(12) United States Patent
Williams et al.

(10) Patent No.: US 9,878,004 B2
(45) Date of Patent: *Jan. 30, 2018

(54) COMPOSITIONS AND FORMULATIONS FOR TREATMENT OF GASTROINTESTINAL TRACT MALABSORPTION DISEASES AND INFLAMMATORY CONDITIONS AND METHODS OF PRODUCTION AND USE THEREOF

(71) Applicant: PRONUTRIA, INC., Cambridge, MA (US)

(72) Inventors: Alison Williams, Cambridge, MA (US); Michael J. Hamill, Wellesley, MA (US); Nathaniel W. Silver, Cambridge, MA (US); Ying-Ja Chen, Cambridge, MA (US); David Arthur Berry, Brookline, MA (US); David V. Erbe, Arlington, MA (US); Chung-Wei Lee, Newton, MA (US); Luke Hamm, Boston, MA (US)

(73) Assignee: Axcella Health Inc., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/024,636

(22) PCT Filed: Sep. 25, 2014

(86) PCT No.: PCT/US2014/057534
§ 371 (c)(1),
(2) Date: Mar. 24, 2016

(87) PCT Pub. No.: WO2015/048340
PCT Pub. Date: Apr. 2, 2015

(65) Prior Publication Data
US 2016/0317614 A1 Nov. 3, 2016

Related U.S. Application Data

(60) Provisional application No. 61/882,300, filed on Sep. 25, 2013, provisional application No. 61/882,235, (Continued)

(51) Int. Cl.
| | |
|---|---|
| *A61K 38/17* | (2006.01) |
| *A61K 45/06* | (2006.01) |
| *A23L 33/18* | (2016.01) |
| *A23L 33/00* | (2016.01) |
| *A61K 38/00* | (2006.01) |
| *A23L 33/17* | (2016.01) |

(Continued)

(52) U.S. Cl.
CPC ............ *A61K 38/1709* (2013.01); *A23L 2/66* (2013.01); *A23L 33/17* (2016.08); *A23L 33/175* (2016.08); *A23L 33/18* (2016.08); *A23L 33/195* (2016.08); *A23L 33/30* (2016.08); *A23L 33/40* (2016.08); *A61K 9/0053* (2013.01); *A61K 9/0075* (2013.01); *A61K 9/0095* (2013.01); *A61K 9/146* (2013.01); *A61K 9/2054* (2013.01); *A61K 9/2866* (2013.01); *A61K 38/00* (2013.01); *A61K 38/10* (2013.01); *A61K 38/16* (2013.01); *A61K 38/164* (2013.01); *A61K 38/168* (2013.01); *A61K 38/17* (2013.01); *A61K 38/1703* (2013.01); *A61K 38/1767* (2013.01); *A61K 38/38* (2013.01); *A61K 38/45* (2013.01); *A61K 45/06* (2013.01); *C12Y 207/04003* (2013.01); *G01N 33/6803* (2013.01); *G01N 33/6806* (2013.01); *G01N 33/6848* (2013.01); *G06F 19/18* (2013.01); *A23V 2002/00* (2013.01); *G01N 2500/00* (2013.01)

(58) Field of Classification Search
CPC .......... A23L 2/66; A23L 33/17; A23L 33/175; A23L 33/18; A23L 33/195; A23L 33/30; A23L 33/40; A23V 2002/00; A61K 38/00; A61K 38/17; A61K 9/0053; A61K 9/0095

See application file for complete search history.

(56) References Cited

U.S. PATENT DOCUMENTS

| | | |
|---|---|---|
| 3,736,150 A | 5/1973 | Basso et al. |
| 4,687,782 A | 8/1987 | Brantman |

(Continued)

FOREIGN PATENT DOCUMENTS

| | | |
|---|---|---|
| AU | 2003290447 A1 | 7/2004 |
| CN | 100353866 A | 3/2006 |

(Continued)

OTHER PUBLICATIONS

Anonymous: "SportProtein.com, Pure Egg Protein," Jul. 13, 2013, 7 pages, [Online] [Retrieved on Apr. 10, 2015] Retrieved from the Internet<URL:http://www.sportprotein.com>.

(Continued)

*Primary Examiner* — Hasan Ahmed
*Assistant Examiner* — Erinne Dabkowski
(74) *Attorney, Agent, or Firm* — Fenwick & West LLP

(57) ABSTRACT

Nutritive polypeptides are provided herein. Also provided are various other embodiments including nucleic acids encoding the polypeptides, recombinant microorganisms that make the polypeptides, vectors for expressing the polypeptides, methods of making the polypeptides using recombinant microorganisms, compositions and formulations that comprise the polypeptides, and methods of using the polypeptides, compositions and formulations.

14 Claims, 117 Drawing Sheets

Related U.S. Application Data filed on Sep. 25, 2013, provisional application No. 61/882,271, filed on Sep. 25, 2013, provisional application No. 61/882,229, filed on Sep. 25, 2013, provisional application No. 61/882,211, filed on Sep. 25, 2013, provisional application No. 61/882,222, filed on Sep. 25, 2013, provisional application No. 61/882,214, filed on Sep. 25, 2013, provisional application No. 61/882,254, filed on Sep. 25, 2013, provisional application No. 61/882,129, filed on Sep. 25, 2013, provisional application No. 61/882,267, filed on Sep. 25, 2013, provisional application No. 61/882,295, filed on Sep. 25, 2013, provisional application No. 61/882,220, filed on Sep. 25, 2013, provisional application No. 61/882,189, filed on Sep. 25, 2013, provisional application No. 61/882,305, filed on Sep. 25, 2013, provisional application No. 61/882,225, filed on Sep. 25, 2013, provisional application No. 61/882,234, filed on Sep. 25, 2013, provisional application No. 61/882,243, filed on Sep. 25, 2013, provisional application No. 61/882,240, filed on Sep. 25, 2013, provisional application No. 61/882,246, filed on Sep. 25, 2013, provisional application No. 61/882,219, filed on Sep. 25, 2013, provisional application No. 61/882,180, filed on Sep. 25, 2013, provisional application No. 61/882,250, filed on Sep. 25, 2013, provisional application No. 61/882,274, filed on Sep. 25, 2013, provisional application No. 61/882,212, filed on Sep. 25, 2013, provisional application No. 61/882,198, filed on Sep. 25, 2013, provisional application No. 61/882,260, filed on Sep. 25, 2013, provisional application No. 61/882,264, filed on Sep. 25, 2013, provisional application No. 61/882,232, filed on Sep. 25, 2013, provisional application No. 61/906,862, filed on Nov. 20, 2013.

(51) Int. Cl.

| | | |
|---|---|---|
| *G01N 33/68* | (2006.01) | |
| *G06F 19/18* | (2011.01) | |
| *A23L 2/66* | (2006.01) | |
| *A61K 38/16* | (2006.01) | |
| *A23L 33/175* | (2016.01) | |
| *A61K 38/38* | (2006.01) | |
| *A61K 9/00* | (2006.01) | |
| *A61K 9/14* | (2006.01) | |
| *A61K 9/20* | (2006.01) | |
| *A61K 9/28* | (2006.01) | |
| *A23L 33/195* | (2016.01) | |
| *A61K 38/10* | (2006.01) | |
| *A61K 38/45* | (2006.01) | |

(56) References Cited

U.S. PATENT DOCUMENTS

| | | | |
|---|---|---|---|
| 7,288,570 | B2 | 10/2007 | Verlaan et al. |
| 8,809,259 | B2 | 8/2014 | Berry et al. |
| 8,822,412 | B2 | 9/2014 | Berry et al. |
| 2002/0192744 | A1* | 12/2002 | Carr ............... C07K 14/77 435/69.1 |
| 2006/0127492 | A1 | 6/2006 | Tsuchita et al. |
| 2006/0280840 | A1 | 12/2006 | Robertson |
| 2010/0196352 | A1 | 8/2010 | O'Donovan et al. |
| 2012/0251512 | A1 | 10/2012 | Farmer et al. |
| 2012/0258236 | A1 | 10/2012 | Cruz et al. |
| 2013/0296231 | A1 | 11/2013 | Berry et al. |
| 2014/0342978 | A1 | 11/2014 | Berry et al. |
| 2014/0343148 | A1 | 11/2014 | Kohsaka et al. |
| 2015/0011482 | A1 | 1/2015 | Berry et al. |
| 2015/0080296 | A1 | 3/2015 | Silver et al. |
| 2015/0087602 | A1 | 3/2015 | von Maltzahn et al. |
| 2015/0126441 | A1 | 5/2015 | Berry et al. |
| 2015/0232520 | A1 | 8/2015 | Hamill et al. |
| 2016/0219910 | A1 | 8/2016 | Silver et al. |
| 2016/0228503 | A1 | 8/2016 | Silver et al. |
| 2016/0228506 | A1 | 8/2016 | Afeyan et al. |
| 2016/0339078 | A1 | 11/2016 | Hamill et al. |
| 2016/0354436 | A1 | 12/2016 | Williams et al. |

FOREIGN PATENT DOCUMENTS

| | | |
|---|---|---|
| CN | 101715964 A | 6/2010 |
| EP | 1455603 A1 | 9/2004 |
| EP | 1865944 A2 | 12/2007 |
| EP | 2744356 A1 | 6/2014 |
| EP | 3027181 A1 | 6/2016 |
| FR | 2882896 A1 | 9/2006 |
| WO | WO 94/28126 A2 | 12/1994 |
| WO | WO 00/77034 A2 | 12/2000 |
| WO | WO 02/15720 A2 | 2/2002 |
| WO | WO 03/061565 A2 | 7/2003 |
| WO | WO 2004/056208 A1 | 7/2004 |
| WO | WO 2005/042012 A1 | 5/2005 |
| WO | WO 2006/105112 A2 | 10/2006 |
| WO | WO 2007/023172 A2 | 3/2007 |
| WO | WO 2007/038623 A2 | 4/2007 |
| WO | WO 2007/103525 A2 | 9/2007 |
| WO | WO 2008/140335 A2 | 11/2008 |
| WO | WO 2011/078654 A1 | 6/2011 |
| WO | WO 2012/024611 A1 | 2/2012 |
| WO | WO 2012/081971 A1 | 6/2012 |
| WO | WO 2012/113415 A1 | 8/2012 |
| WO | WO 2012/135499 A1 | 10/2012 |
| WO | WO 2012/143402 A1 | 10/2012 |
| WO | WO 2013/017553 A1 | 2/2013 |
| WO | WO 2013/028547 A1 | 2/2013 |
| WO | WO 2013/058294 A1 | 4/2013 |
| WO | WO 2013/133727 A1 | 9/2013 |
| WO | WO 2013/148325 A1 | 10/2013 |
| WO | WO 2013/148328 A1 | 10/2013 |
| WO | WO 2013/148330 A1 | 10/2013 |
| WO | WO 2013/148331 A1 | 10/2013 |
| WO | WO 2013/148332 A1 | 10/2013 |
| WO | WO 2013/163654 A2 | 10/2013 |
| WO | WO 2014/020004 A1 | 2/2014 |
| WO | WO 2014/134225 A2 | 9/2014 |
| WO | WO 2015/015149 A1 | 2/2015 |

OTHER PUBLICATIONS

Brockerhoff, S.E. et al., "Structural Analysis of Wild-Type and Mutant Yeast Calmodulins by Limited Proteolysis and Electrospray Ionization Mass Spectrometry," Protein Science, 1992, pp. 504-516, vol. 1.

Domanski, M. et al., "Sarcopenia: A Major Challenge in Elderly Patients with End-Stage Renal Disease," Journal of Aging Research, Jan. 2012, pp. 93-112, vol. 28, No. 164.

Hida, A. et al., "Effects of Egg White Protein Supplementation on Muscle Strenth and Serum Free Amino Acid Concentrations," Nutrients, Dec. 19, 2012, pp. 1504-1517, vol. 4, No. 12.

Kalman, D., "Amino Acid Composition of an Organic Brown Rice Protein Concentrate and Isolate Compared to Soy and Whey Concentrates and Isolates," Foods, Jun. 30, 2014, pp. 394-402, vol. 3, No. 3.

Lollo, P.C.B. et al., "Effects of Whey Protein and Casein Plus Leucine on Diaphram the mTOR Patheway of Sedentary, Trained Rats," Food Research International, Nov. 2012, pp. 416-424, vol. 49, No. 1.

PCT Invitation to Pay Additional Fees, PCT Application No. PCT/US2014/057534, dated May 20, 2015, 9 pages.

PCT Invitation to Pay Additional Fees, PCT Application No. PCT/US2014/057537 dated Mar. 18, 2015, 11 pages.

(56) References Cited

OTHER PUBLICATIONS

PCT Invitation to Pay Additional Fees, PCT Application No. PCT/US2014/057542, dated Apr. 29, 2015, 18 pages.
PCT Invitation to Pay Additional Fees, PCT Application No. PCT/US2014/057543, dated May 4, 2015, 18 pages.
PCT Invitation to Pay Additional Fees, PCT Application No. PCT/US2014/057546, dated May 20, 2015, 9 pages.
PCT International Search Report and Written Opinion, PCT Application No. PCT/US2014/057534, dated Aug. 12, 2015, 21 pages.
PCT International Search Report and Written Opinion, PCT Application No. PCT/US2014/057537, dated Jun. 24, 2015, 24 pages.
PCT International Search Report and Written Opinion, PCT Application No. PCT/US2014/057542, dated Jul. 13, 2015, 18 pages.
PCT International Search Report and Written Opinion, PCT Application No. PCT/US2014/057543, dated Jul. 10, 2015, 18 pages.
PCT International Search Report and Written Opinion, PCT Application No. PCT/US2014/057546, dated Aug. 12, 2015, 21 pages.
Sousa, G.TD. Et al., "Dietary Whey Protein Lessens Several Risk Factors for Metabolic Diseases: A Review," Lipids in Health and Disease, Biomed 9 pages, vol. 11, No. 1.
Van Norren, K. et al., "Dietary Supplementation with a Specific Combination of High Protein, Leucine, and Fish Oil Improves Muscle Function and Daily Activity in Tumour-Bearing Cachectic Mice," British Journal of Cancer, Mar. 10, 2009, pp. 713-722, vol. 100, No. 5.
United States Restriction Requirement, U.S. Appl. No. 15/024,644, dated Dec. 2, 2016, 10 pages.
U.S. Appl. No. 11/909,740, filed Jun. 23, 2010, Inventors: Kobayashi et al.
U.S. Appl. No. 14/239,323, filed Jul. 14, 2014, Inventors: Serrano et al.
Berendsen, H.J., "A Glimpse of the Holy Grail?," Science, Oct. 23, 1998, pp. 642-643, vol. 282, No. 5389.
Bradley, C.M. et al., "Limits of Cooperativity in a Structurally Modular Protein: Response of the Notch Ankyrin Domain to Analogous Alanine Substitutions in Each Repeat," J. Mol. Biol., 2002, pp. 373-386, vol. 324.
Eghtesad, S. et al., "Malnutrition in Liver Cirrhosis: The Influence of Protein and Sodium," Middle East Journal of Digestive Diseases, Apr. 2013, pp. 65-75, vol. 5, No. 2.
European Communication Under Rule 164(2)(a) EPC, European Application No. 14792628.1, dated Feb. 13, 2017, 5 pages.
European Communication Under Rule 164(2)(a) EPC, European Application No. 14796570.1, dated Feb. 15, 2017, 4 pages.
European Communication Under Rule 164(2)(a) EPC, European Application No. 14796569.3, dated Feb. 17, 2017, 4 pages.
Gordon, Metformin Preferred Drug for Type 2 Diabetes, Experts Say, Feb. 6, 2012, pp. 1-3, May be retrieved at<URL:http://health.usnews.com/health-news/news/articles/2012/02/06/metformin-preferred.drug-for-type-2-diabetes-experts-say>.
Ngo, J.T. et al., "Computational Complexity, Protein Structure Protection and the Levinthal Paradox," The Protein Folding Problem and Tertiary Structure Prediction, K. Merz Jr. et al., (Eds.), 1994, pp. 491-494.
Rudinger, J., Chapter 1: "Characteristics of the Amino Acids as Components of a Peptide Hormone Sequence," Peptide Hormones, JA Parsons, (Ed.), 1976, pp. 1-7.
Sigma-Genosys, Designing Custom Peptides, Dec. 16, 2004, pp. 1-2, May be Retrieved at<URL:http://www.sigma-genosys.com/peptide_design.asp>.
Voet, D. et al., Biochemistry, John Wiley & Sons Inc., 1995, pp. 235-241.
United States Office Action, U.S. Appl. No. 15/024,644, dated Apr. 12, 2017, 30 pages.
United States Restriction Requirement, U.S. Appl. No. 15/024,648, dated Apr. 12, 2017, 10 pages.
Anonymous: "Calmodulin," Nov. 18, 2012, 4 pages, [Online] [Retrieved on Mar. 27, 2017] Retrieved from the Internet<URL:http://calmodulinnutrition.blogspot.de>.
Anonymous: "Miracle Cure with Calmodulin (CAM)," May 1, 2012, 5 pages, [Online] [Retrieved on Apr. 3, 2017] Retrieved from the Internet<URL:http://calmodulinsupplement.blogspot.de/2012/05/final-state-cancer-patients-recovery-at.html>.
Boulhosa, R.S.S.B. et al., "The Impact of Nutritional Supplementation on Quality of Life in Patients Infected with Hepatitis C Virus," Journal of Human Nutrition and Dietetics, The British Dietetic Association Ltd., 2013, pp. 7-15.
Canadian Office Action, Canadian Application No. 2,925,557, dated May 16, 2017, 6 pages.
Canadian Office Action, Canadian Application No. 2,925,521, dated Aug. 9, 2017, 6 pages.
European Examination Report, European Application No. 14796569.3, dated Apr. 25, 2017, 12 pages.
European Examination Report, European Application No. 14792628.1, dated Apr. 25, 2017, 14 pages.
European Examination Report, European Application No. 14796570.1, dated Apr. 25, 2017, 12 pages.
Fiaccadori, E. et al., "Specific Nutritional Problems in Acute Kidney Injury, Treated with Non-Dialysis and Dialytic Modalities," NDT Plus, 2010, pp. 1-7, vol. 3.
"A List of Kidney Diseases," Joshua Schwimmer, MD: Nephrology and Hypertension, kidney.nyc, pp. 1-12, [Online] [Retrieved on Jul. 18, 2017], Retrieved from the Internet<URL:http://www.kidney.nyc/types-of-kidney-disease/>.
"Nutrition and Renal Disease," The Physicians Committee, pp. 1-16, Online] [Retrieved on Jul. 18, 2017], Retrieved from the Internet<URL:http://www.pcrm.org/health/health-topics/nutrition-and-renal-disease>.
United States Office Action, U.S. Appl. No. 15/024,648, dated Aug. 17, 2017, 36 pages.
United States Office Action, U.S. Appl. No. 15/024,644, dated Aug. 25, 2017, 19 pages.
Canadian Office Action, Canadian Application No. 2,925,450, dated Aug. 16, 2017, 7 pages.

* cited by examiner

COMPOSITIONS AND FORMULATIONS FOR TREATMENT OF GASTROINTESTINAL TRACT MALABSORPTION DISEASES AND INFLAMMATORY CONDITIONS AND METHODS OF PRODUCTION AND USE THEREOF

CROSS REFERENCE TO RELATED APPLICATIONS

This application claims the benefit of U.S. Provisional Application No. 61/882,211, filed Sep. 25, 2013, 61/882,214, filed Sep. 25, 2013, 61/882,219, filed Sep. 25, 2013, 61/882,220, filed Sep. 25, 2013, 61/882,225, filed Sep. 25, 2013, 61/882,229, filed Sep. 25, 2013, 61/882,232, filed Sep. 25, 2013, 61/882,234, filed Sep. 25, 2013, 61/882,235, filed Sep. 25, 2013, 61/882,240, filed Sep. 25, 2013, 61/882,129, filed Sep. 25, 2013, 61/882,243, filed Sep. 25, 2013, 61/882,246, filed Sep. 25, 2013, 61/882,250, filed Sep. 25, 2013, 61/882,254, filed Sep. 25, 2013, 61/882,260, filed Sep. 25, 2013, 61/882,264, filed Sep. 25, 2013, 61/882,267, filed Sep. 25, 2013, 61/882,271, filed Sep. 25, 2013, 61/882,274, filed Sep. 25, 2013, 61/882,180, filed Sep. 25, 2013, 61/882,189, filed Sep. 25, 2013, 61/882,198, filed Sep. 25, 2013, 61/882,212, filed Sep. 25, 2013, 61/882,222, filed Sep. 25, 2013, 61/882,300, filed Sep. 25, 2013, 61/882,295, filed Sep. 25, 2013, and 61/882,305, filed Sep. 25, 2013; the entire disclosures of which are hereby incorporated by reference in their entirety for all purposes.

BACKGROUND

Dietary protein is an essential nutrient for human health and growth. The World Health Organization recommends that dietary protein should contribute approximately 10 to 15% of energy intake when in energy balance and weight stable. Average daily protein intakes in various countries indicate that these recommendations are consistent with the amount of protein being consumed worldwide. Meals with an average of 20 to 30% of energy from protein are representative of high-protein diets when consumed in energy balance. The body cannot synthesize certain amino acids that are necessary for health and growth, and instead must obtain them from food. These amino acids, called "essential amino acids", are Histidine (H), Isoleucine (I), Leucine (L), Lysine (K), Methionine (M), Phenylalanine (F), Threonine (T), Tryptophan (W), and Valine (V). Dietary protein sources that provide all the essential amino acids are referred to as "high quality" proteins. Animal foods such as meat, fish, poultry, eggs, and dairy products are generally regarded as high quality protein sources that provide a good balance of essential amino acids. Casein (a protein commonly found in mammalian milk, making up 80% of the proteins in cow milk) and whey (the protein in the liquid that remains after milk has been curdled and strained) are major sources of high quality dietary protein. Foods that do not provide a good balance of essential amino acids are referred to as "low quality" protein sources. Most fruits and vegetables are poor sources of protein. Some plant foods including beans, peas, lentils, nuts and grains (such as wheat) are better sources of protein but may have allergenicity issues. Soy, a vegetable protein manufactured from soybeans, is considered by some to be a high quality protein. Studies of high protein diets for weight loss have shown that protein positively affects energy expenditure and lean body mass. Further studies have shown that overeating produces significantly less weight gain in diets containing at least 5% of energy from protein, and that a high-protein diet decreases energy intake. Proteins commonly found in foods do not necessarily provide an amino acid composition that meets the amino acid requirements of a mammal, such as a human, in an efficient manner. The result is that, in order to attain the minimal requirements of each essential amino acid, a larger amount of total protein must be consumed in the diet than would be required if the quality of the dietary protein were higher. By increasing the quality of the protein in the diet it is possible to reduce the total amount of protein that must be consumed compared to diets that include lower quality proteins. Traditionally, desirable mixtures of amino acids, such as mixtures comprising essential amino acids, have been provided by hydrolyzing a protein with relatively high levels of essential amino acids, such as whey protein, and/or by combining free amino acids in a mixture that optionally also includes a hydrolyzed protein such as whey. Mixtures of this type may have a bitter taste, undesirable mouthfeel and are poorly soluble, and may be deemed unsuitable or undesirable for certain uses. As a result, such mixtures sometimes include flavoring agents to mask the taste of the free amino acids and/or hydrolyzed protein. In some cases compositions in which a proportion of the amino acid content is provided by polypeptides or proteins are found to have a better taste than compositions with a high proportion of total amino acids provided as free amino acids and/or certain hydrolyzed proteins. The availability of such compositions has been limited, however, because nutritional formulations have traditionally been made from protein isolated from natural food products, such as whey isolated from milk, or soy protein isolated from soy. The amino acid profiles of those proteins do not necessarily meet the amino acid requirements for a mammal. In addition, commodity proteins typically consist of mixtures of proteins and/or protein hydrolysates which can vary in their protein composition, thus leading to unpredictability regarding their nutritional value. Moreover, the limited number of sources of such high quality proteins has meant that only certain combinations of amino acids are available on a large scale for ingestion in protein form. The agricultural methods required for the supply of high quality animal protein sources such as casein and whey, eggs, and meat, as well as plant proteins such as soy, also require significant energy inputs and have potentially deleterious environmental impacts.

Accordingly, it would be useful in certain situations to have alternative sources and methods of supplying proteins for mammalian consumption. One feature that can enhance the utility of a nutritive protein is its solubility. Nutritive proteins with higher solubility can exhibit desirable characteristics such as increased stability, resistance to aggregation, and desirable taste profiles. For example, a nutritive protein that exhibits enhanced solubility can be formulated into a beverage or liquid formulation that includes a high concentration of nutritive protein in a relatively low volume of solution, thus delivering a large dose of protein nutrition per unit volume. A soluble nutritive protein can be useful in sports drinks or recovery drinks wherein a user (e.g., an athlete) wants to ingest nutritive protein before, during or after physical activity. A nutritive protein that exhibits enhanced solubility can also be particularly useful in a clinical setting wherein a subject (e.g., a patient or an elderly person) is in need of protein nutrition but is unable to consume solid foods or large volumes of liquids.

SUMMARY OF THE INVENTION

In one aspect, the invention provides methods of preventing or reducing loss of muscle mass and/or muscle function in a human subject, including the steps of: i) identifying a human subject suffering from or at risk of a gastrointestinal protein malabsorption disease, disorder or condition, and ii) administering to the human subject a nutritional formulation in an amount sufficient to prevent or reduce a loss of muscle mass and/or muscle function, wherein the nutritional formulation includes an isolated nutritive polypeptide including an amino acid sequence at least about 90% identical over at least about 50 amino acids to a polypeptide sequence provided herein; wherein the formulation includes at least 1.0 g of the nutritive polypeptide; wherein the formulation is present as a liquid, semi-liquid or gel in a volume not greater than about 500 ml or as a solid or semi-solid in a total mass not greater than about 200 g; and wherein the formulation is substantially free of non-comestible products. In one embodiment, the human subject is suffering from a gastrointestinal protein malabsorption disease, disorder or condition and has received one or more doses of a pharmaceutical composition, wherein administration of the pharmaceutical composition increases a risk of loss of muscle mass and/or muscle function. In one embodiment, the human subject is suffering from a gastrointestinal protein malabsorption disease, disorder or condition and has received one or more doses of a pharmaceutical composition, wherein i) the disease, disorder or condition or ii) the administration of the pharmaceutical composition, or both i) and ii) increases a risk of loss of muscle mass and/or muscle function.

In another aspect, the invention provides methods of treating a gastrointestinal protein malabsorption disease, disorder or condition in a human subject in need thereof, including the step of administering to the human subject a nutritional formulation in an amount sufficient to treat such disease, disorder or condition, wherein the nutritional formulation includes an isolated nutritive polypeptide including an amino acid sequence at least about 90% identical over at least about 50 amino acids to a polypeptide sequence provided herein; wherein the formulation includes at least 1.0 g of the nutritive polypeptide. In one embodiment, the formulation is administered on a dosage schedule sufficient to provide substantial protein nutrition to the human subject in the absence of consumption by the subject of an agriculturally-derived food product.

In another aspect, the invention provides methods of reducing the risk of a human subject developing a gastrointestinal protein malabsorption disease, disorder or condition characterized or exacerbated by protein malnourishment, including the steps of (i) identifying the human subject as being at risk of developing the disease, disorder or condition; and (ii) administering in one or more doses a nutritional formulation including an isolated nutritive polypeptide including an amino acid sequence at least about 90% identical over at least about 50 amino acids to a polypeptide sequence provided herein; wherein the formulation includes at least 1.0 g of the nutritive polypeptide. In one embodiment, the human subject is at risk of developing malnutrition or protein malnutrition. In one embodiment, the human subject has a dysphagia. In one embodiment, the human subject has an oropharyngeal dysphagia. In one embodiment, the human subject has an esophageal dysphagia. In one embodiment, the human subject has a functional dysphagia. In one embodiment, the human subject has a gastrointestinal disorder or a short bowel syndrome gastrointestinal disorder. In one embodiment, the nutritional formulation is administered in conjunction with an exercise regimen. In one embodiment, the nutritional formulation is administered as an adjunct to a surgical procedure. In one embodiment, the subject is immobilized or mobility-impaired following the surgical procedure. In one embodiment, the nutritional formulation is administered as an adjunct to administration of a pharmaceutical composition. In one embodiment, the human subject has an eating disorder.

In another aspect, the invention provides methods of increasing muscle anabolism in a human subject suffering from a gastrointestinal protein malabsorption disease, including administering to a human subject in one or more doses a nutritional formulation including an isolated nutritive polypeptide including an amino acid sequence at least about 90% identical over at least about 50 amino acids to a polypeptide sequence provided herein; wherein the formulation includes at least 1.0 g of the nutritive polypeptide, wherein the nutritive formulation is administered to the human subject at a frequency sufficient to increase muscle anabolism in the subject after the administration thereof.

In another aspect, the invention provides methods of formulating a nutritional product for use in treating a human subject, including the steps of providing to a human subject suffering from or at risk of a gastrointestinal protein malabsorption disease, disorder, or condition, a nutritive composition including an isolated nutritive polypeptide including an amino acid sequence at least about 90% identical over at least about 50 amino acids to a polypeptide sequence provided herein; and formulating the nutritive polypeptide with an acceptable excipient, wherein the isolated nutritive polypeptide has an aqueous solubility at pH 7 of at least 12.5 g/L, and wherein the isolated nutritive polypeptide has a simulated gastric digestion half-life of less than 30 minutes. In one embodiment, the methods further include combining the nutritive composition with at least one of a tastant, a nutritional carbohydrate and a nutritional lipid, wherein the product is present as a liquid, semi-liquid or gel in a volume not greater than about 500 ml or as a solid or semi-solid in a total mass not greater than about 200 g. In one embodiment, the product is substantially free of non-comestible products.

In another aspect, the invention provides methods for selecting an amino acid sequence of a nutritive polypeptide wherein the nutritive polypeptide is suitable for use in treating a human subject suffering from or at risk of a gastrointestinal protein malabsorption disease, disorder, or condition, including i) providing a library of amino acid sequences including a plurality of amino acid sequences, ii) identifying in the library one or more amino acid sequences including at least one amino acid of interest, and iii) selecting the one or more identified amino acid sequences, thereby selecting an amino acid sequence of a nutritive polypeptide.

In another aspect, the invention provides methods for selecting an amino acid sequence of a nutritive polypeptide wherein the nutritive polypeptide is suitable for use in treating a human subject suffering from or at risk of a gastrointestinal protein malabsorption disease, disorder, or condition, including i) providing a library of amino acid sequences including a plurality of amino acid sequences, ii) identifying in the library one or more amino acid sequences including a ratio of at least one amino acid residues of interest to total amino acid residues greater than or equal to a selected ratio, and iii) selecting the one or more identified amino acid sequences, thereby selecting an amino acid sequence of a nutritive polypeptide.

In another aspect, the invention provides methods for selecting an amino acid sequence of a nutritive polypeptide wherein the nutritive polypeptide is suitable for use in treating a human subject suffering from or at risk of a gastrointestinal protein malabsorption disease, disorder, or condition, including i) providing a library of amino acid sequences including a plurality of amino acid sequences, ii) identifying in the library one or more amino acid sequences including a ratio of at least one amino acid residues of interest to total amino acid residues less than or equal to a selected ratio, and iii) selecting the one or more identified amino acid sequences, thereby selecting an amino acid sequence of a nutritive polypeptide.

In another aspect, the invention provides nutritive formulations for the treatment or prevention of a gastrointestinal protein malabsorption disease, disorder or condition in a human subject, including an isolated nutritive polypeptide including an amino acid sequence at least about 90% identical over at least about 50 amino acids to a polypeptide sequence provided herein; wherein the nutritive polypeptide is present in an amount sufficient to provide a nutritional benefit to a human subject having reduced protein absorption capacity. In one embodiment, the polypeptide sequence includes a ratio of essential amino acid residues to total amino acid residues of at least 34% and wherein the polypeptide sequence is nutritionally complete. In one embodiment, the essential amino acids present in the nutritive polypeptide are substantially bioavailable. In one embodiment, the isolated nutritive polypeptide has an aqueous solubility at pH 7 of at least 12.5 g/L. In one embodiment, the isolated nutritive polypeptide has a simulated gastric digestion half-life of less than 30 minutes. In one embodiment, the nutritive polypeptide is formulated in a pharmaceutically acceptable carrier. In one embodiment, the nutritive polypeptide is formulated in or as a food or a food ingredient. In one embodiment, the nutritive polypeptide is formulated in or as a beverage or a beverage ingredient. In one embodiment, the amino acid sequence encodes an enzyme having a primary activity, and wherein the nutritive polypeptide substantially lacks the primary activity. In one embodiment, the formulation is present as a liquid, semi-liquid or gel in a volume not greater than about 500 ml or as a solid or semi-solid in a total mass not greater than about 200 g. In one embodiment, the nutritive polypeptide includes an amino acid sequence at least about 90% identical to an edible species polypeptide or fragment thereof at least 50 amino acids in length, wherein the amino acid sequence has less than about 50% identity over at least 25 amino acids to a known allergen. In one embodiment, the formulations further include a component selected from a tastant, a protein mixture, a polypeptide, a peptide, a free amino acid, a carbohydrate, a lipid, a mineral or mineral source, a vitamin, a supplement, an organism, a pharmaceutical, and an excipient. In one embodiment, the human subject is suffering from a muscle wasting disease, disorder or condition. In one embodiment, the amino acid sequence contains a density of essential amino acids about equal to or greater than the density of essential chain amino acids present in a full-length reference nutritional polypeptide or a reference polypeptide-containing mixture. In one embodiment, the amino acid sequence contains a density of at least one amino acid selected from the group consisting of leucine, arginine and glutamine about equal to or greater than the density of the selected amino acid present in a full-length reference nutritional polypeptide or a reference polypeptide-containing mixture.

In another aspect, the invention provides formulations including at least one nutritive polypeptide including an amino acid sequence at least about 99% identical to an edible species polypeptide capable of being secreted from a microorganism, wherein the nutritive polypeptide is present in the formulation in an amount sufficient to provide a nutritional benefit equivalent to or greater than at least about 2% of a reference daily intake value of protein.

A nutritive formulation for the treatment or prevention of a gastrointestinal protein malabsorption disease, disorder or condition in a human subject, including a nutritive amino acid composition including a plurality of free amino acids including an amino acid ratio at least about 90% identical to an amino acid ratio of a polypeptide sequence provided herein, wherein the nutritive amino acid composition is nutritionally complete; wherein the nutritive amino acid composition is present in an amount sufficient to provide a nutritional benefit to a human subject having reduced protein absorption capacity. In one embodiment, the formulation is present as a liquid, semi-liquid or gel in a volume not greater than about 500 ml or as a solid or semi-solid in a total mass not greater than about 200 g.

BRIEF DESCRIPTION OF THE FIGURES

These and other features, aspects, and advantages of the present invention will become better understood with regard to the following description, and accompanying drawings, where.

change in ellipticity at a given wavelength over the temperature range for that SEQID-00105.

Figure 49:
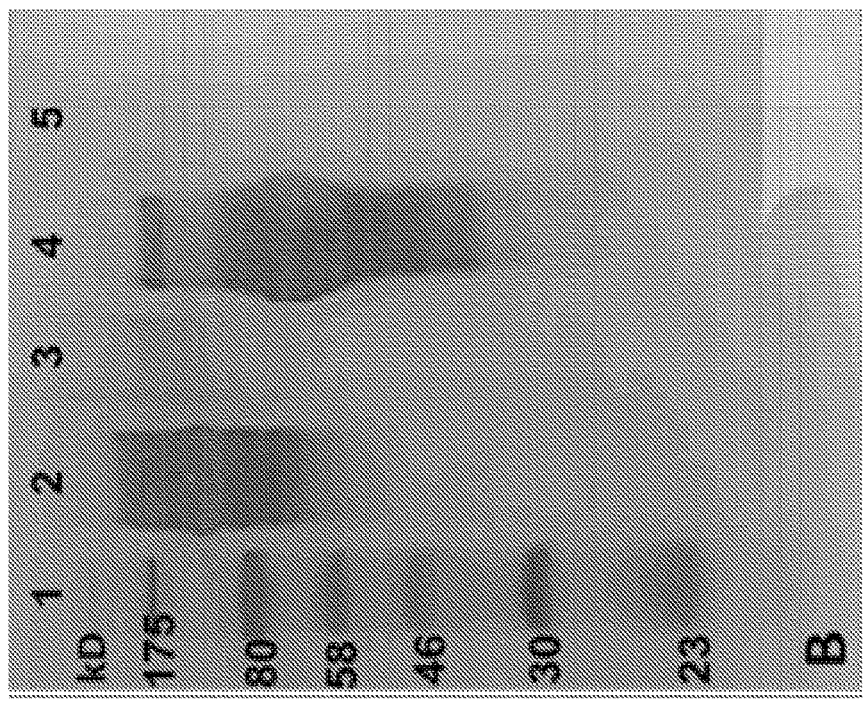
Figure 49:
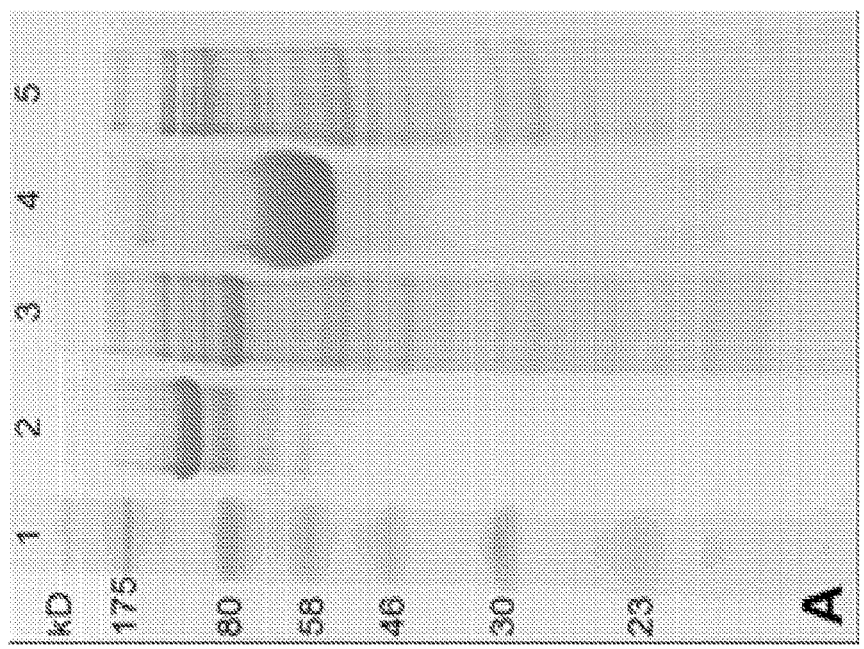

FIG. 49 is an image demonstrating Western blot analysis for mannose-containing glycans. A) Coomassie-stained gel. B) GNA blotted membrane. In both panels, lanes are as follows: 1) Pre-stained protein ladder, 2) SEQID-00363 (5 µg) from *A. niger*, 3) whole cell extract (5 µg) from *E. coli* transformed with an expression vector encoding SEQID-00363, 4), GNA positive control carboxypeptidase (5 µg), 5) soluble lysate (5 µg) from *E. coli* transformed with an expression vector encoding SEQID-00363.

Figure 50:
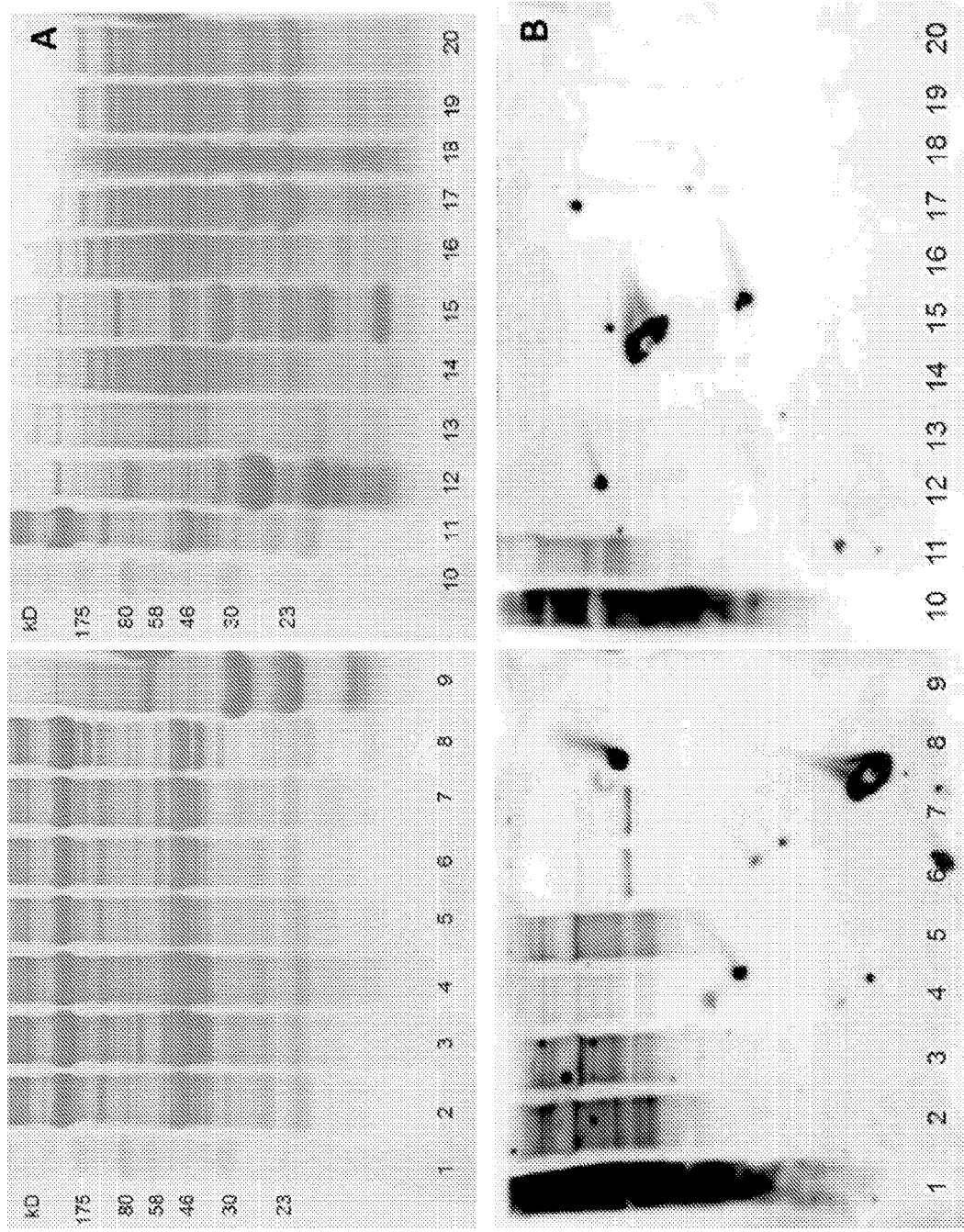

FIG. 50 is an image demonstrating Western blot analysis for Neu5Gc. A) Coomassie-stained gel. B) anti-Neu5Gc probed membrane. In both panels, lanes are as follows: 1 & 10) Pre-stained protein ladder (New England Biolab), 2 & 11) beef extract (30 µg), 3) pork extract (30 µg), 4) deer extract (30 µg), 5) lamb extract (30 µg), 6) turkey extract (30 µg), 7) chicken extract (30 µg), 8) cod extract (30 µg), 9) Protein Mixture 1 (10 µg), 12-15) 168 nutritive polypeptide library (30 µg) expressed in 12) *E. coli* (IMAC-purified lysate), 13) *B. subtilis* (supernatant), 14) *B. subtilis* (lysate), 15) *B. subtilis* (IMAC-purified lysate), 16-20) cDNA Library (30 µg) expressed in 16) *B. subtilis* (PH951 Grac lysate), 17) *E. coli* (Rosetta soluble lysate), 18) *E. coli* (Rosetta whole cell), 19) *E. coli* (GamiB lysate), and 20) *E. coli* (Gami2 lysate).

Figure 51:
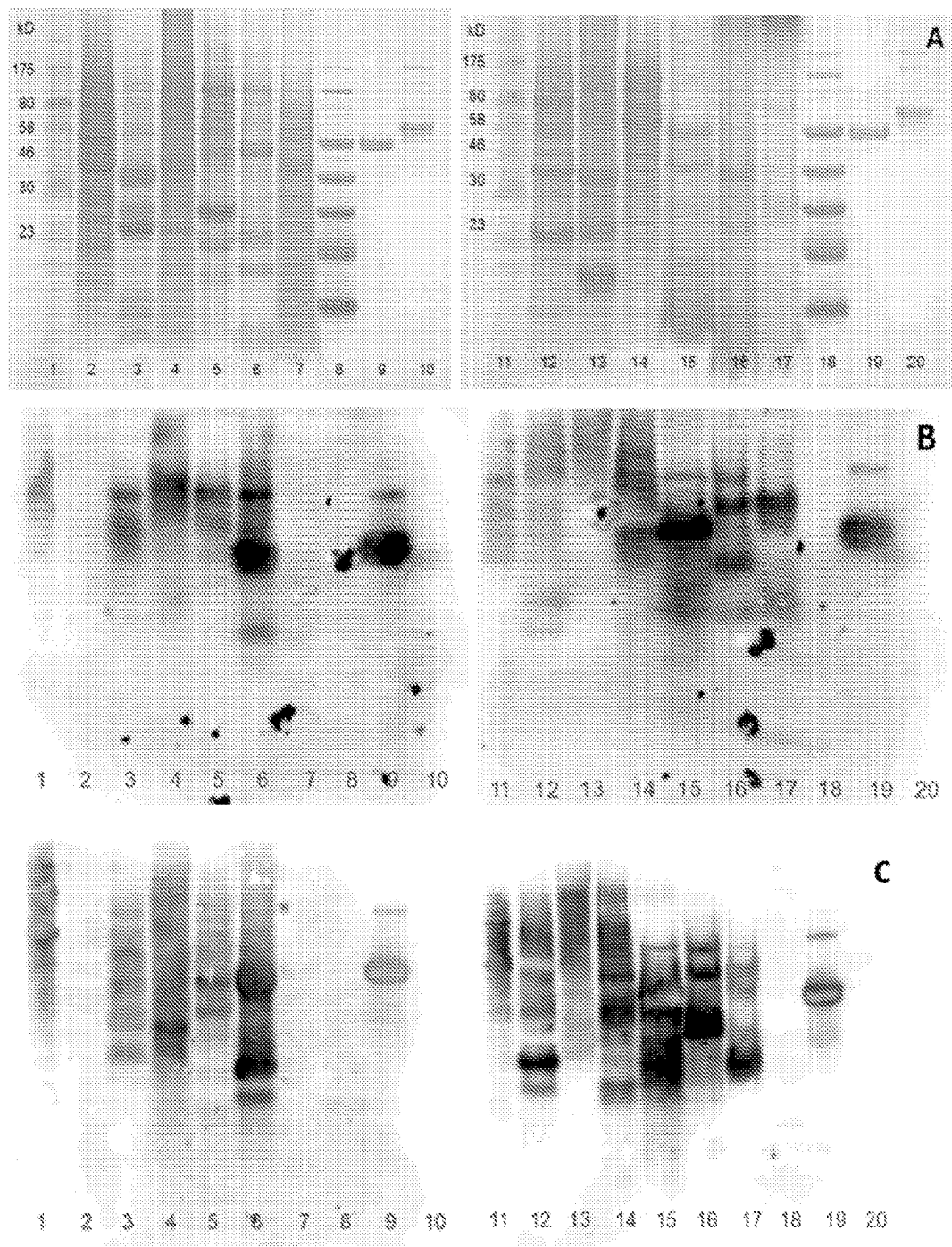
Figure 52A:
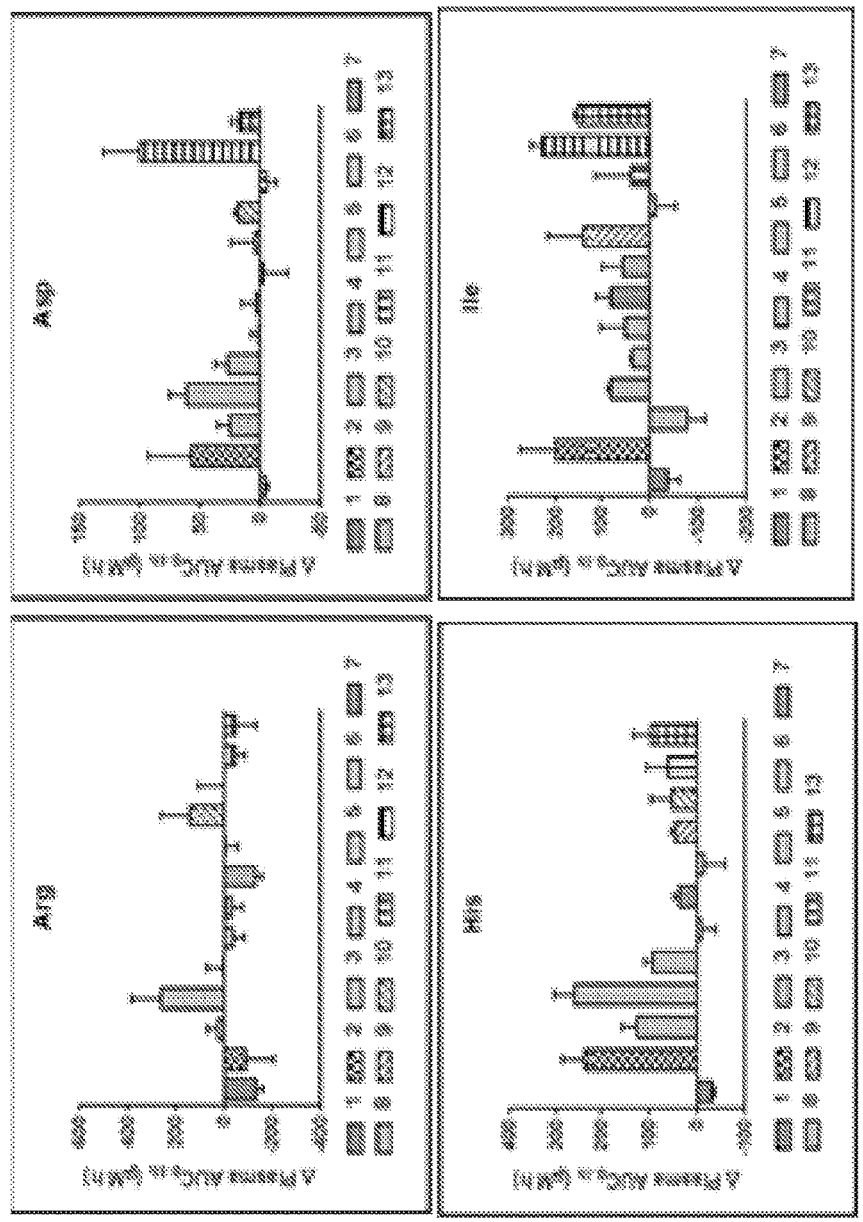
Figure 52B:
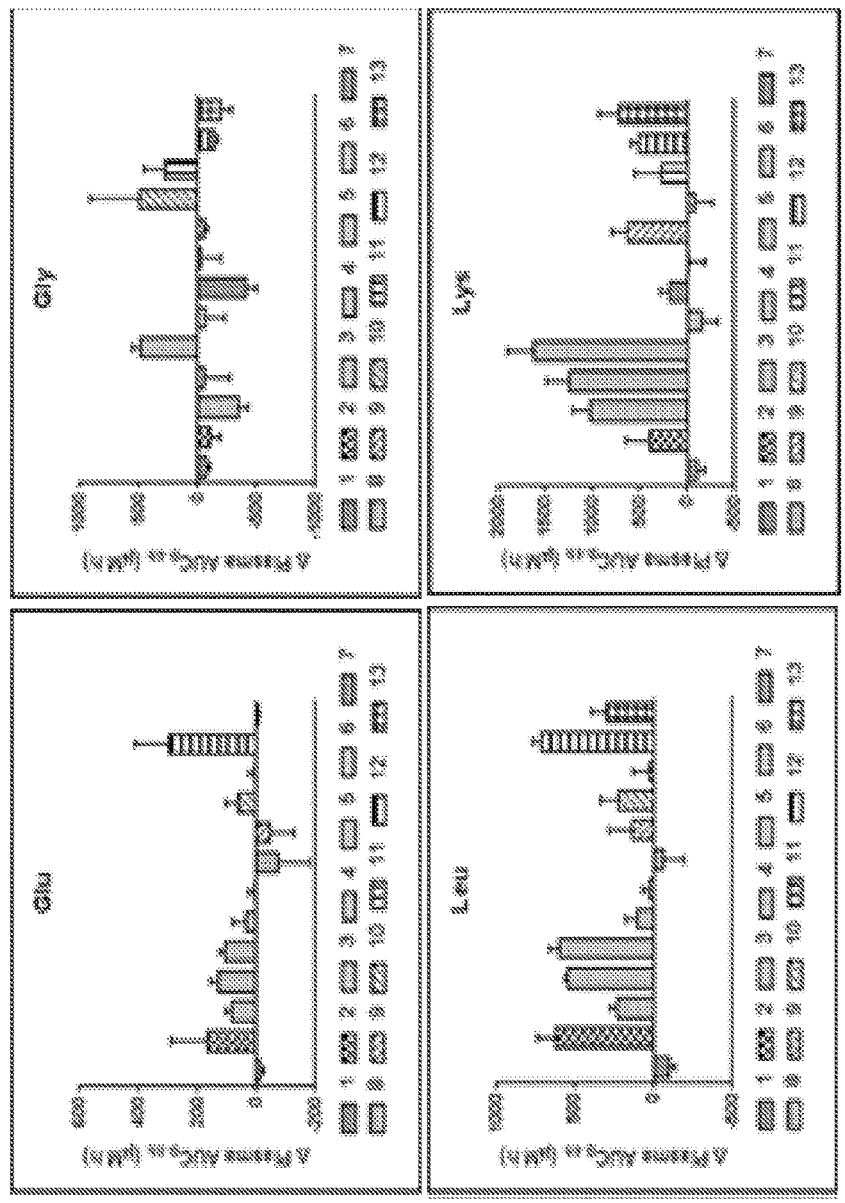
Figure 52C:
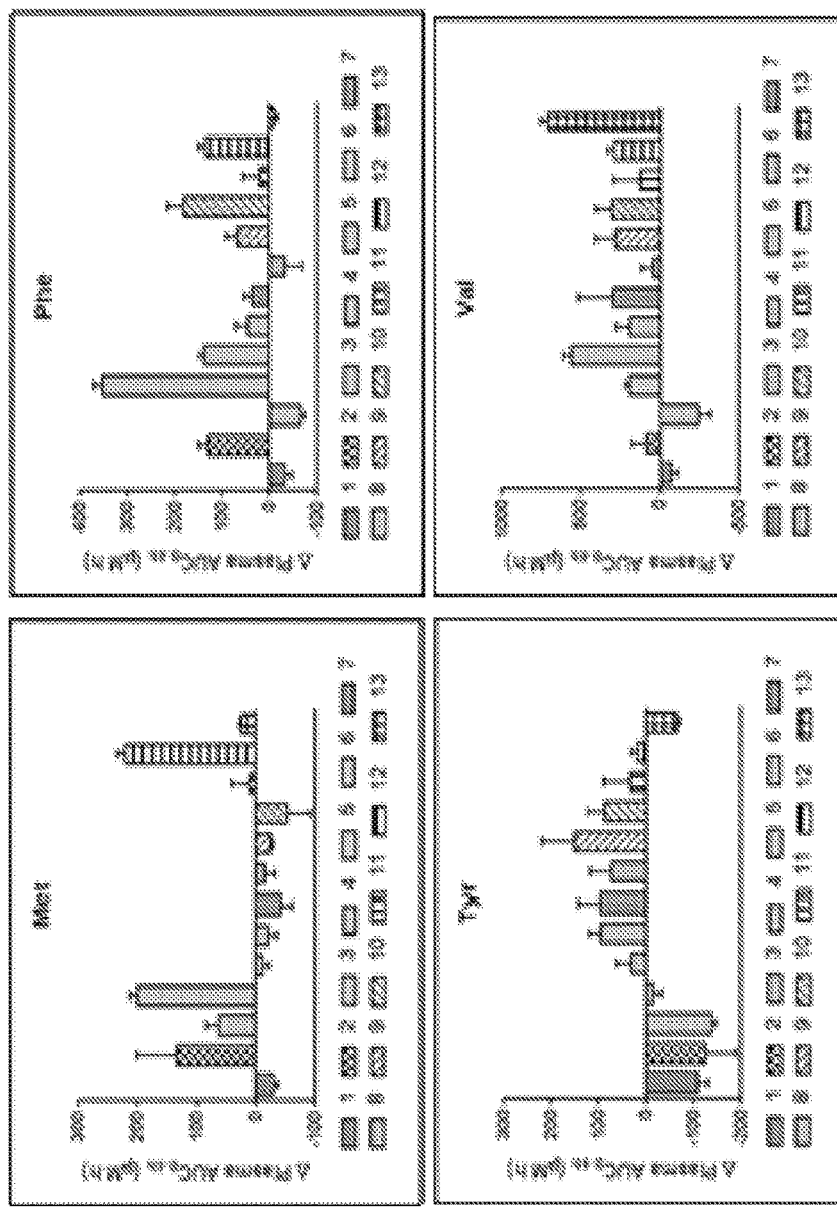
Figure 52D:
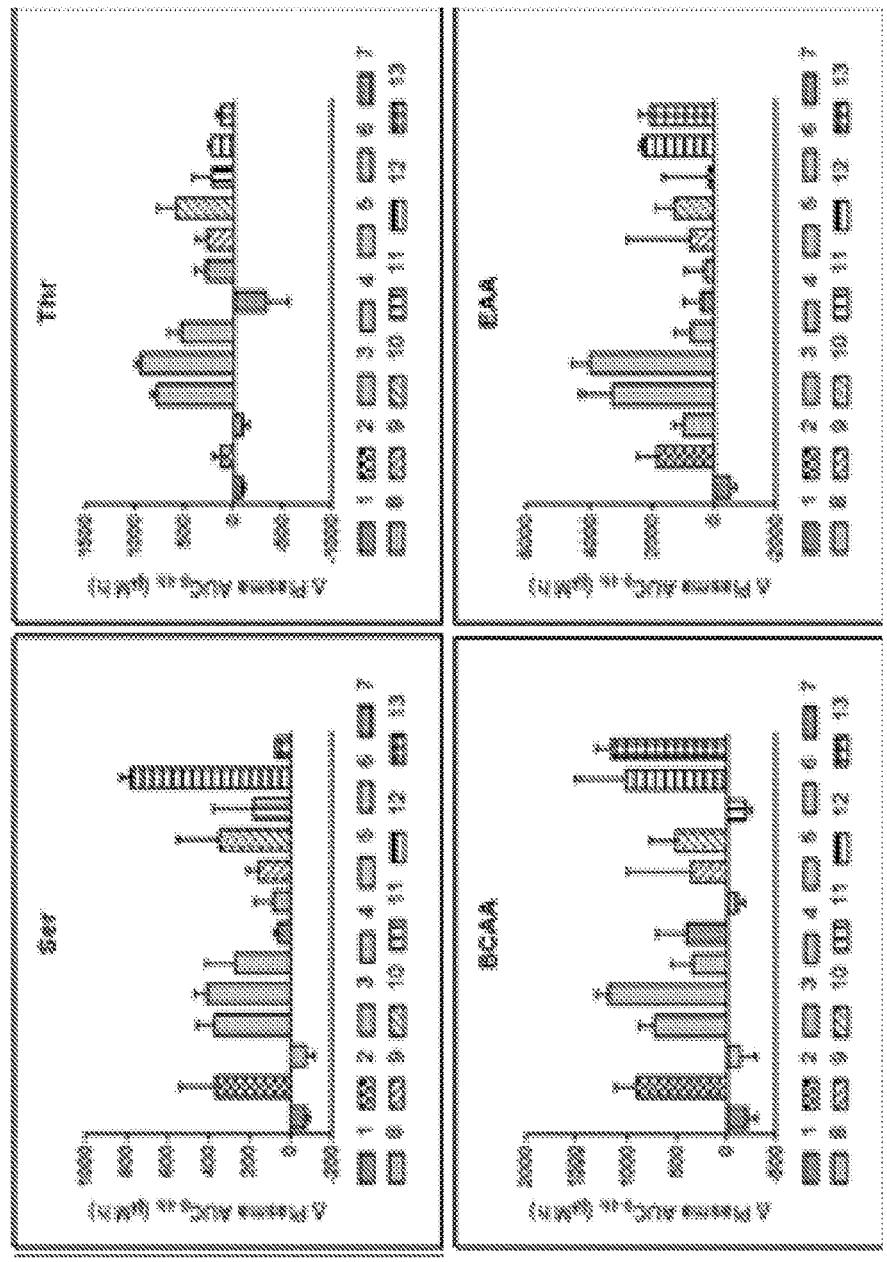
Figure 53A:
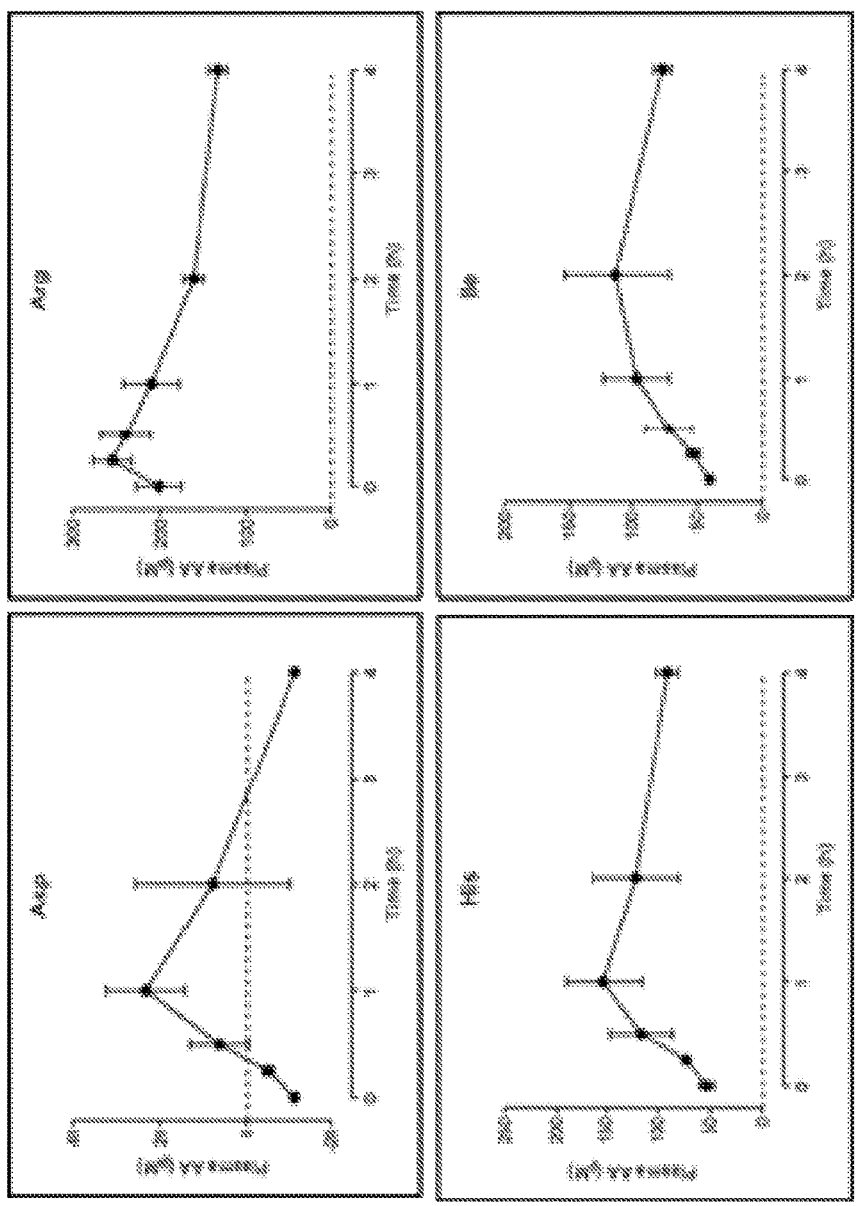
Figure 53B:
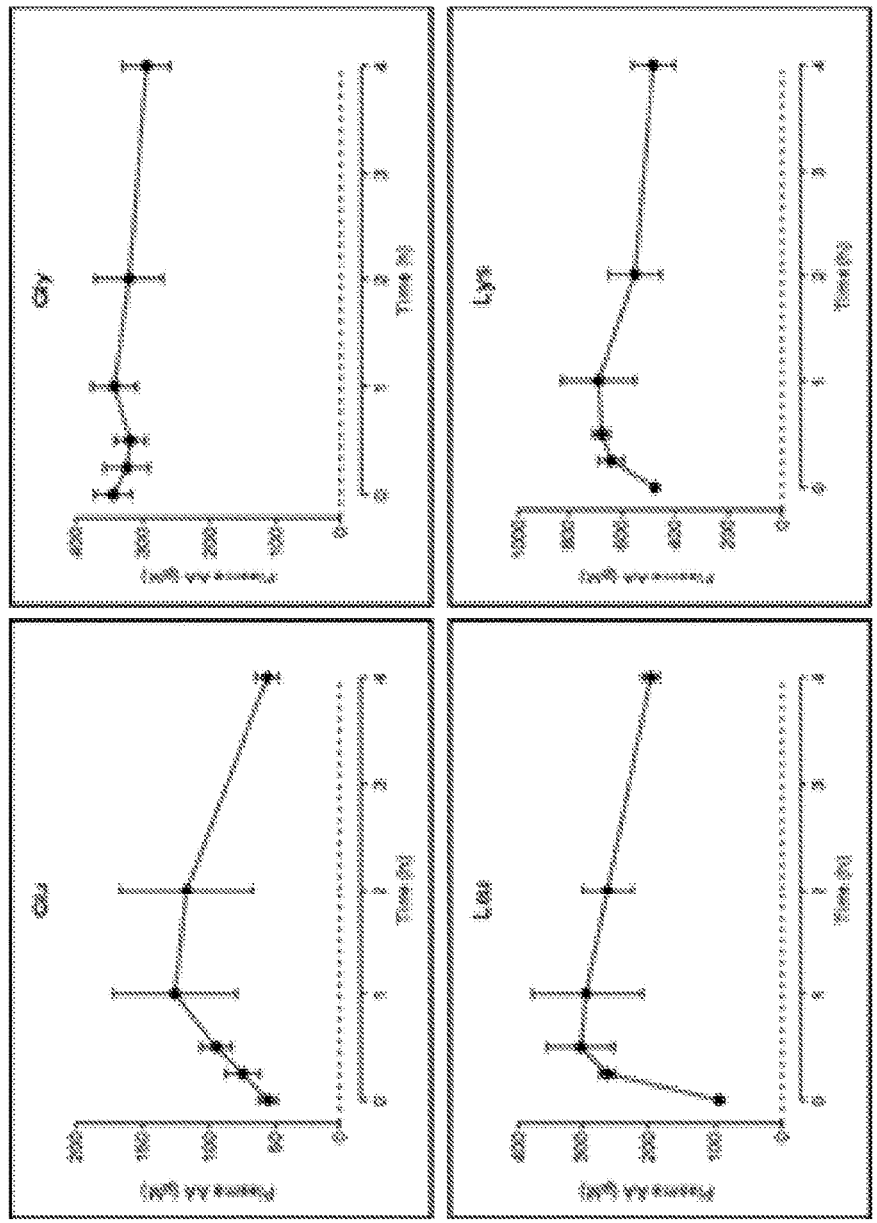
Figure 53C:
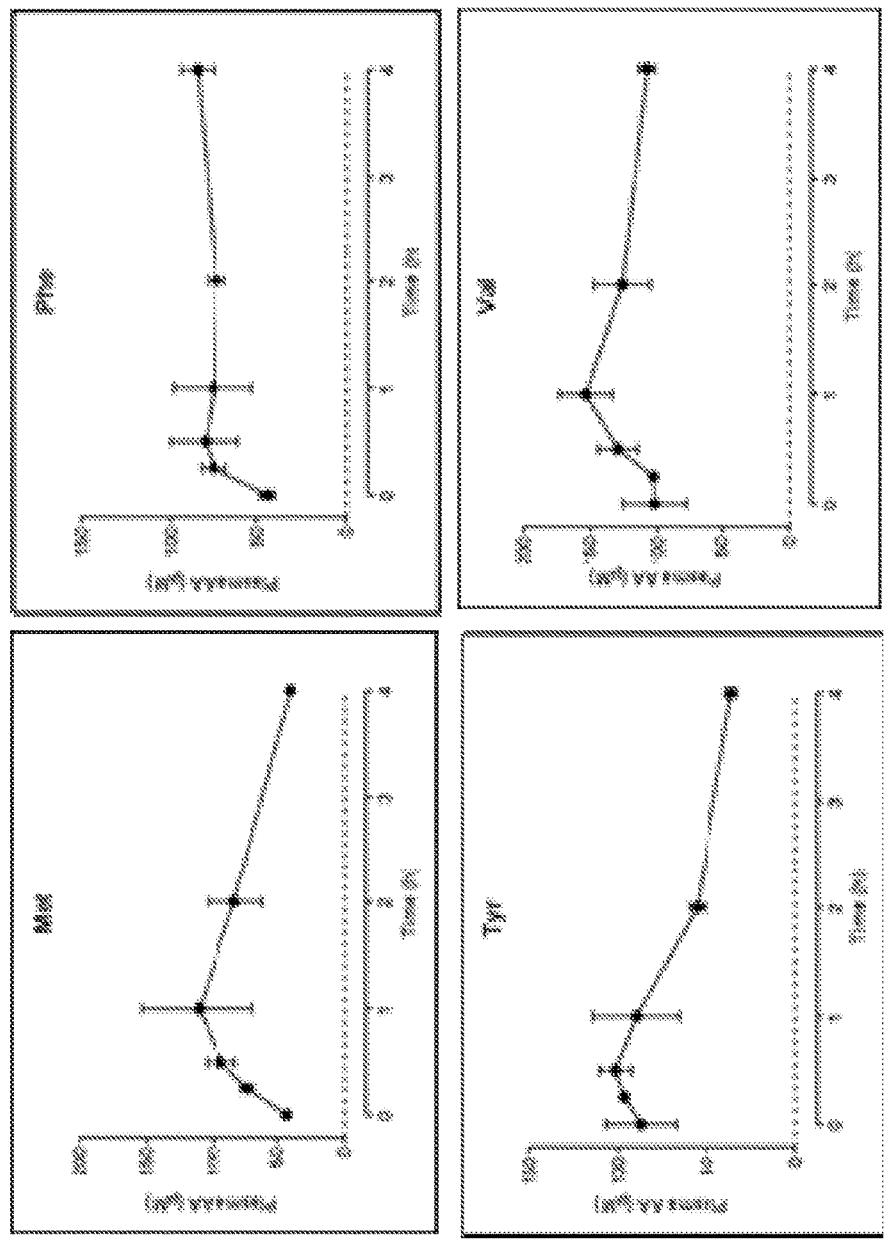
Figure 53D:
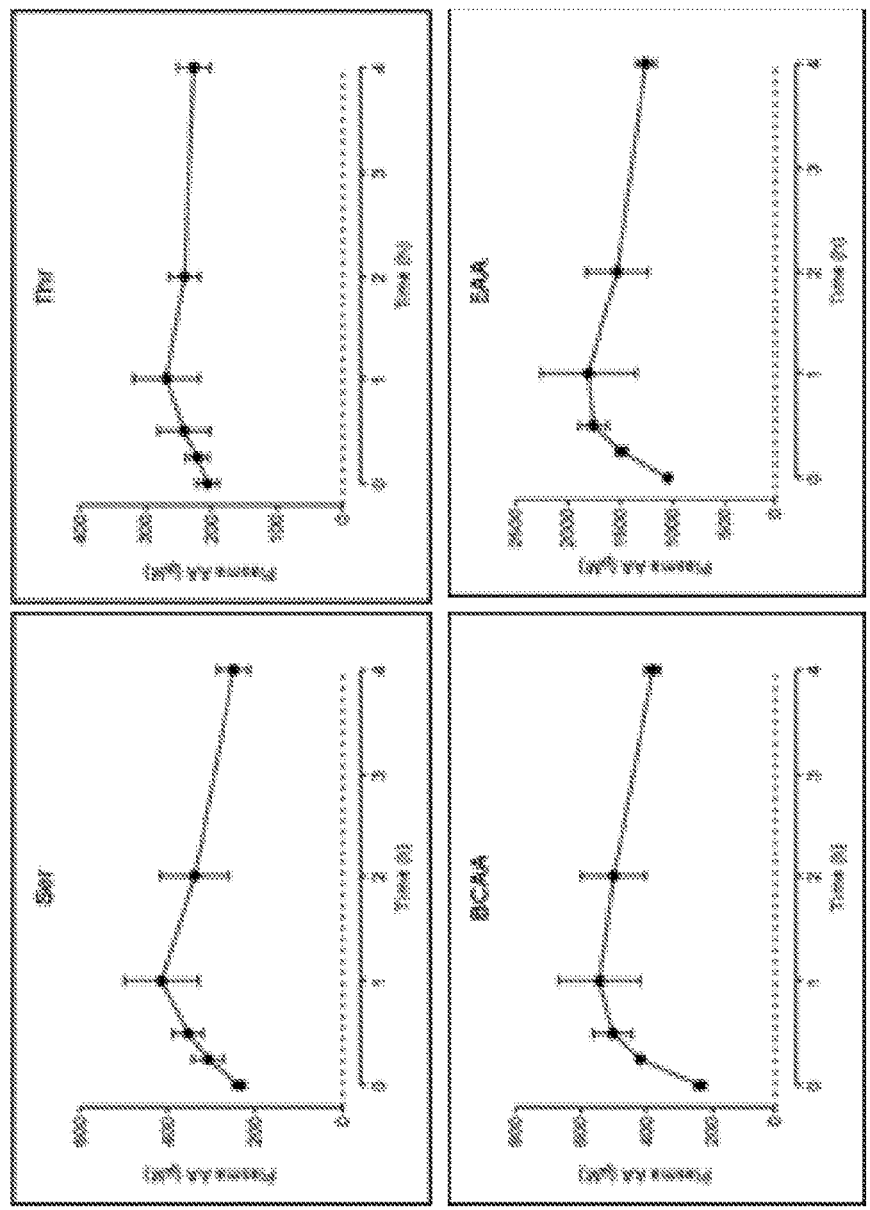

FIG. 51 is an image demonstrating Western blot analysis for Xylose and Fucose. A) Coomassie-stained gel. B) anti-Neu5Gc probed membrane. In western blot analysis of samples of protein extracted from plants and fungi or recombinantly expressed by *E. coli* and *A. niger*. xylose- and fucose-containing glycans in A) Coomassie-stained gel. B) anti-Neu5Gc-blotted membrane. In both panels, lanes are as follows: 1&11) Pre-stained protein ladder (New England Biolab), 2) yeast extract (30 µg), 3) flaxseed extract (30 µg), 4) chicken extract (30 µg), 5) corn extract (30 µg), 6) potato extract (30 µg), 7) mushroom extract (30 µg), 8) Protein Mixture 2 (30 µg), 9) HRP (2 µg), 10) fetuin (2 µg), 12) soy extract (30 µg), 13) rice extract (30 µg), 14) broccoli extract (30 µg), 15) tomato extract (30 µg), 16) blueberry extract (30 µg), 17) grape extract (30 µg), 18) Protein Mixture 2 (30 µg), 19) HRP (2 µg), 20) fetuin (2 µg).

FIG. 52 is a series of charts demonstrating change in average area under the curve (AUC) (±SD) of plasma amino acid concentrations (µM·h) measured in blood samples collected from rats (n=2-4) over 4 h following oral administration of the indicated nutritive polypeptides at the doses listed in Table E33A. BCAA: branched chain amino acids, EAA: essential amino acids.

FIG. 53 is a series of charts demonstrating average plasma amino acid concentration (±SD)-time curve for rats (n=4) orally administered of SEQID-00105 at 2.85 g/kg. BCAA: branched chain amino acids, EAA: essential amino acids.

Figure 54:
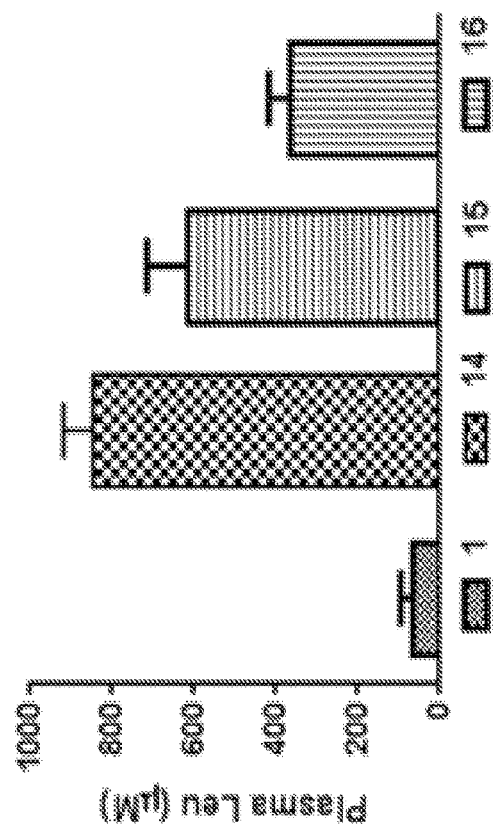
Figure 54:
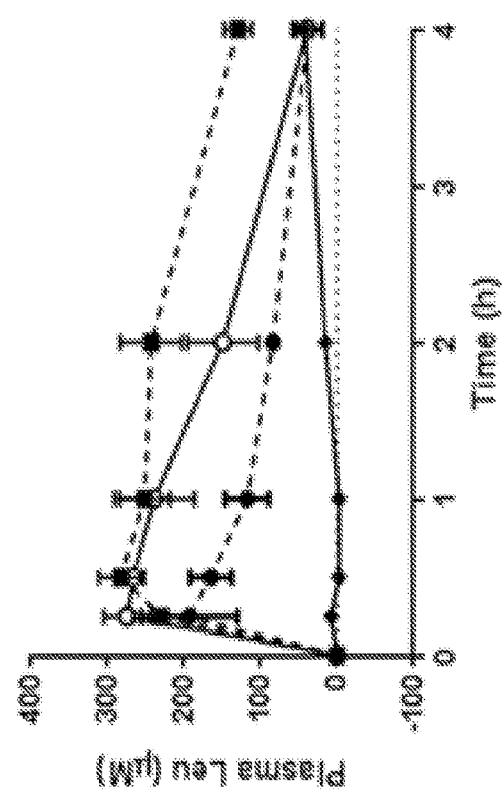

FIG. 54 is a series of charts demonstrating dose-response effect of SEQID-00105. (Left) Average plasma Leu concentration (±SD)-time curve (Right) Average area under the curve (AUC) (±SD) of plasma amino acid concentrations (µM·h) measured in blood samples collected from rats (n=4) over 4 h following oral administration of SEQID-00105 at the doses listed in Table E33A.

Figure 55:
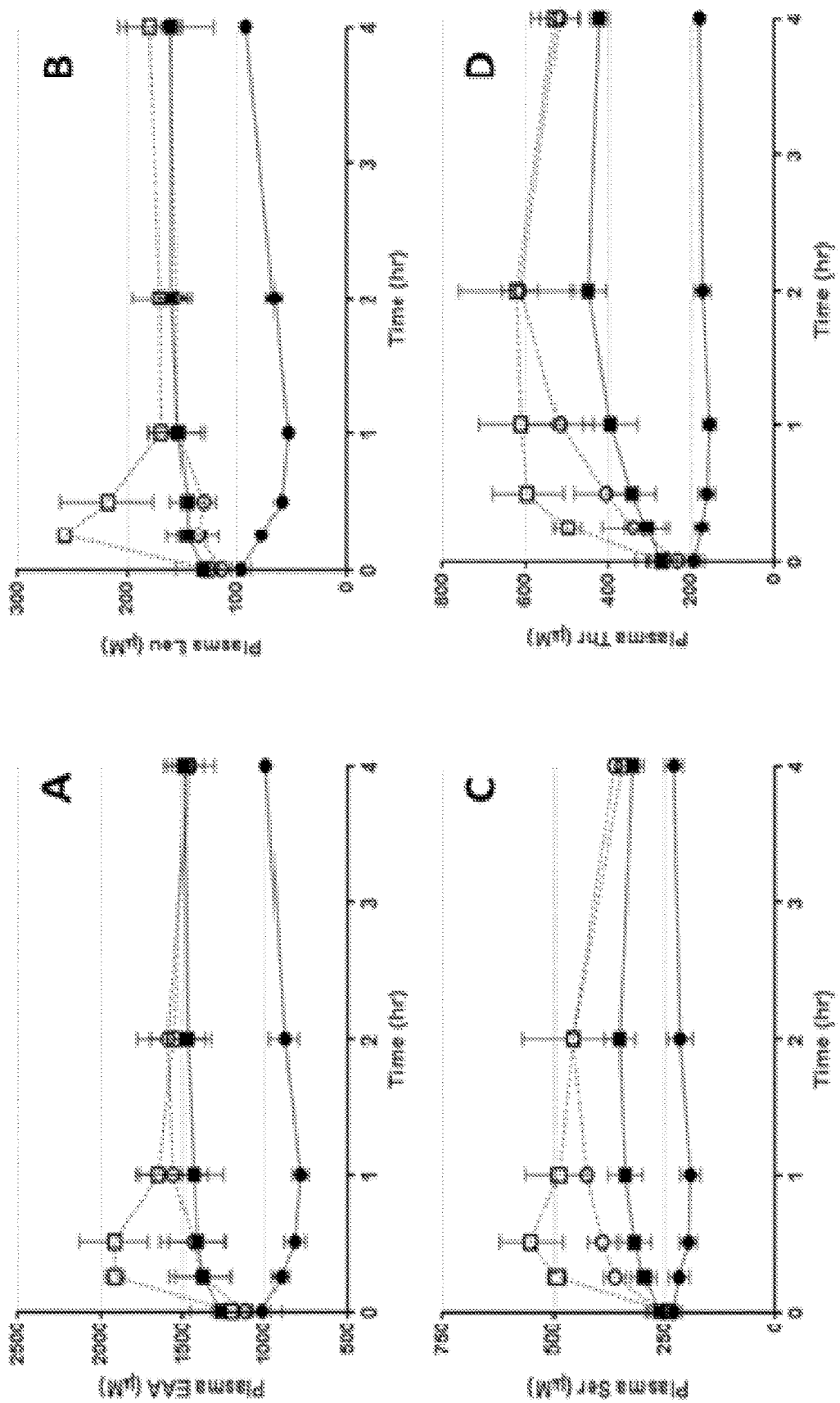

FIG. 55 is a series of charts demonstrating plasma amino acid concentrations during rat pharmacokinetic studies of native and modified forms of SEQID-00363. Plasma amino acid profile of essential amino acids (EAAs) (A), Leucine (B), Serine (C), and Threonine (D) following oral administration of saline (circle (●), solid line) (n=4), native SEQID-00363 (square (■), solid line) (n=4), deglycosylated SEQID-00363 (open circle (○), dashed line) (n=2), and hydrolyzed SEQID-00363 (open square (□), dashed line) (n=4). Data represent the mean±the standard deviation of the mean for n=2-4 rats, as indicated above.

Figure 56:
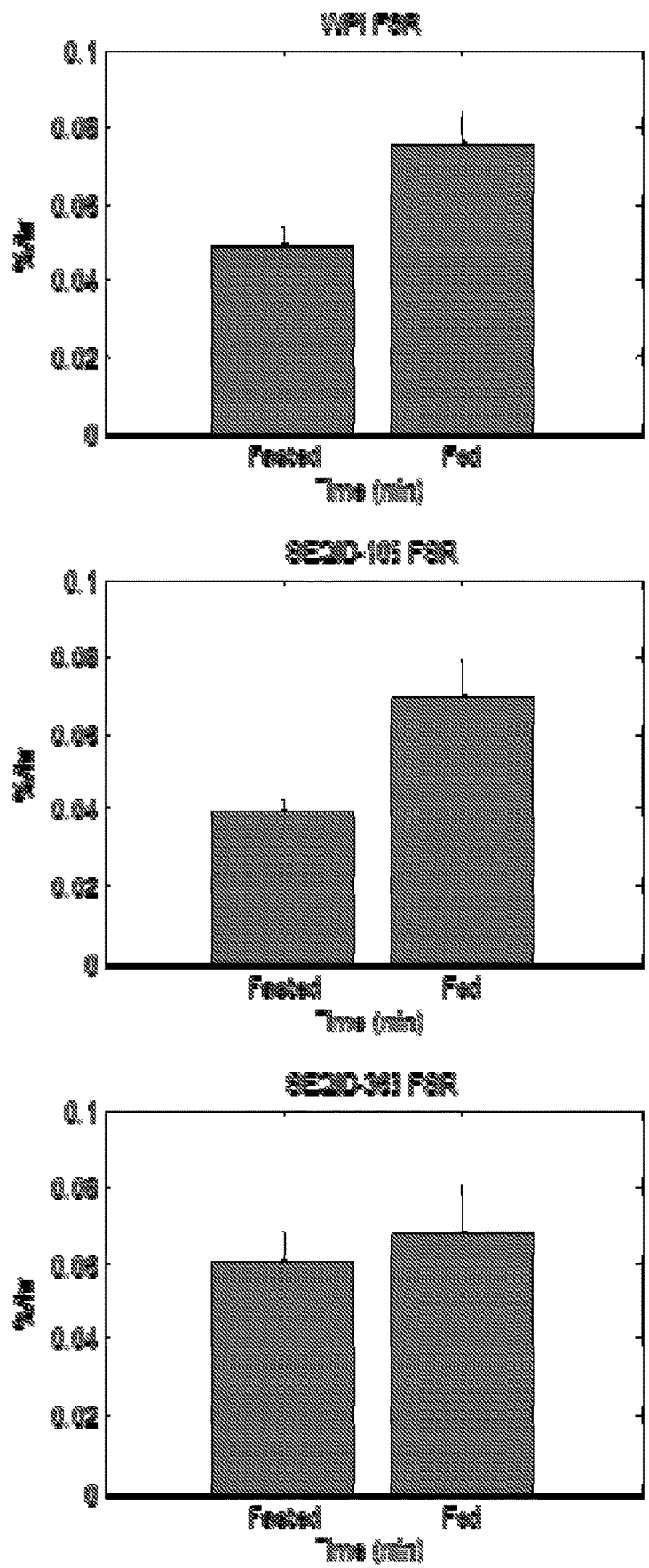
Figure 57A:
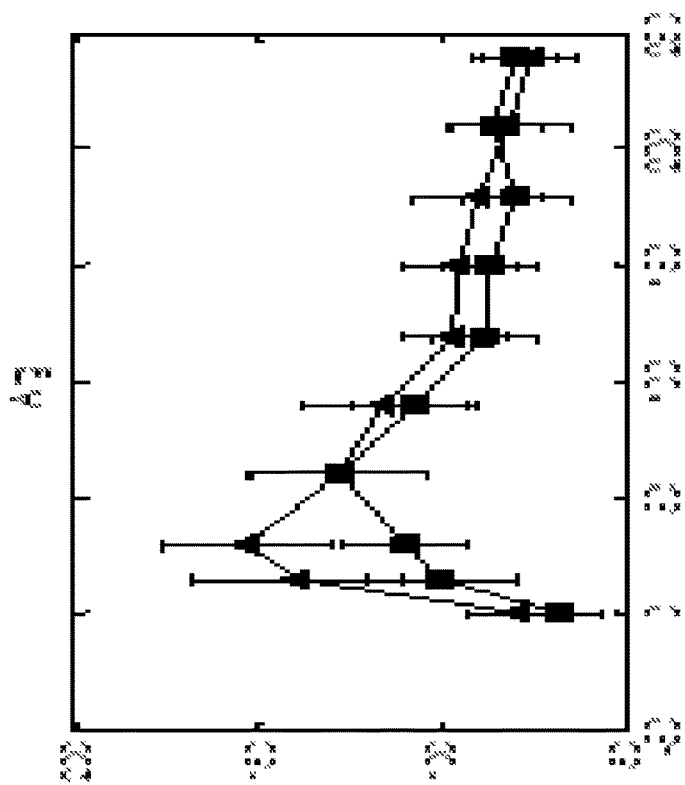
Figure 57A:
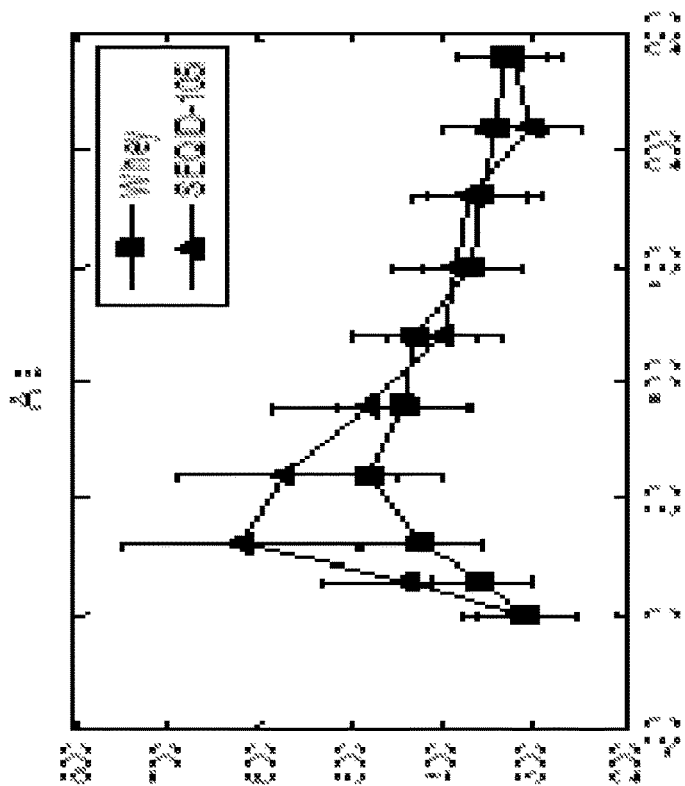
Figure 57B:
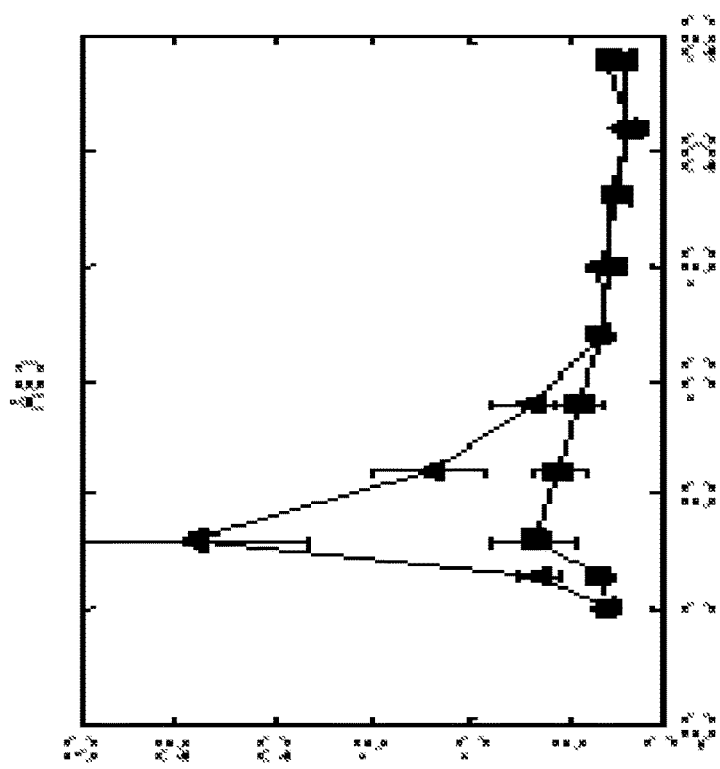
Figure 57B:
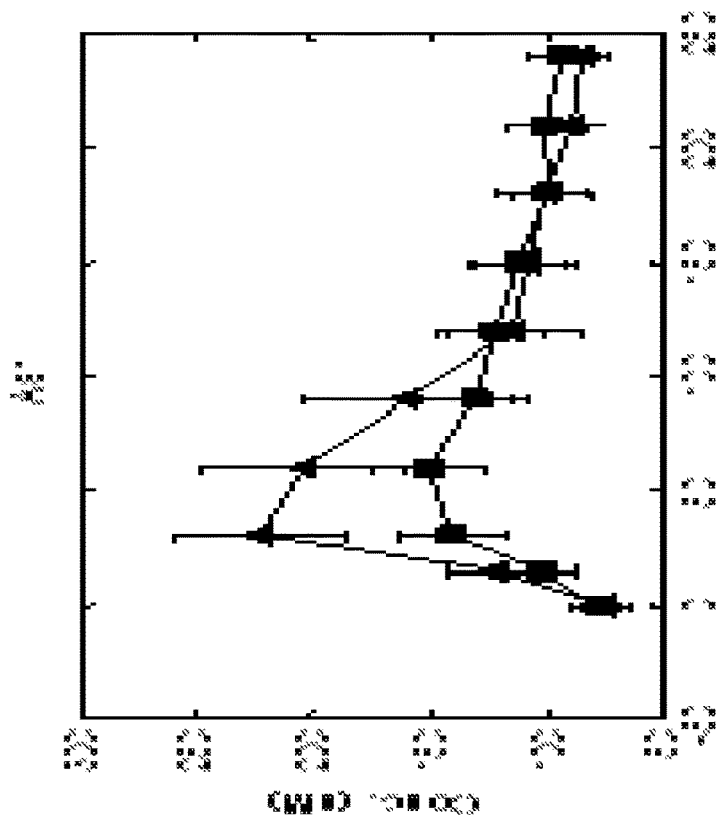
Figure 57C:
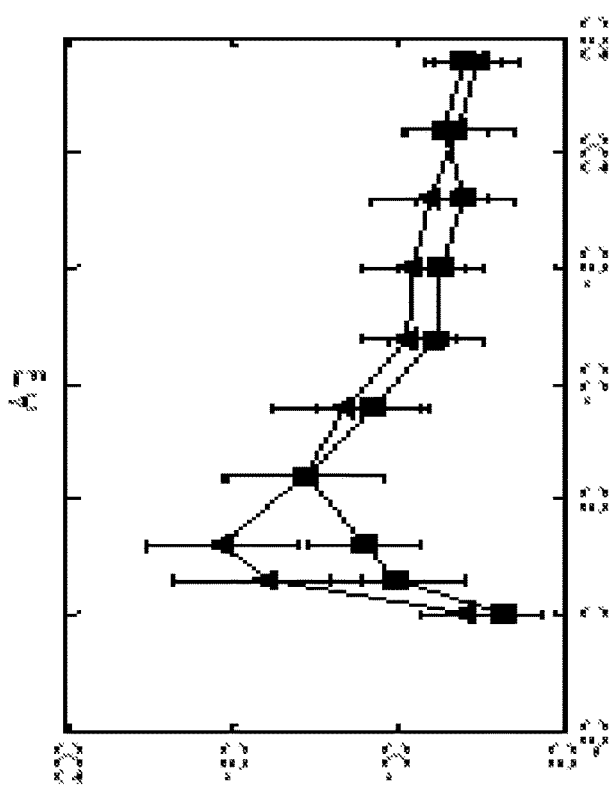
Figure 57C:
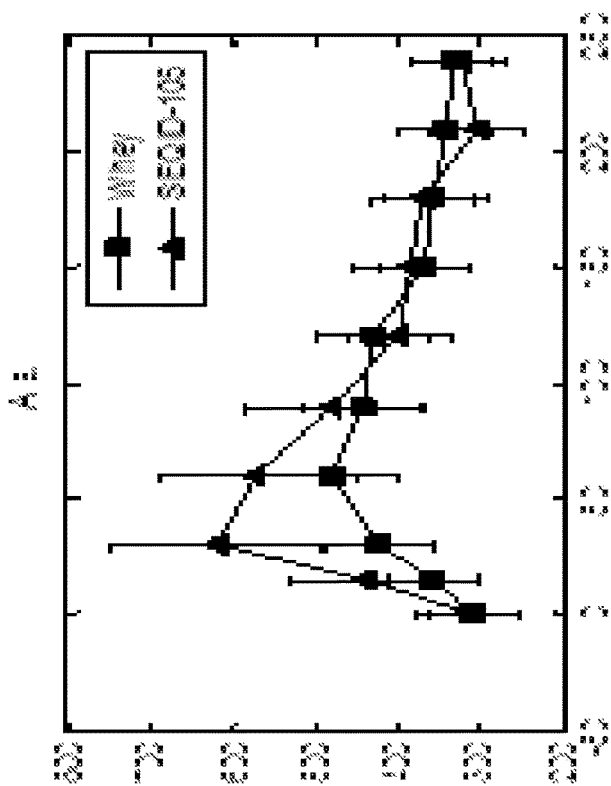
Figure 58A:
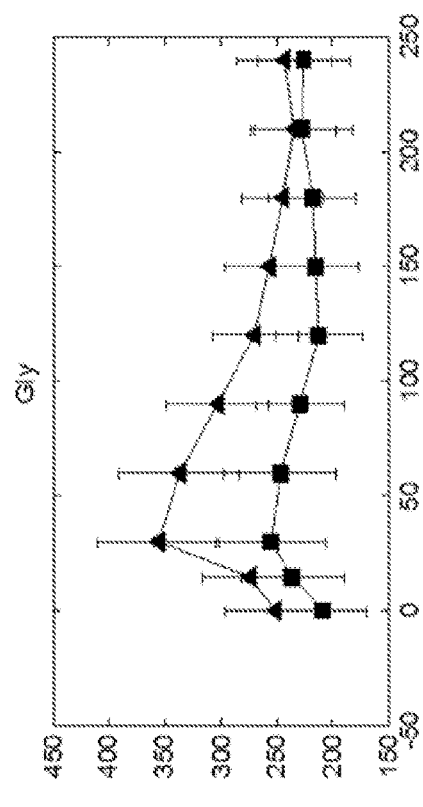
Figure 58A:
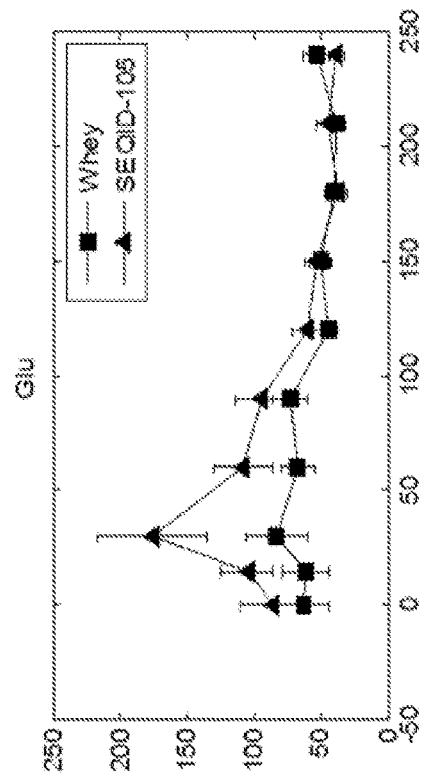
Figure 58B:
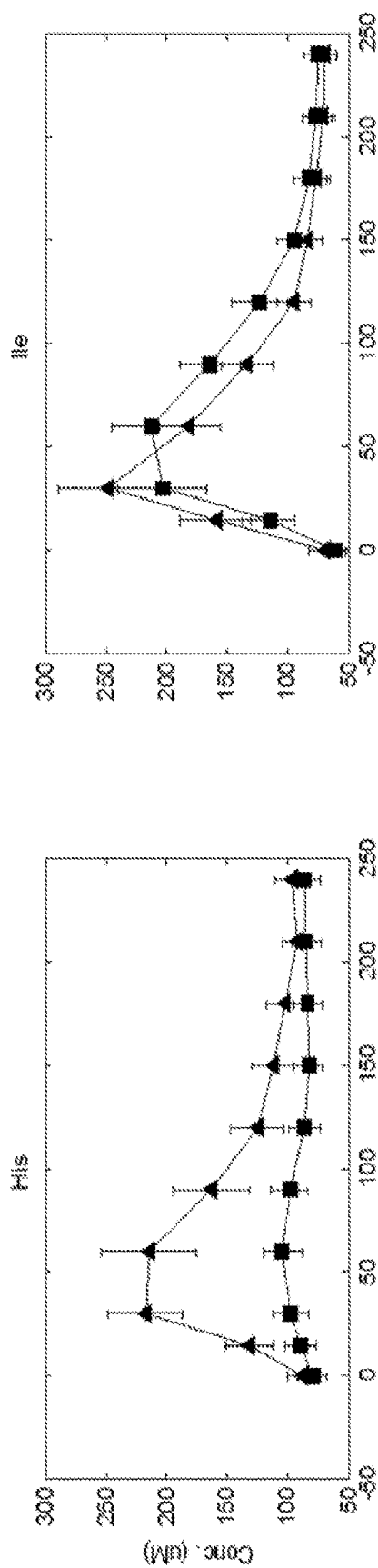
Figure 58C:
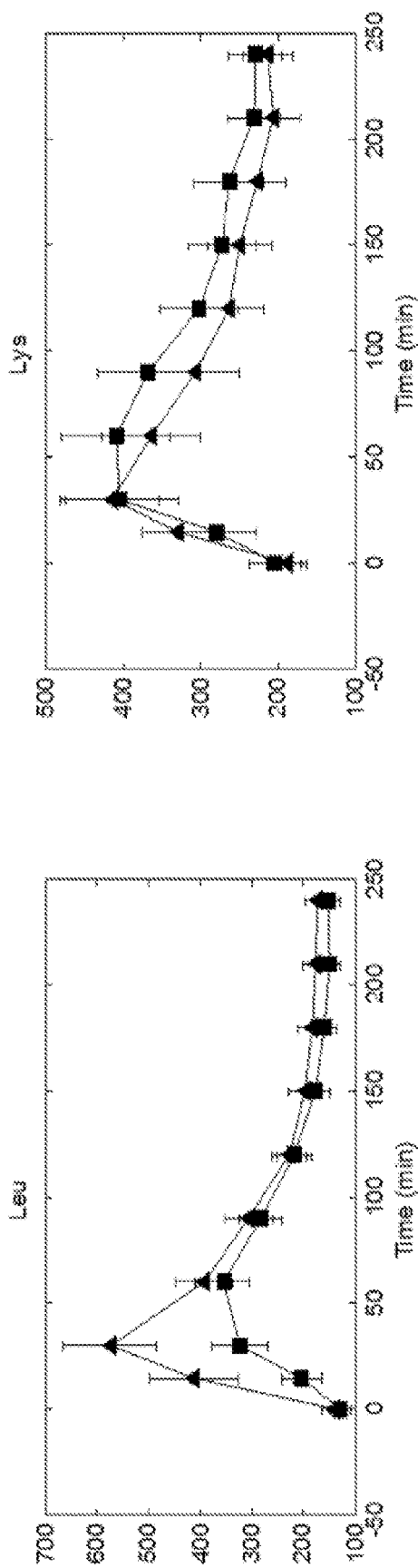
Figure 59A:
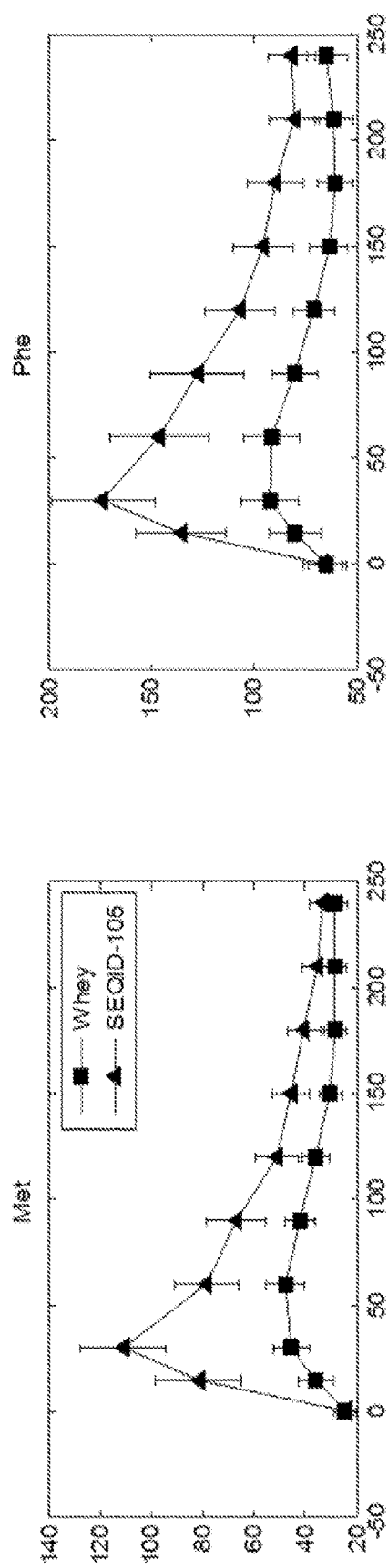
Figure 59B:
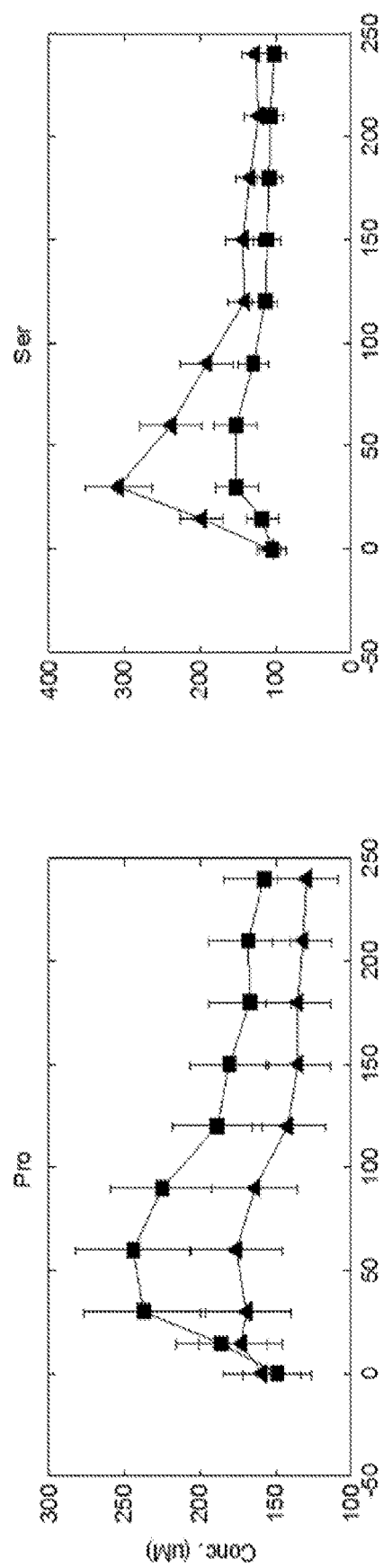
Figure 59C:
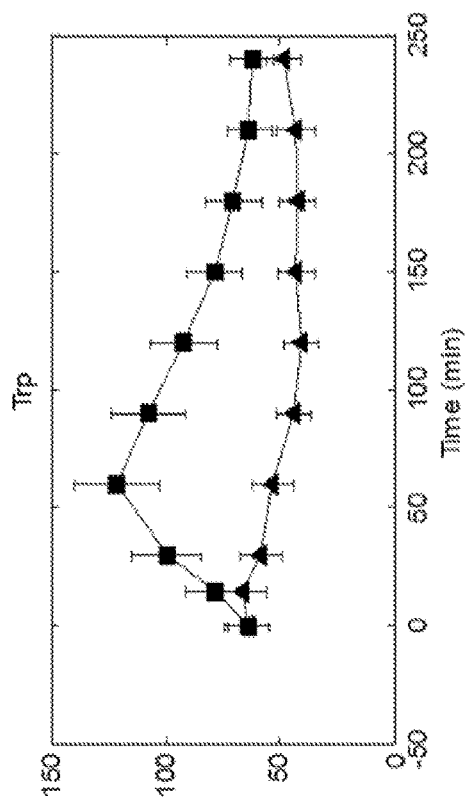
Figure 59C:
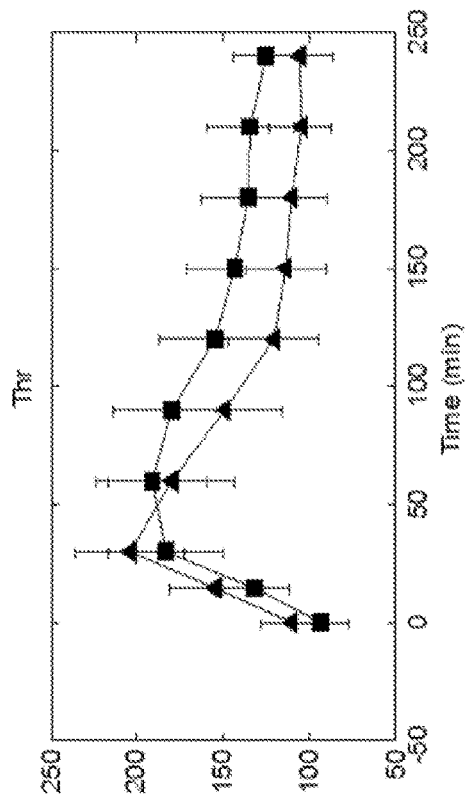

FIG. 56 is a series of charts demonstrating change in average FSR for WPI, SEQID-00105, and SEQID-363

FIG. 57 is a series of charts demonstrating human plasma time course of measured amino acid s for WPI and SEQID-00105.

FIG. 58 is a series of charts demonstrating human plasma time course of measured amino acid s for WPI and SEQID-00105.

FIG. 59 is a series of charts demonstrating human plasma time course of measured amino acid s for WPI and SEQID-00105.

Figure 60A:
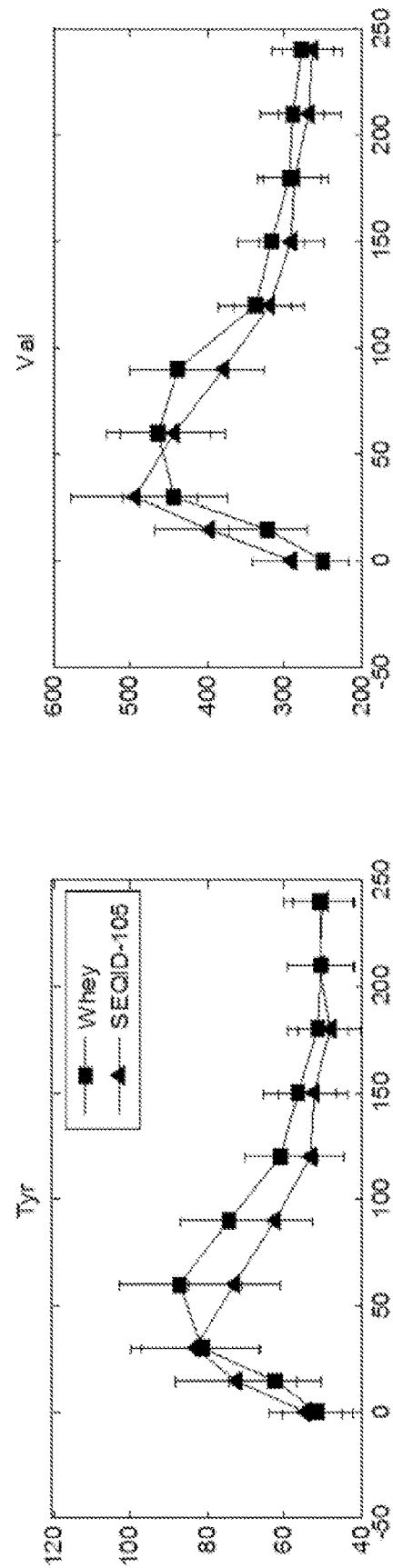
Figure 60B:
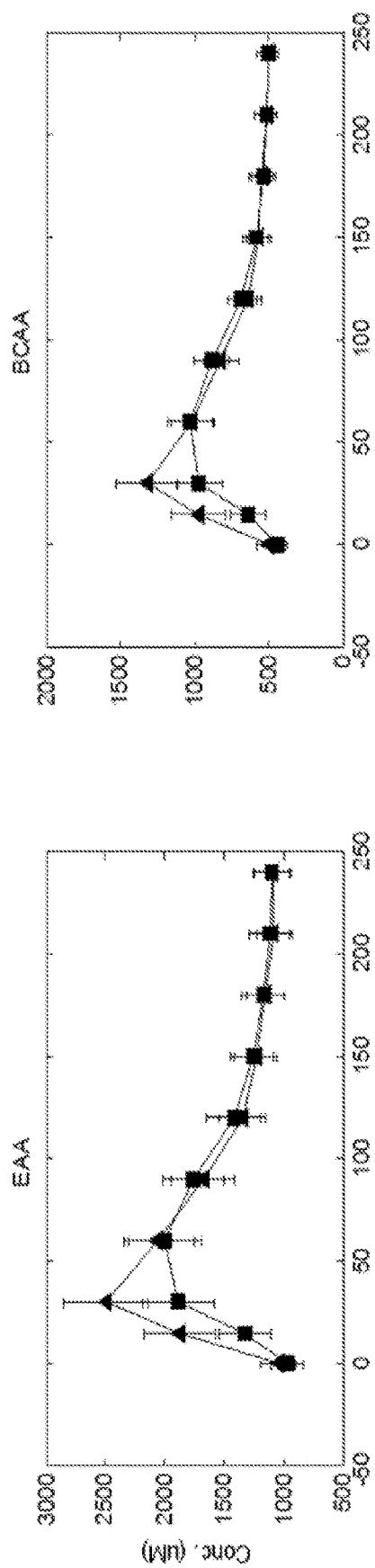
Figure 60C:
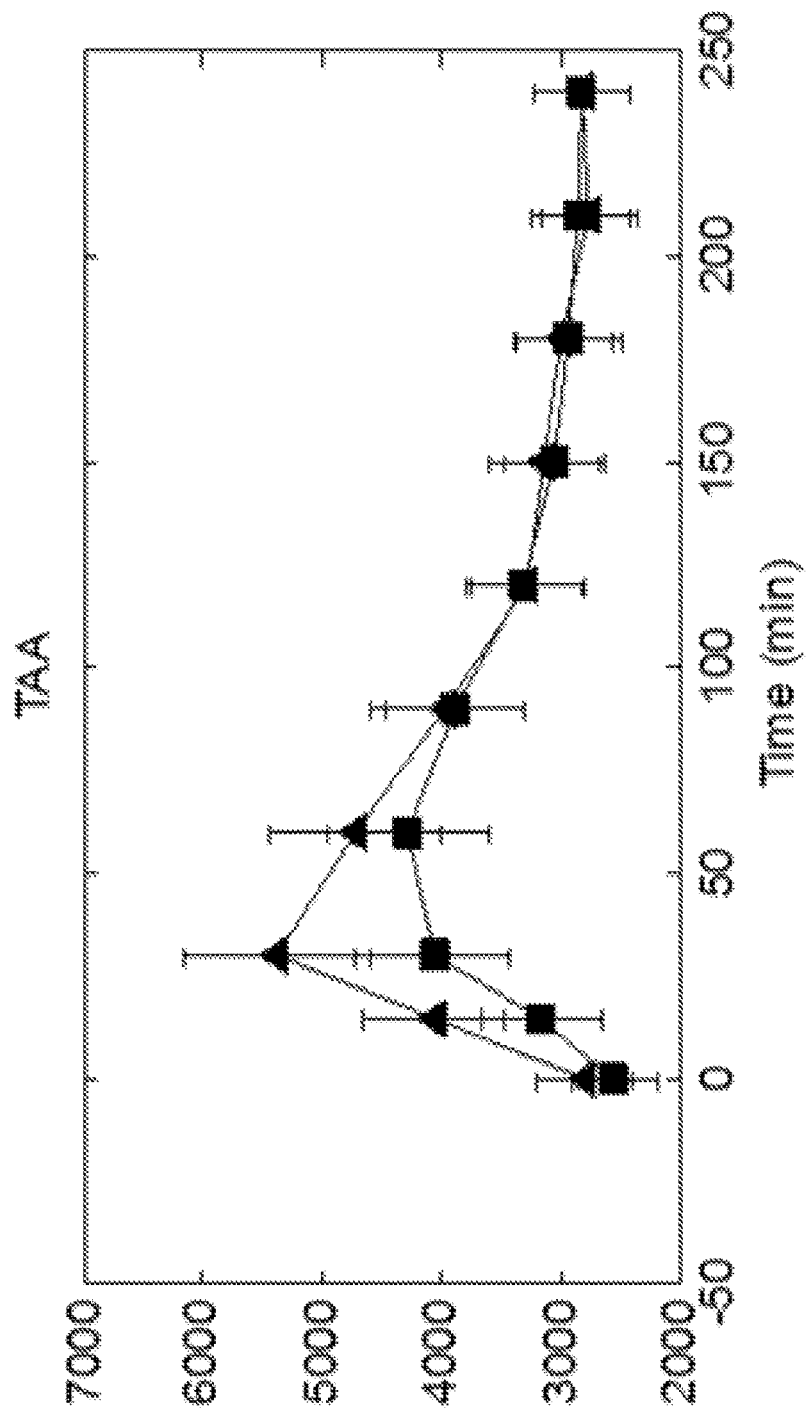

FIG. 60 is a series of charts demonstrating human plasma time course of measured amino acid and the aggregate groups, essential amino acids (EAA), branched chain amino acids (BCAA), and total amino acids (TAA) for WPI and SEQID-00105.

Figure 61:
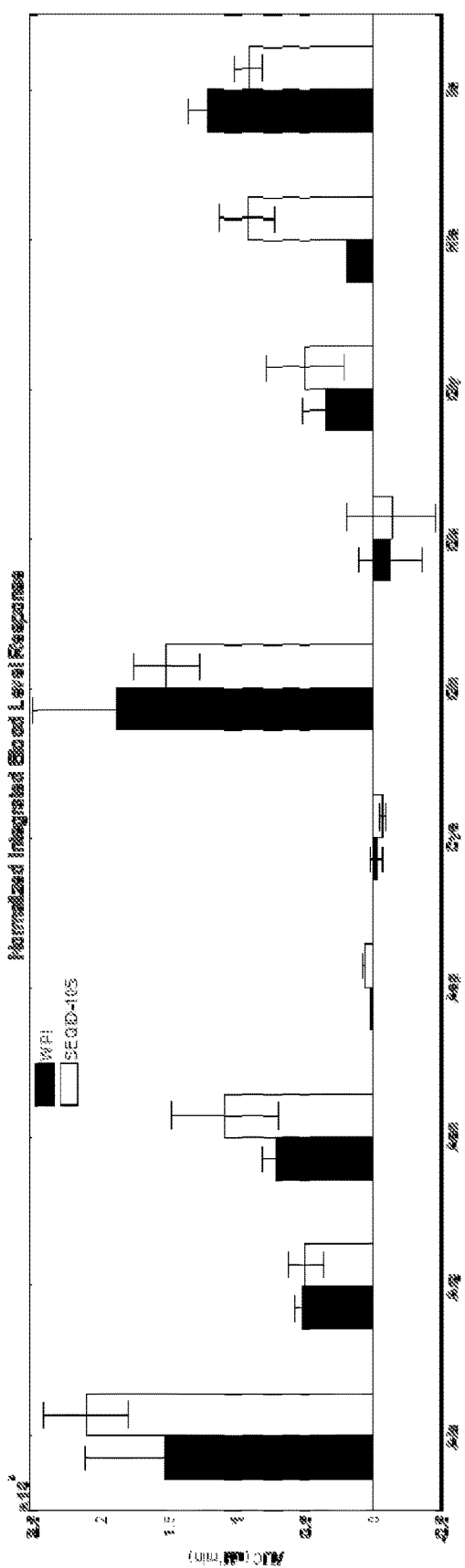

FIG. 61 is a chart demonstrating integrated area under the curve (AUC) of measured amino acids, for WPI and SEQID-00105.

Figure 62:
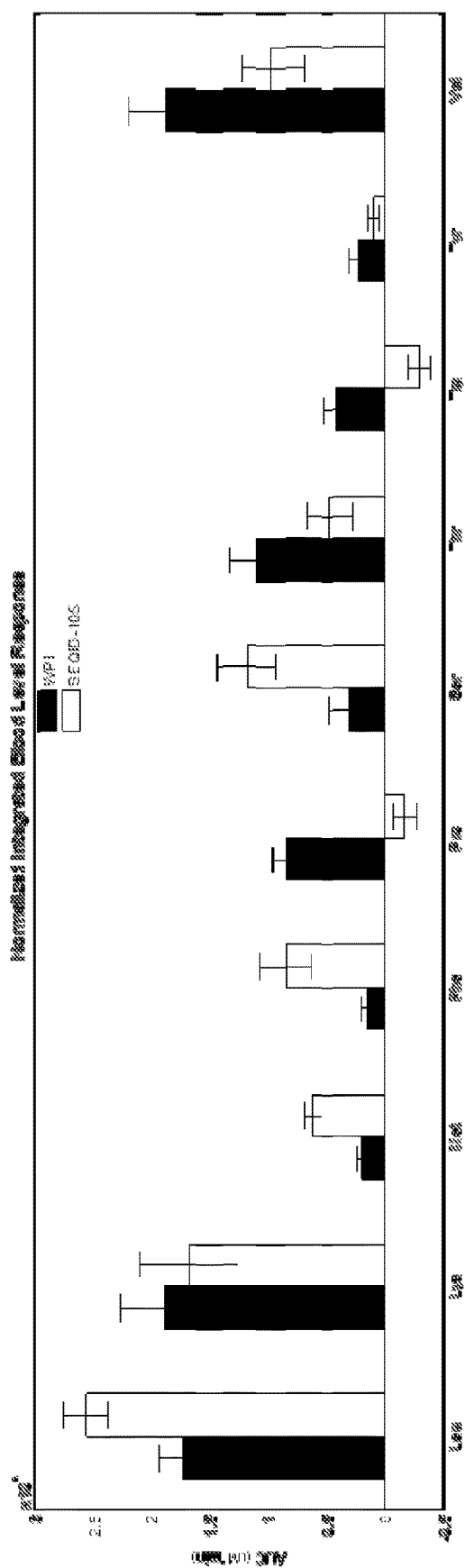

FIG. 62 is a chart demonstrating integrated area under the curve (AUC) of measured amino acids, for WPI and SEQID-00105.

Figure 63:
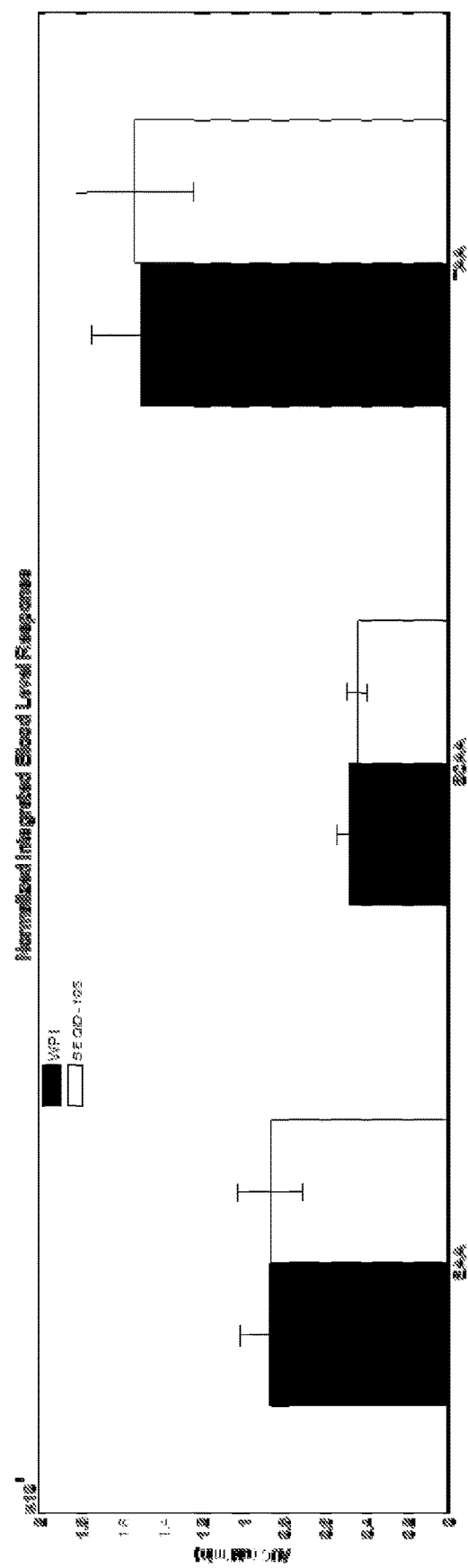
Figure 64A:
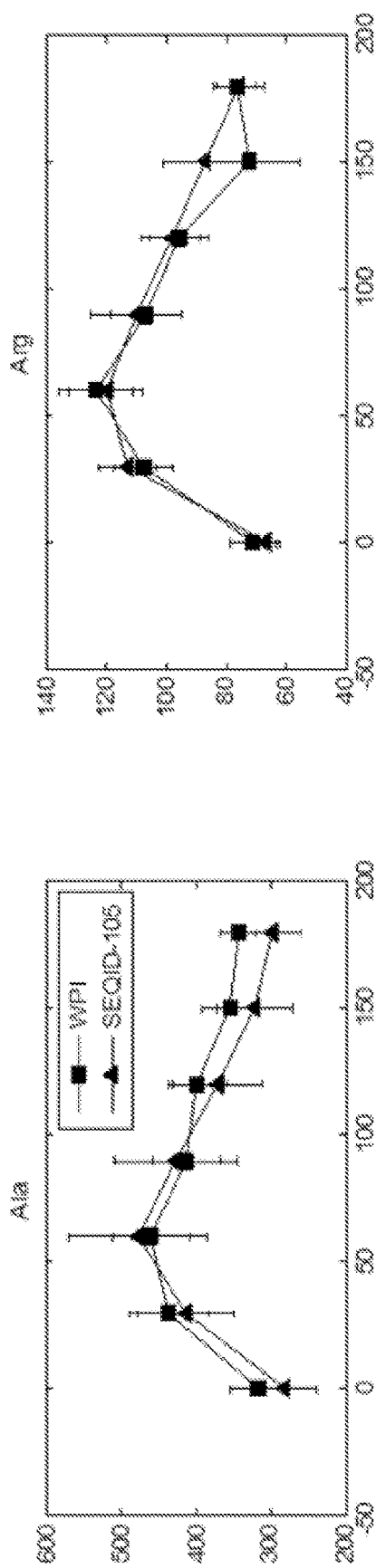
Figure 64B:
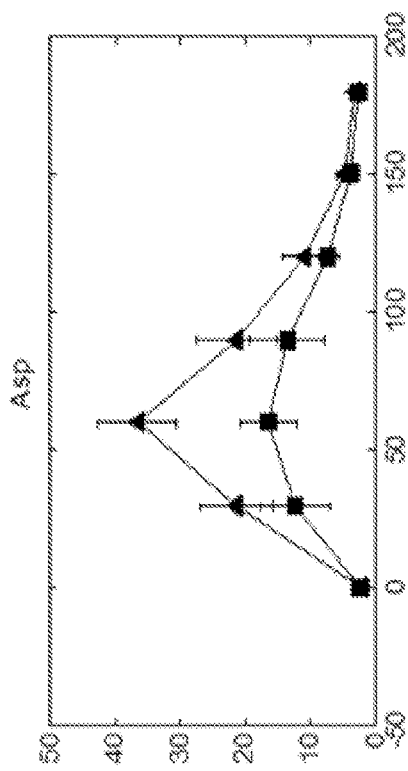
Figure 64B:
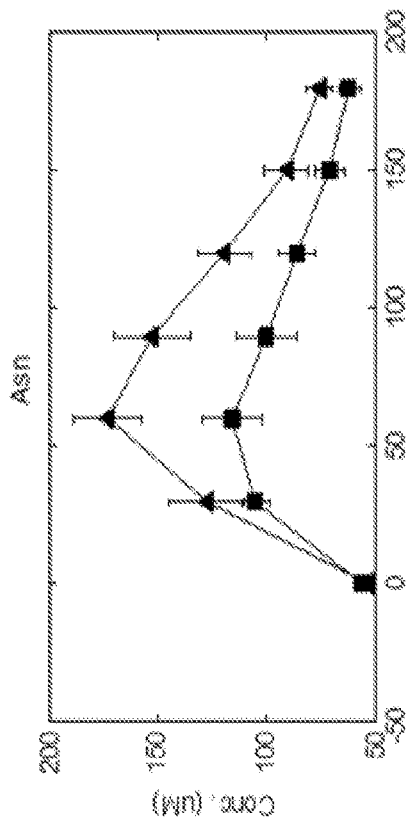
Figure 64C:
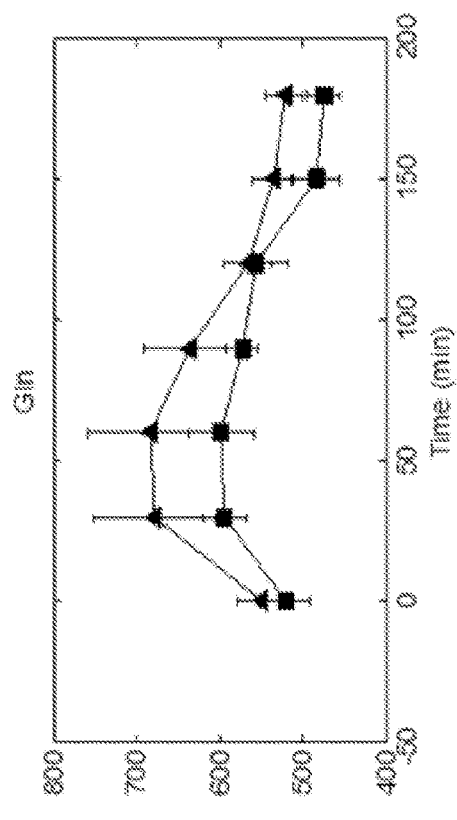
Figure 64C:
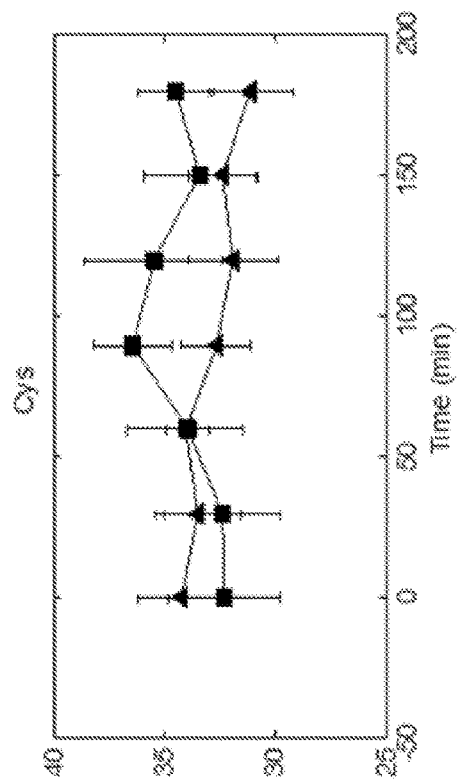
Figure 65A:
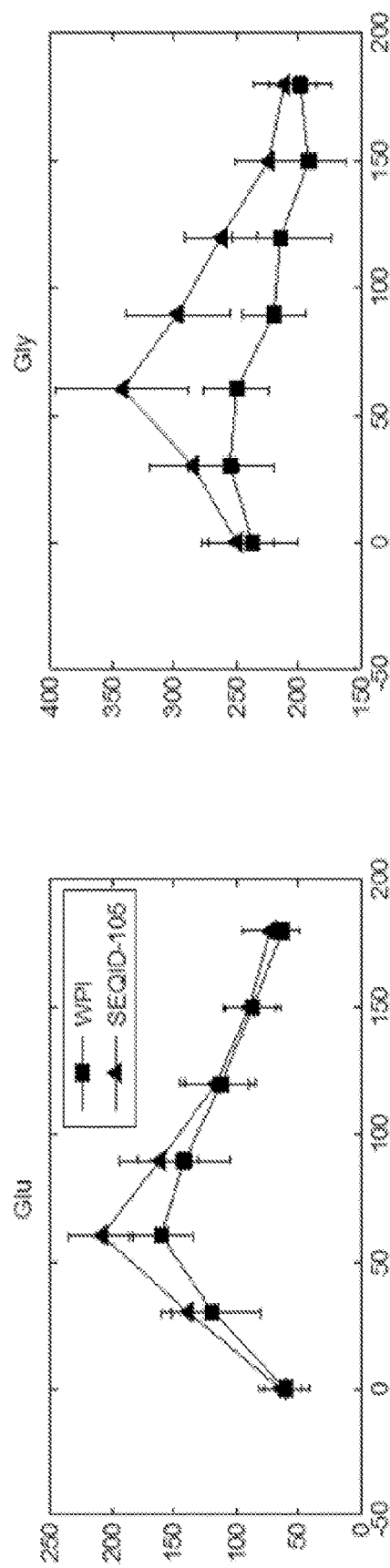
Figure 65B:
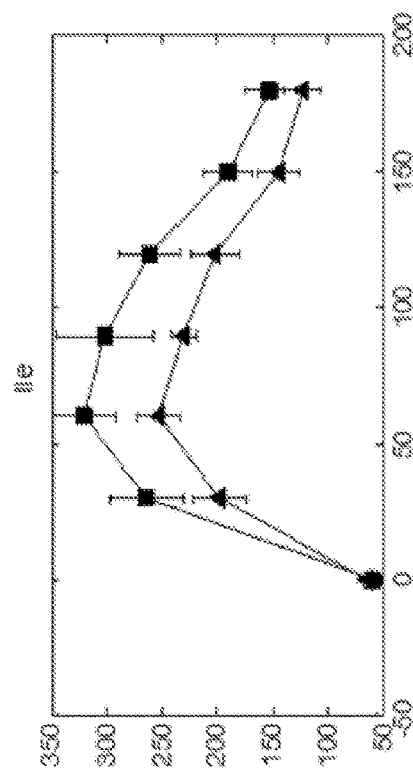
Figure 65B:
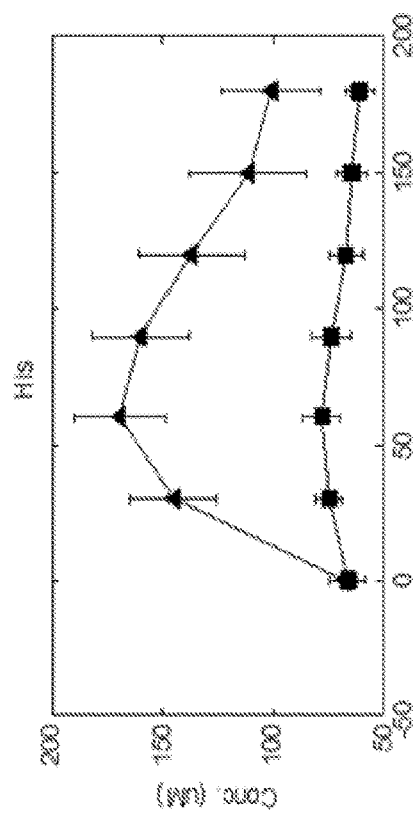
Figure 65C:
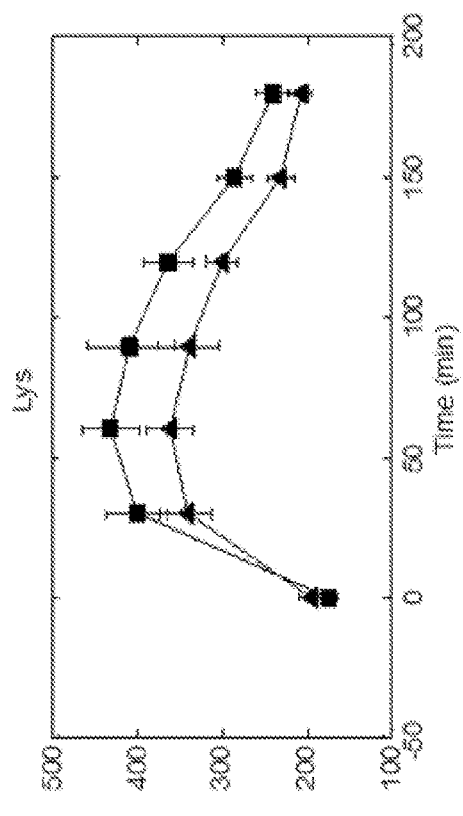
Figure 65C:
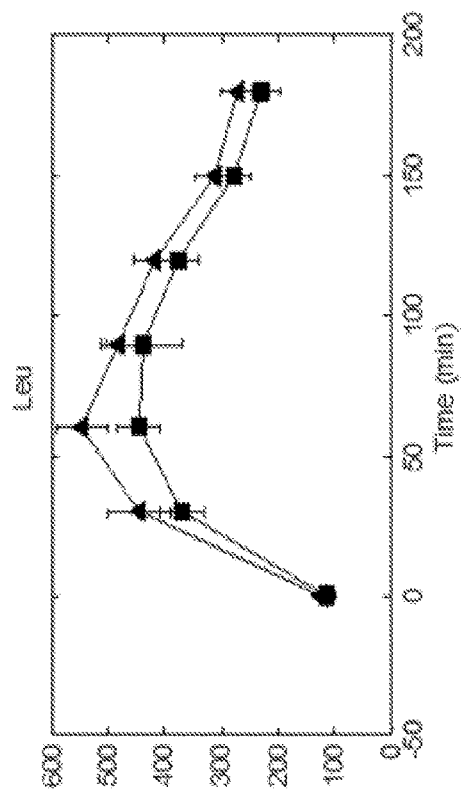
Figure 66A:
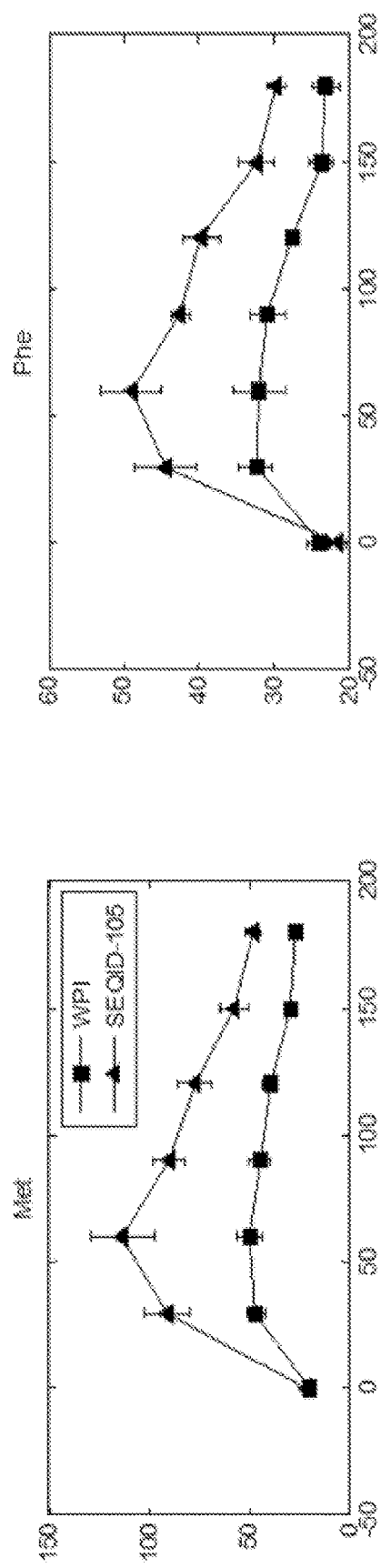
Figure 66B:
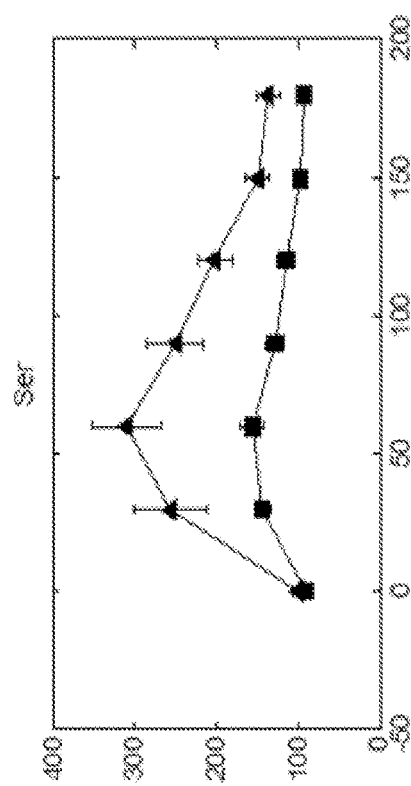
Figure 66B:
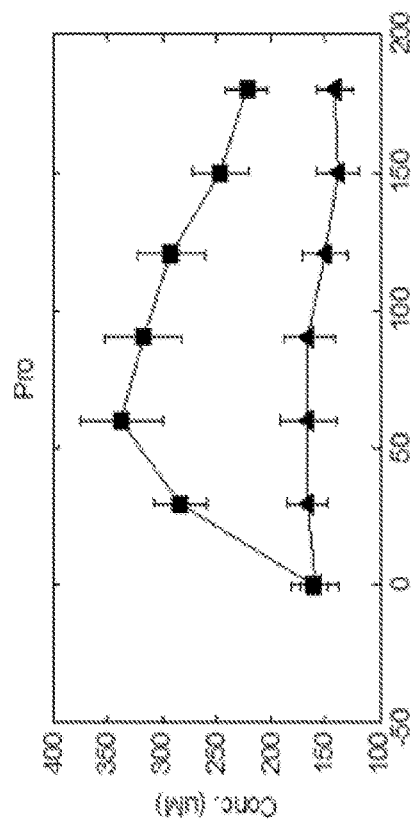
Figure 66C:
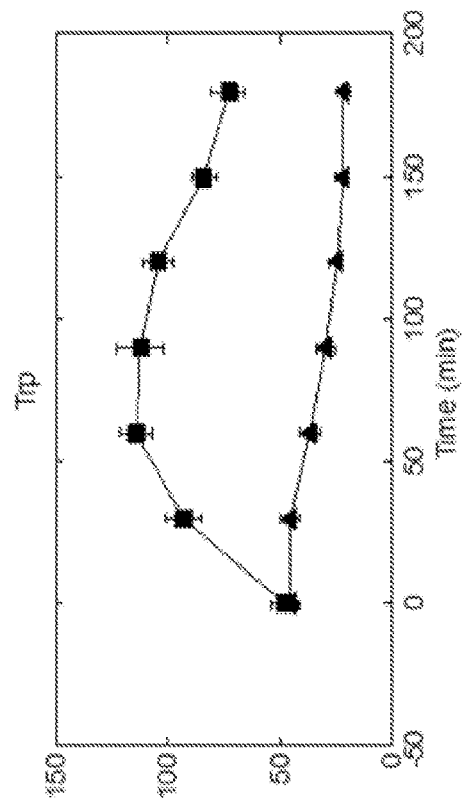
Figure 66C:
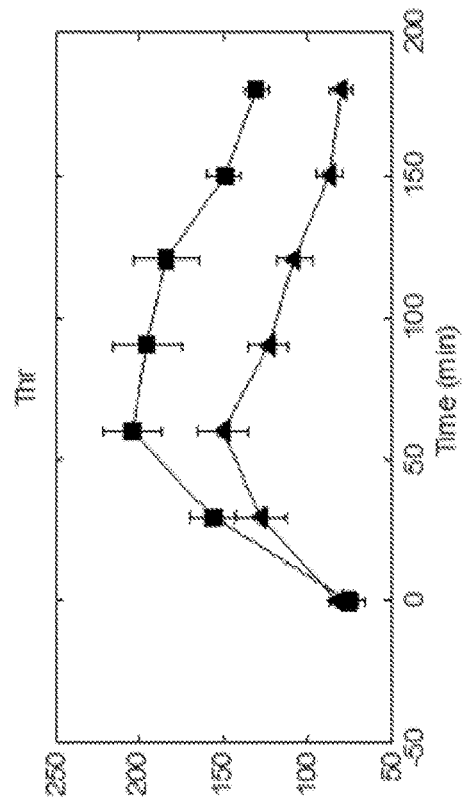
Figure 67A:
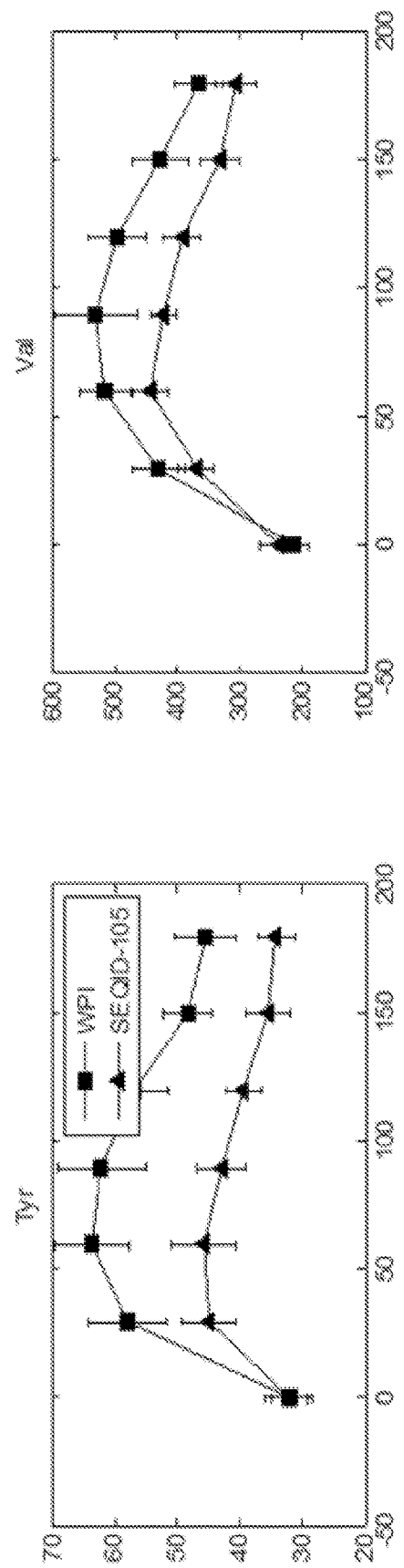
Figure 67B:
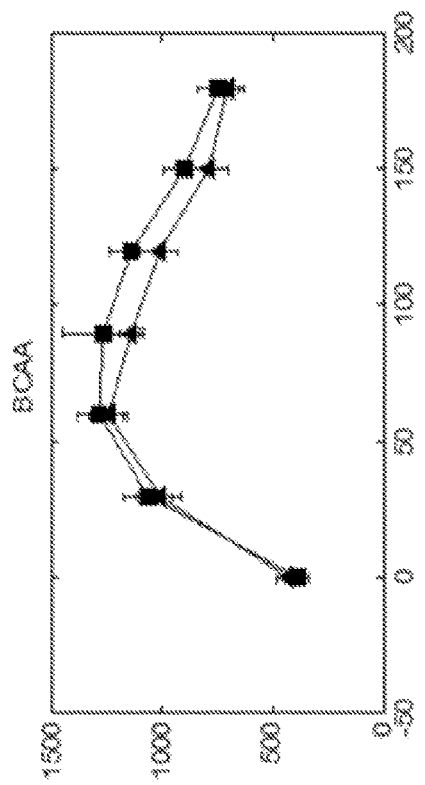
Figure 67B:
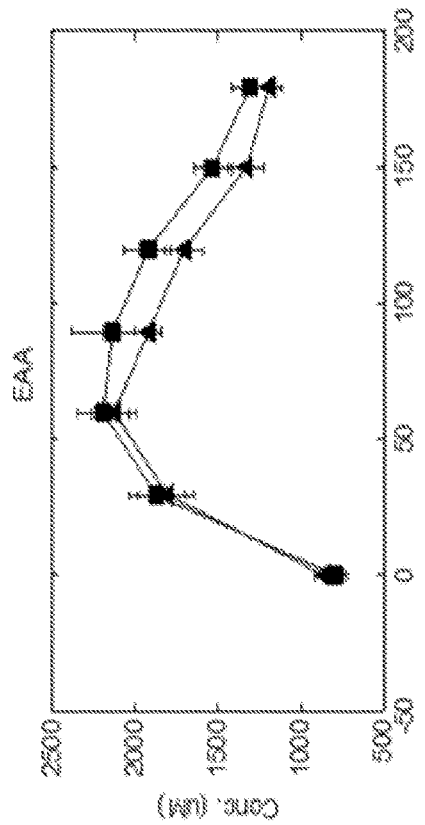
Figure 67C:
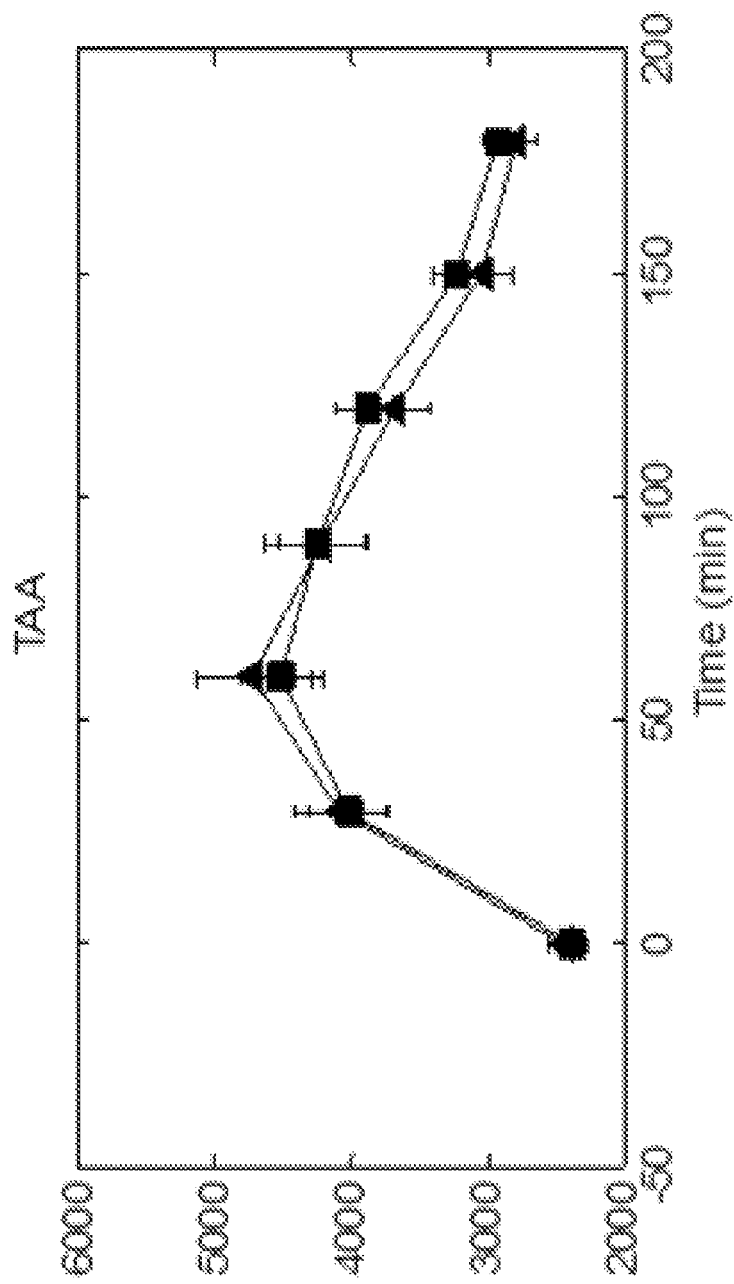

FIG. 63 is a chart demonstrating integrated area under the curve (AUC) of aggregate groups, essential amino acids (EAA), branched chain amino acids (BCAA), and total amino acids (TAA), for WPI and SEQID-00105.

FIG. 64 is a series of charts demonstrating human plasma time course of measured amino acid s for WPI and SEQID-00105.

FIG. 65 is a series of charts demonstrating human plasma time course of measured amino acid s for WPI and SEQID-00105.

FIG. 66 is a series of charts demonstrating human plasma time course of measured amino acid s for WPI and SEQID-00105.

FIG. 67 is a series of charts demonstrating human plasma time course of measured amino acid and the aggregate groups, essential amino acids (EAA), branched chain amino acids (BCAA), and total amino acids (TAA) for WPI and SEQID-00105.

Figure 68:
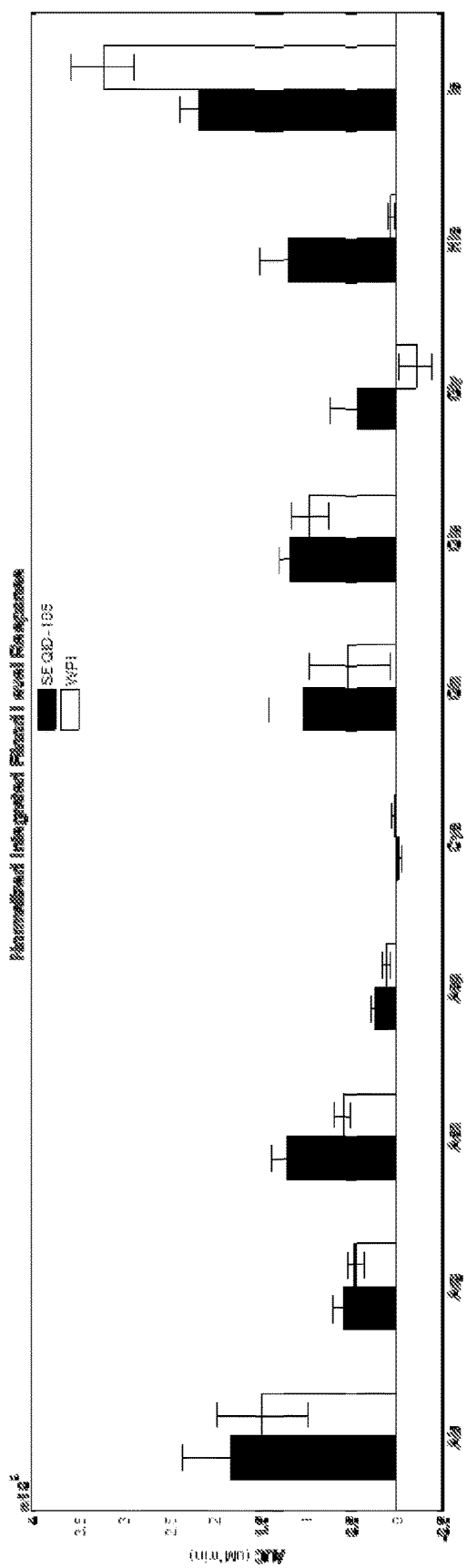

FIG. 68 is a chart demonstrating integrated area under the curve (AUC) of measured amino acids, for WPI and SEQID-00105.

Figure 69:
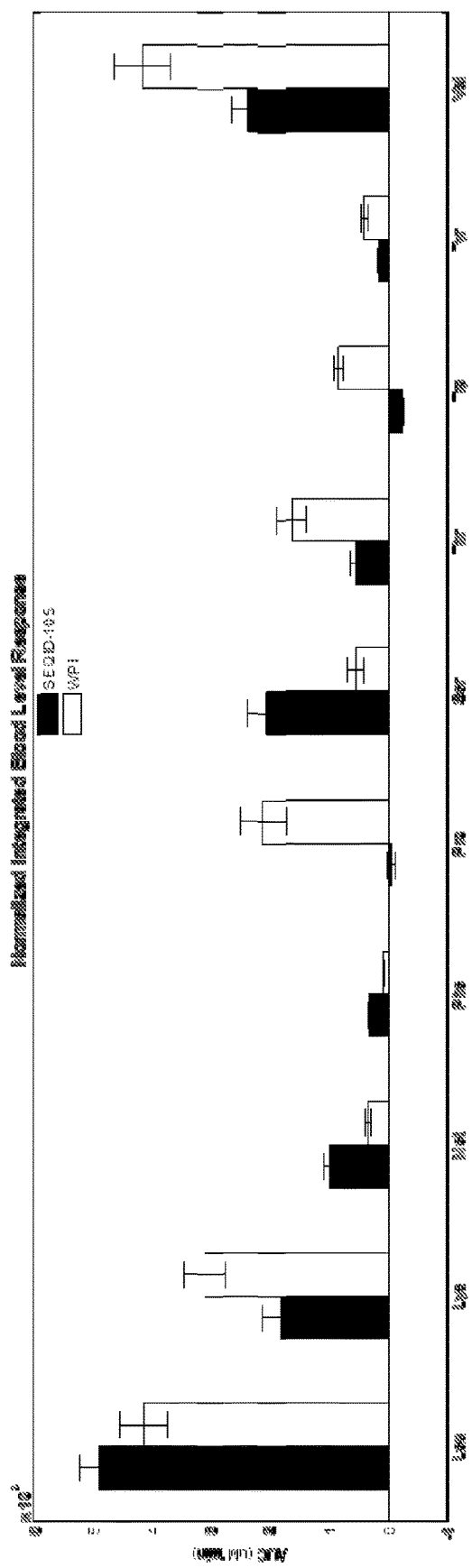

FIG. 69 is a chart demonstrating integrated area under the curve (AUC) of measured amino acids, for WPI and SEQID-00105.

Figure 70:
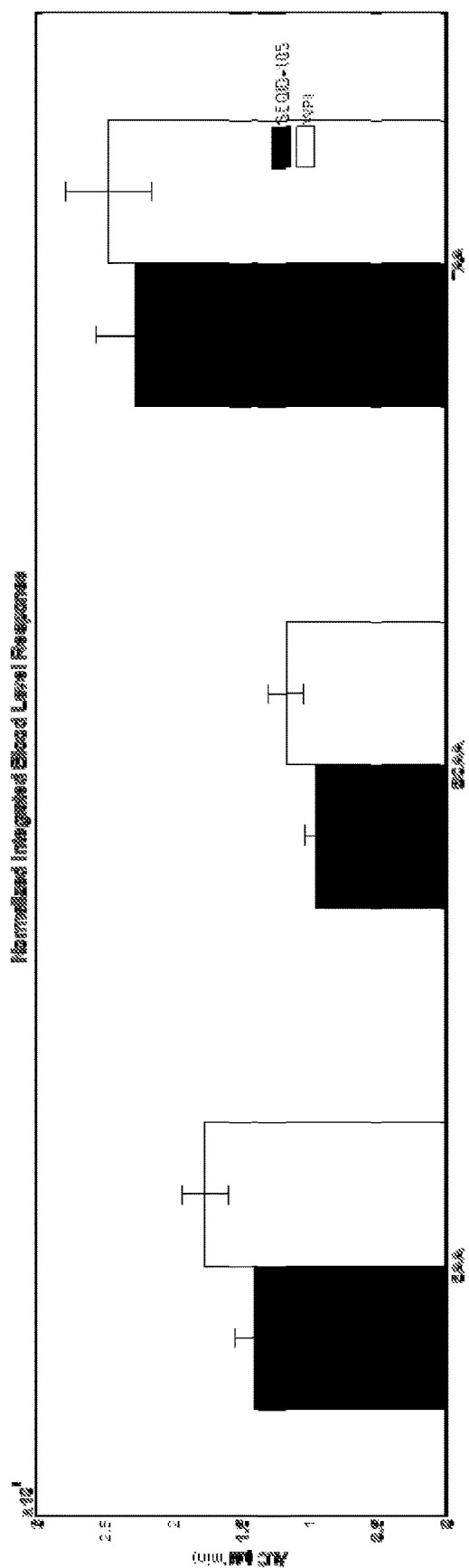
Figure 71A:
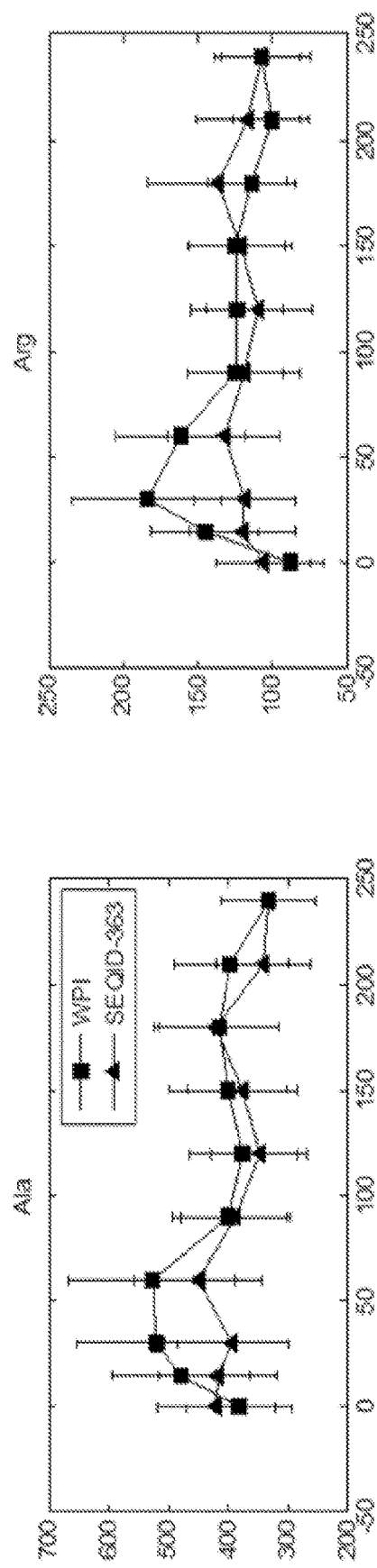
Figure 71B:
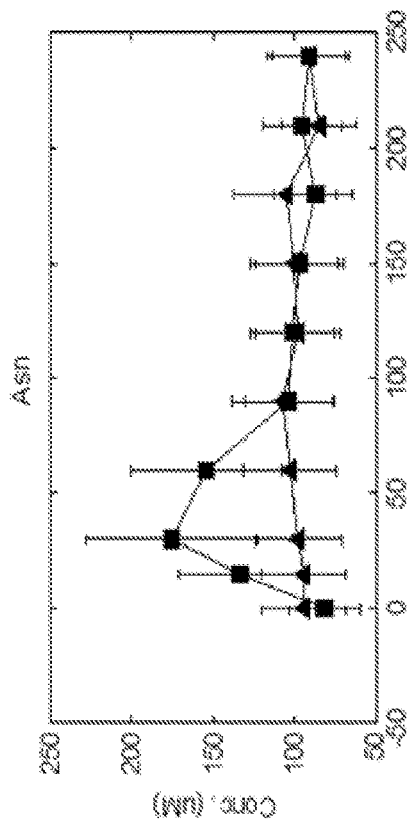
Figure 71B:
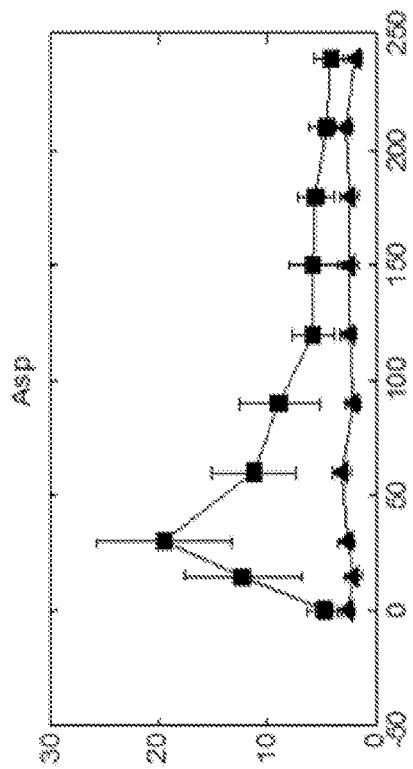
Figure 71C:
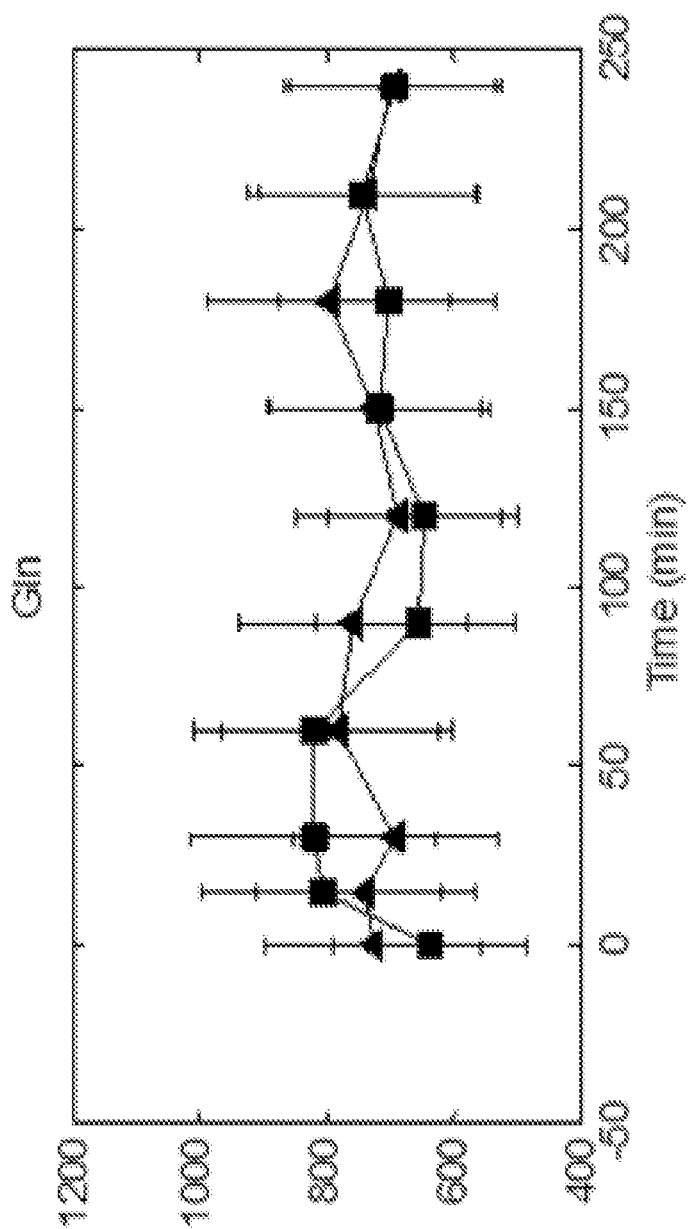
Figure 72A:
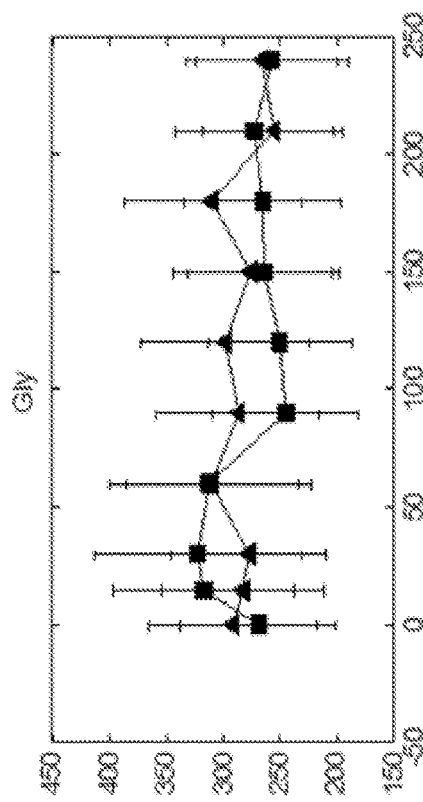
Figure 72A:
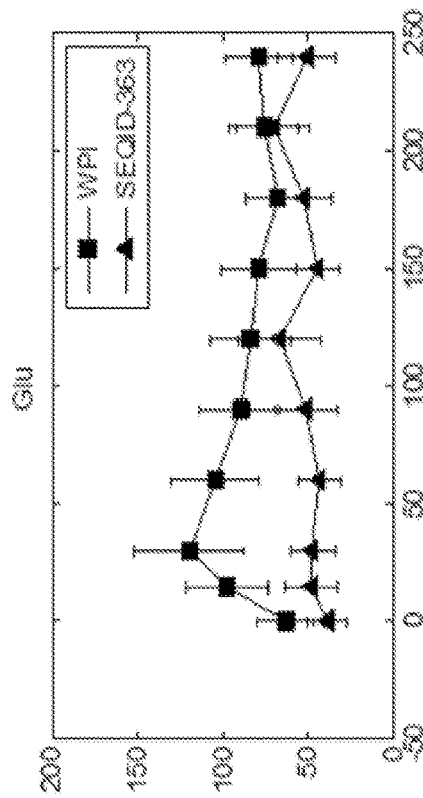
Figure 72B:
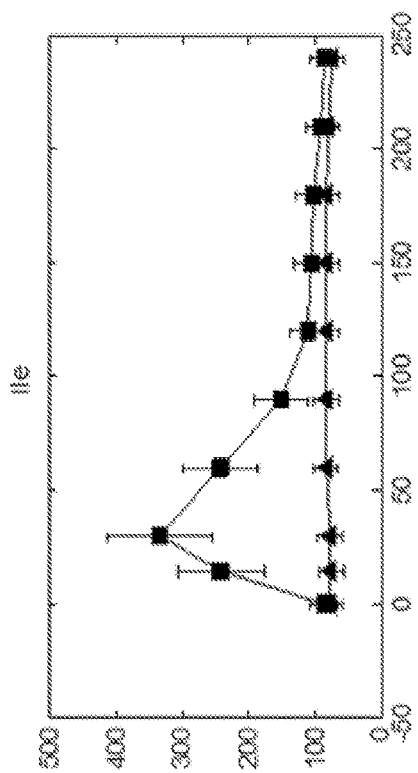
Figure 72B:
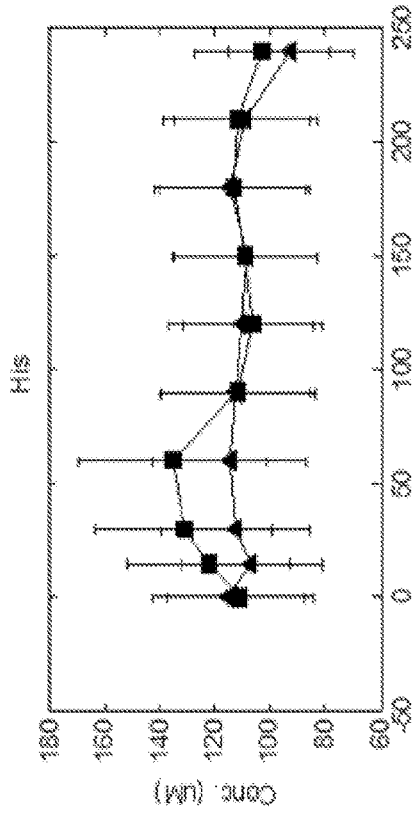
Figure 72C:
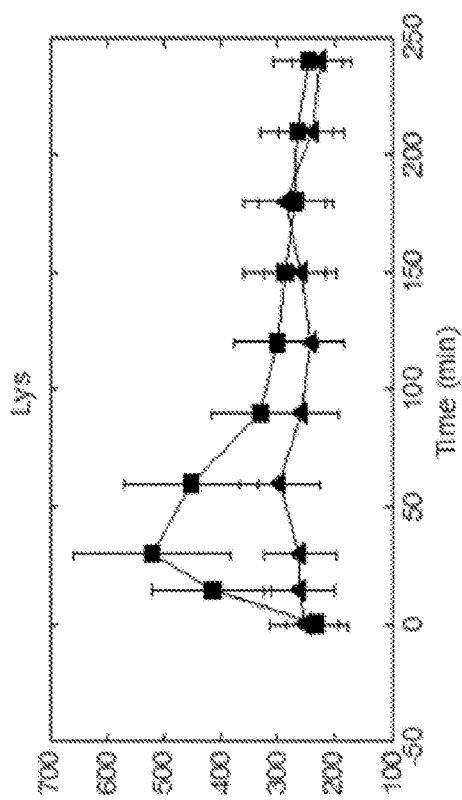
Figure 72C:
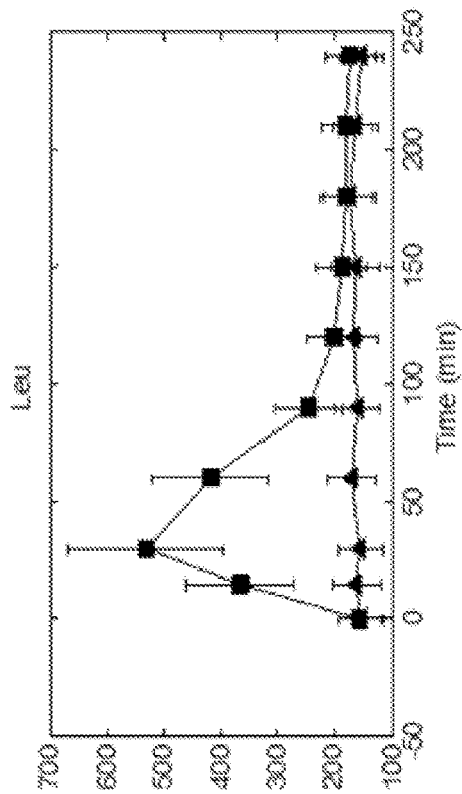

FIG. 70 is a chart demonstrating integrated area under the curve (AUC) of aggregate groups, essential amino acids (EAA), branched chain amino acids (BCAA), and total amino acids (TAA), for WPI and SEQID-00105

FIG. 71 is a series of charts demonstrating human plasma time course of measured amino acid s for WPI and SEQID-00363.

FIG. 72 is a series of charts demonstrating human plasma time course of measured amino acid s for WPI and SEQID-00363.

Figure 73A:
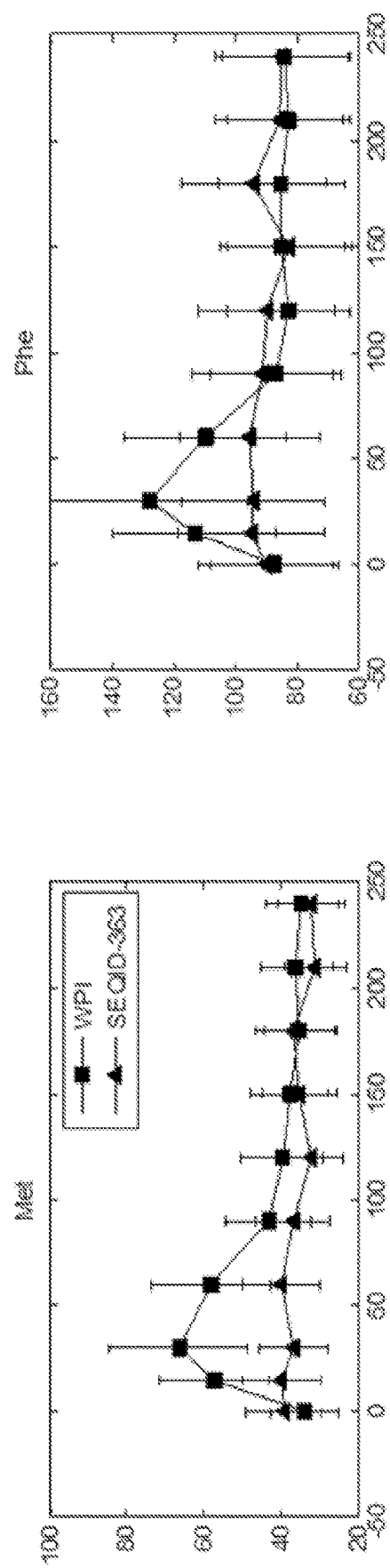
Figure 73B:
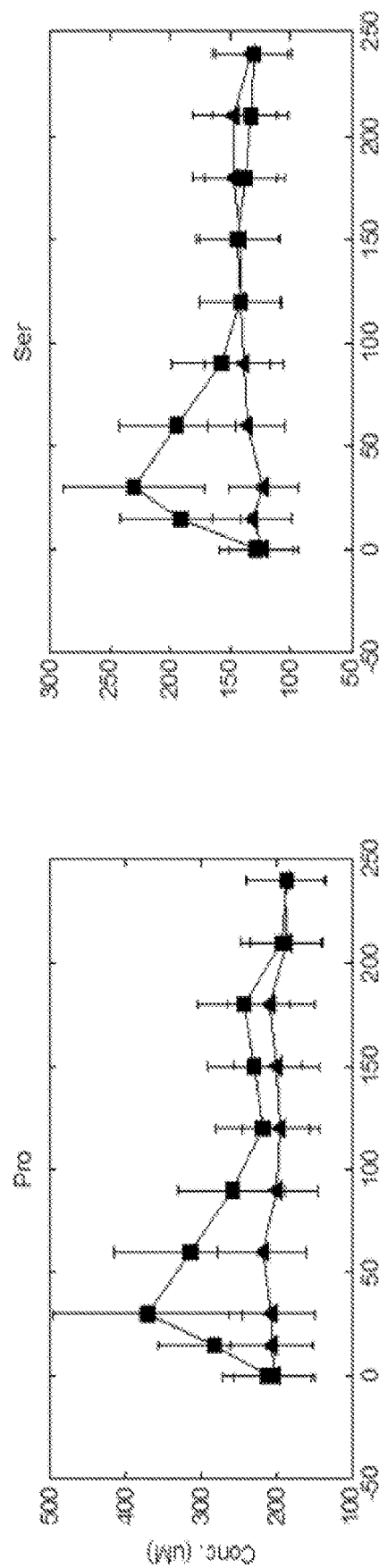
Figure 73C:
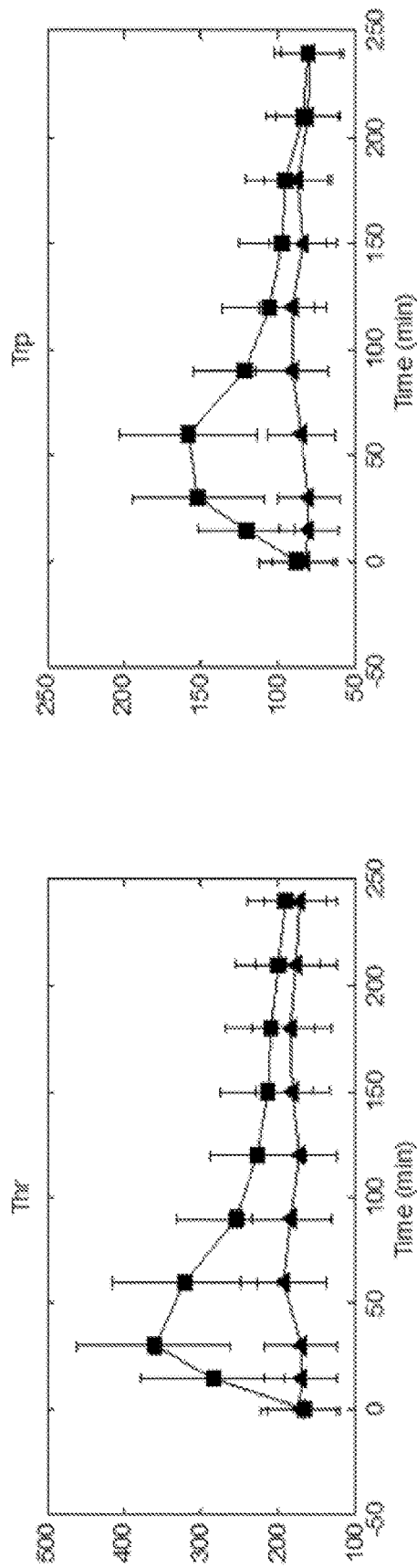

FIG. 73 is a series of charts demonstrating human plasma time course of measured amino acid s for WPI and SEQID-00363.

Figure 74A:
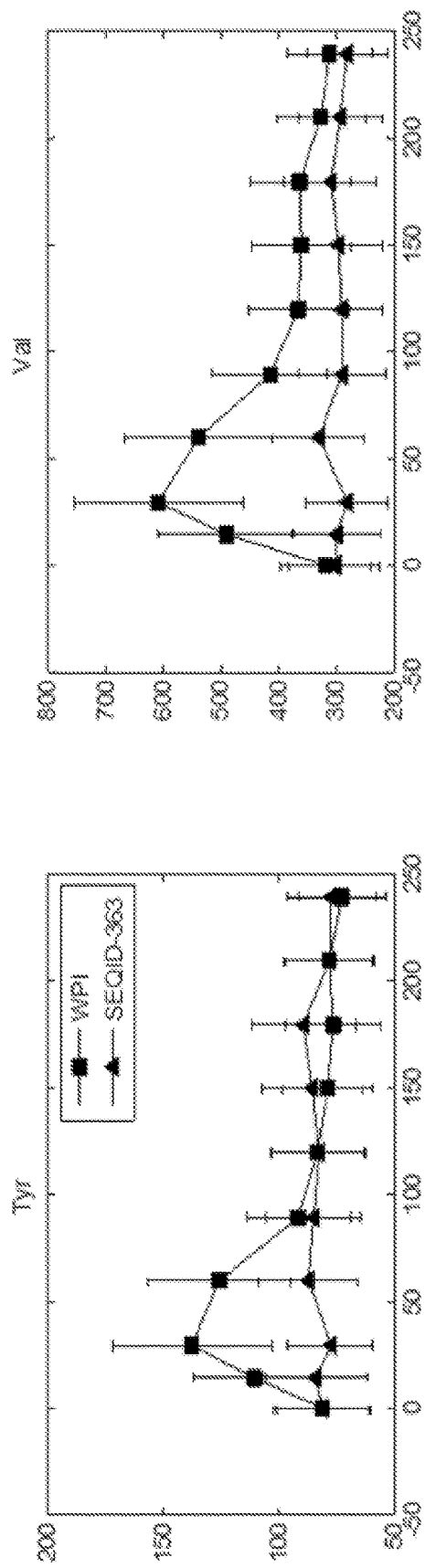
Figure 74B:
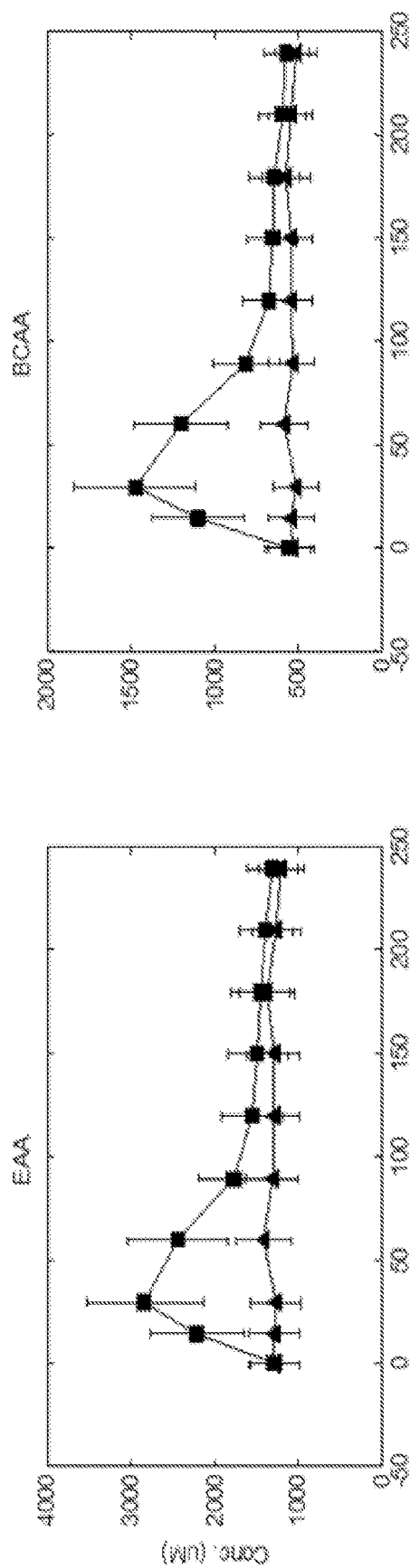
Figure 74C:
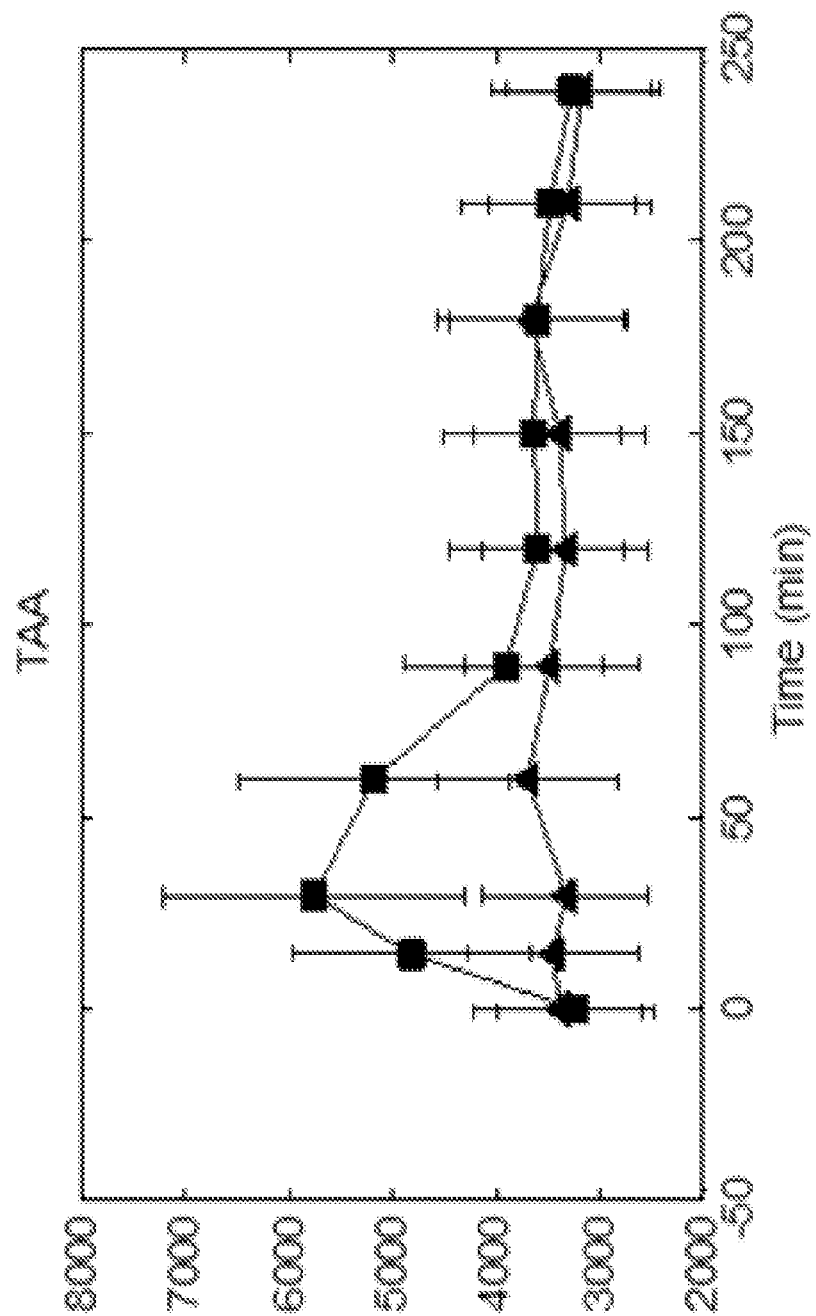
Figure 75A:
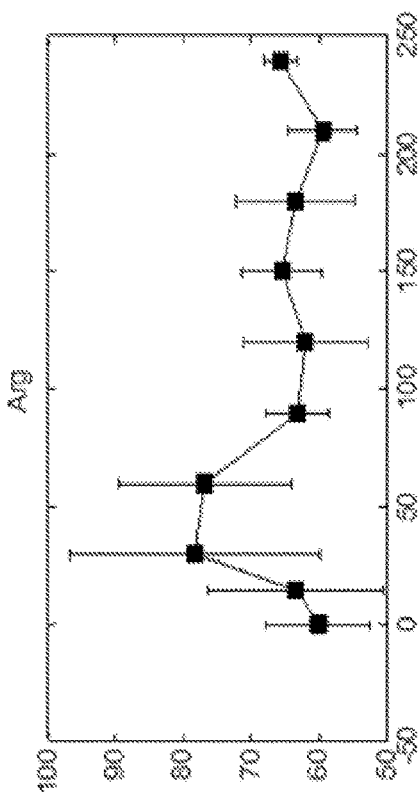
Figure 75A:
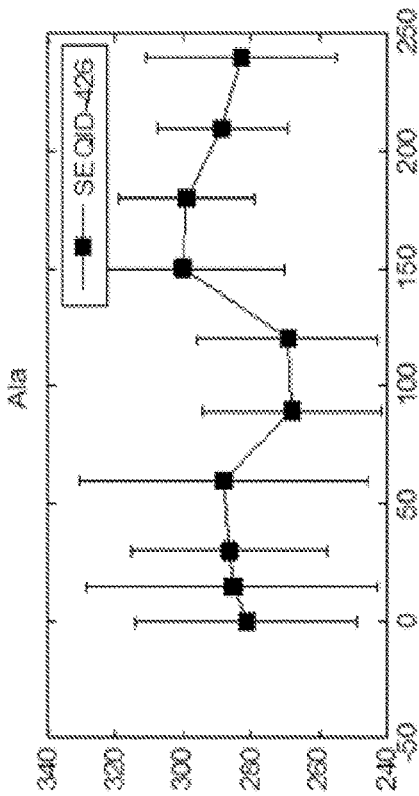
Figure 75B:
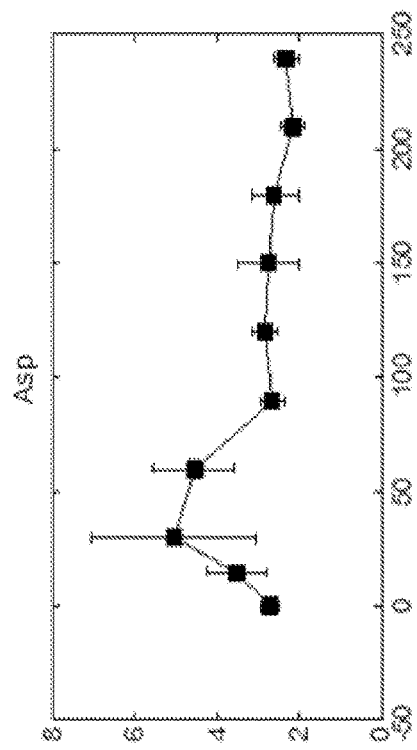
Figure 75B:
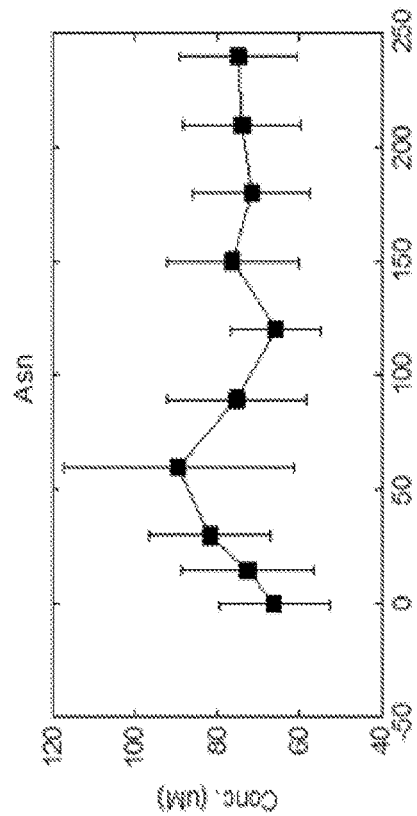
Figure 75C:
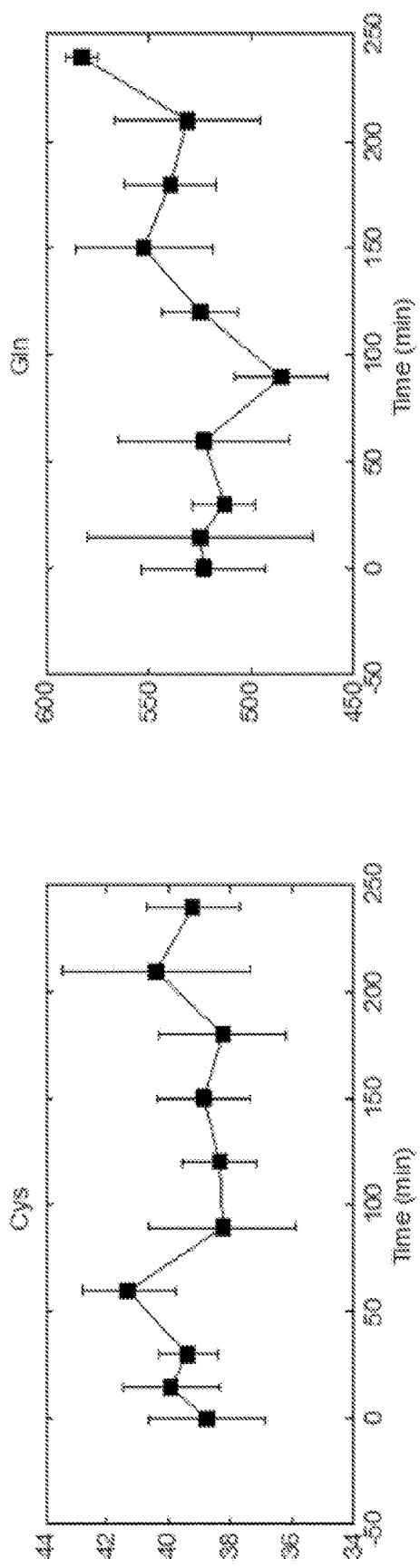

FIG. 74 is a series of charts demonstrating human plasma time course of measured amino acid and the aggregate groups, essential amino acids (EAA), branched chain amino acids (BCAA), and total amino acids (TAA) for WPI and SEQID-363.

FIG. 75 is a series of charts demonstrating human plasma time course of measured amino acid s for WPI and SEQID-00426.

Figure 76A:
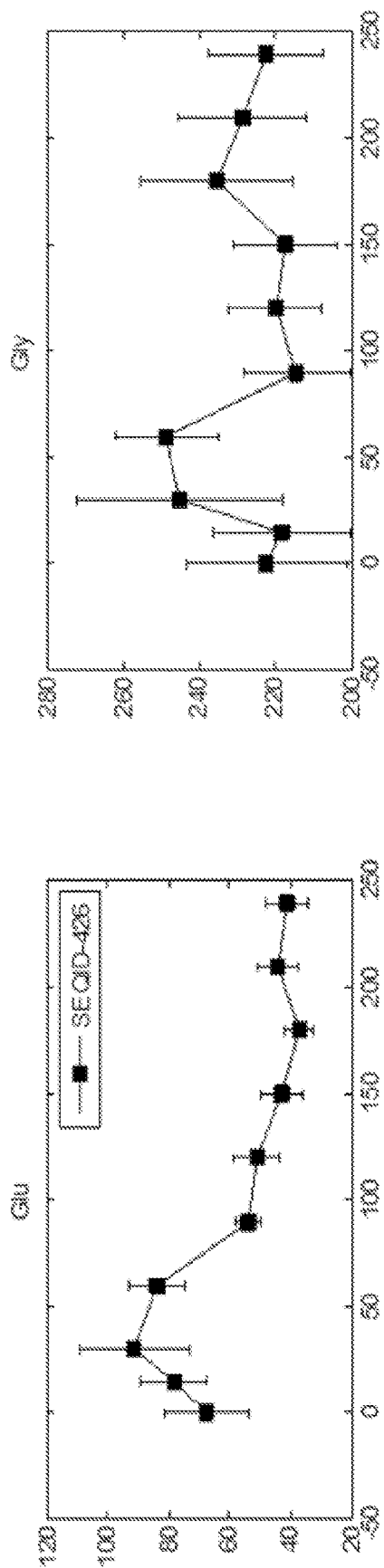
Figure 76B:
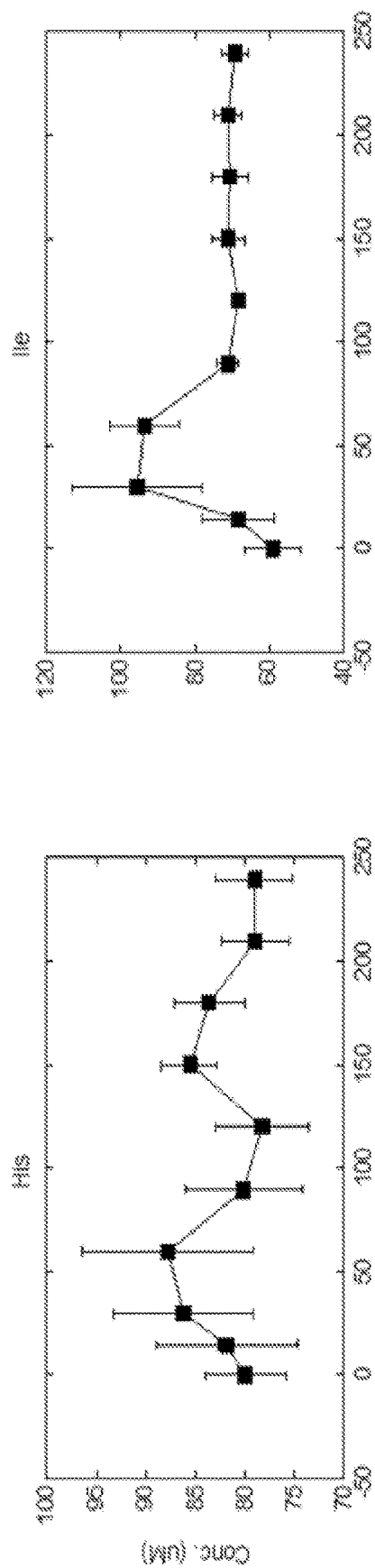
Figure 76C:
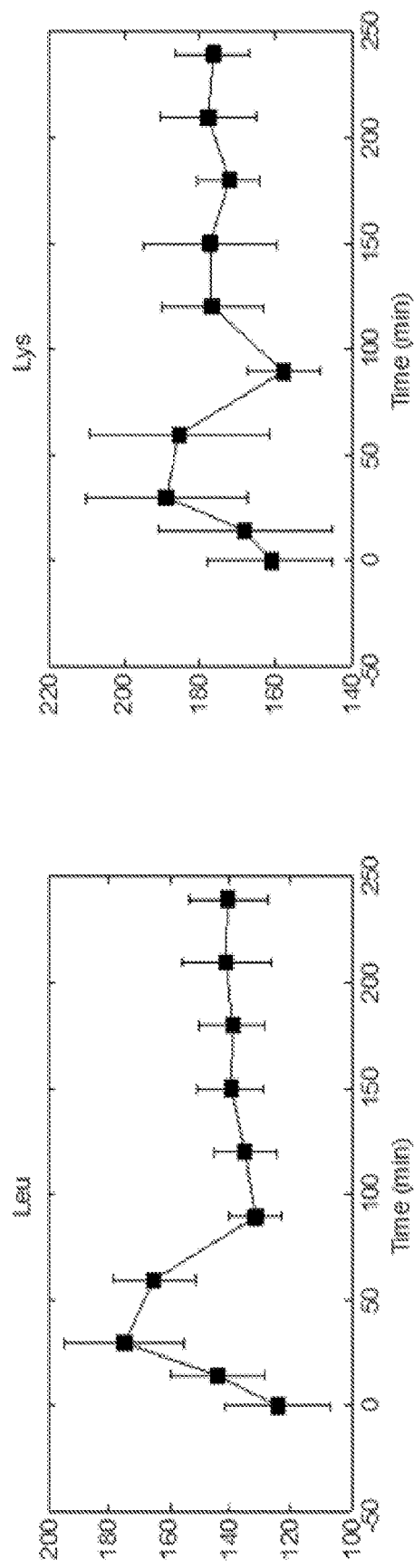
Figure 77A:
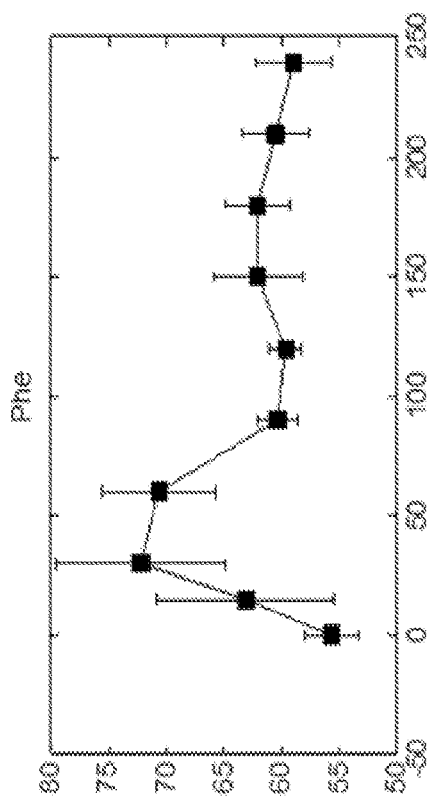
Figure 77A:
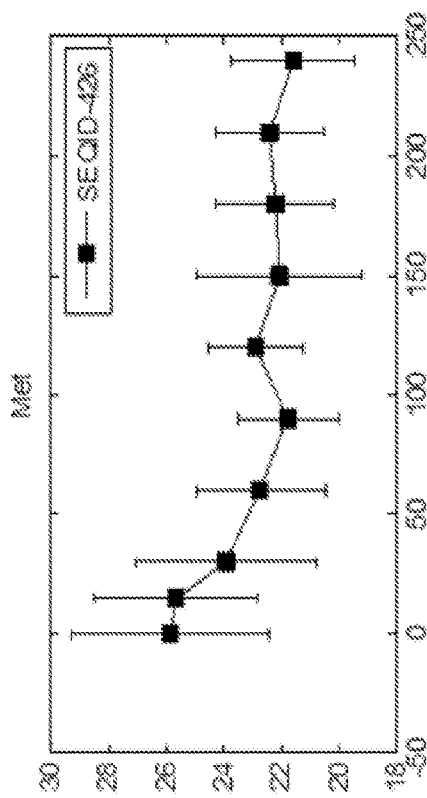
Figure 77B:
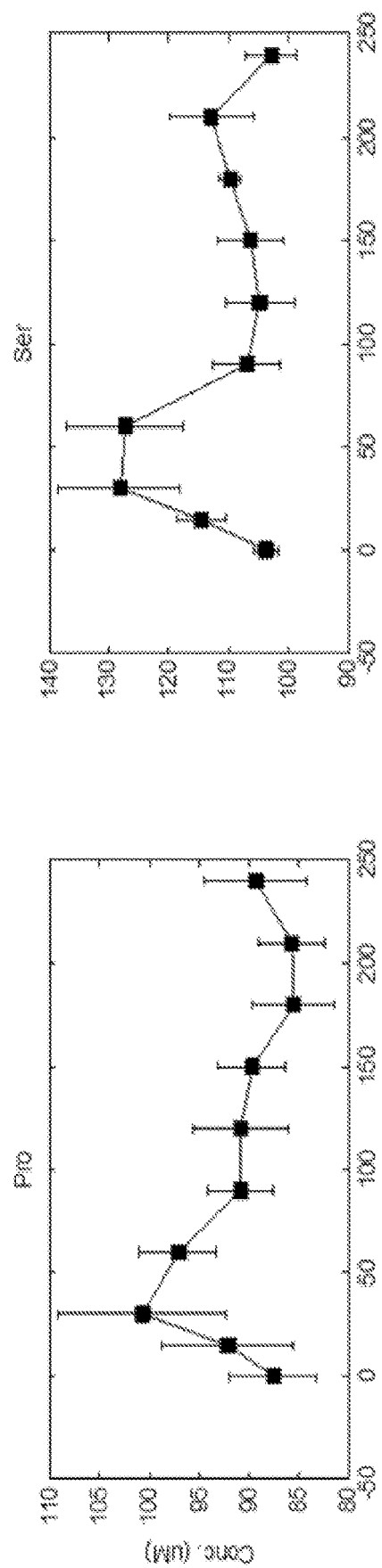
Figure 77C:
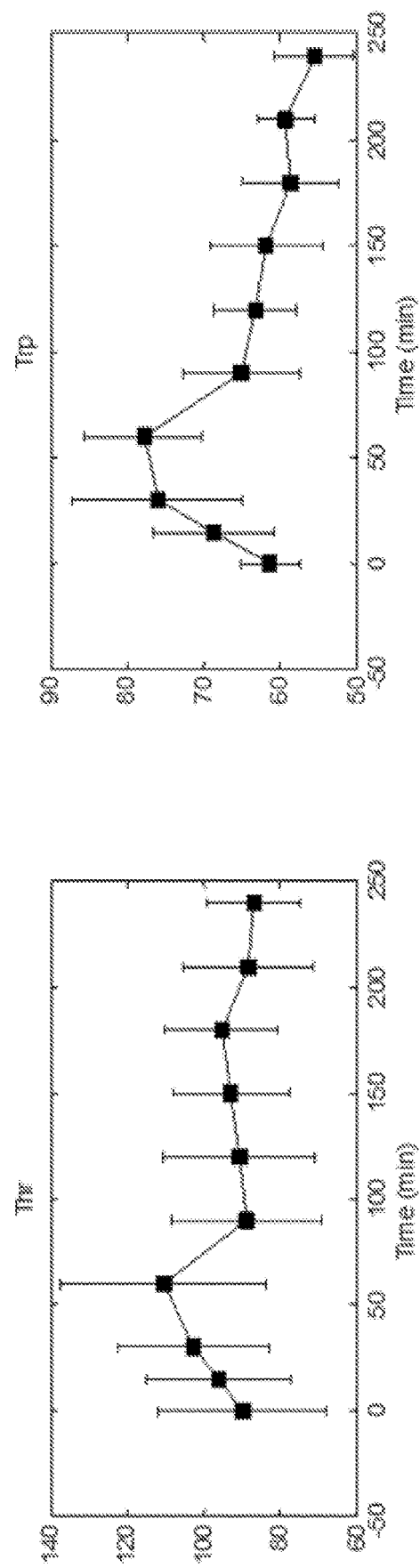
Figure 78A:
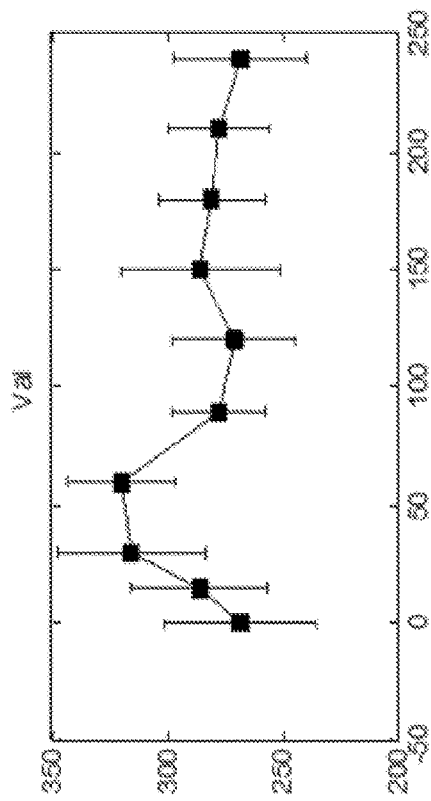
Figure 78A:
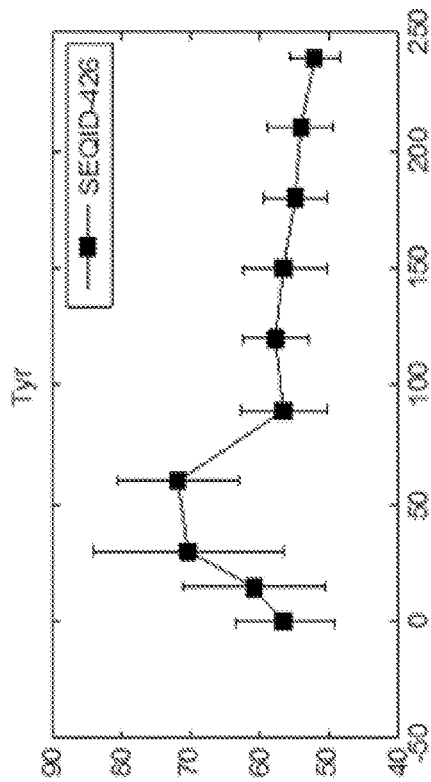
Figure 78B:
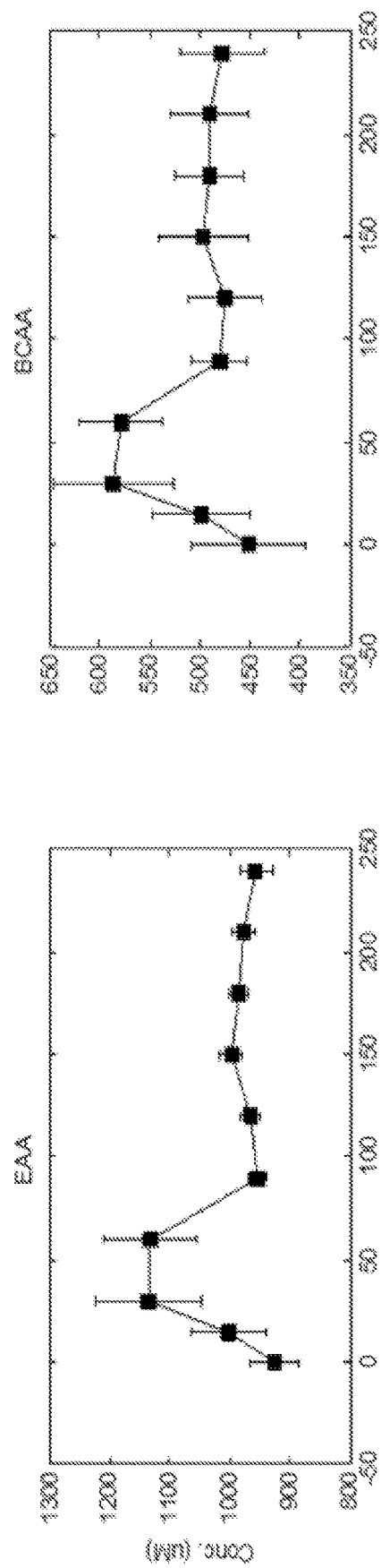
Figure 78C:
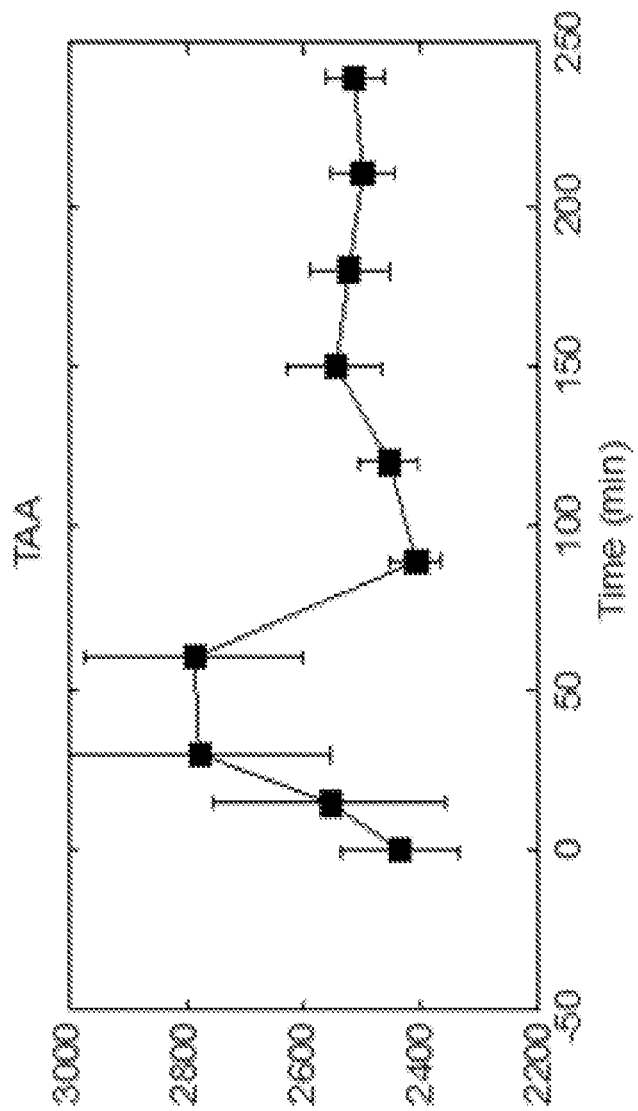

FIG. 76 is a series of charts demonstrating human plasma time course of measured amino acid s for WPI and SEQID-00426.

FIG. 77 is a series of charts demonstrating human plasma time course of measured amino acid s for WPI and SEQID-00426.

FIG. 78 is a series of charts demonstrating human plasma time course of measured amino acid and the aggregate groups, essential amino acids (EAA), branched chain amino acids (BCAA), and total amino acids (TAA) for WPI and SEQID-00426.

DETAILED DESCRIPTION

Terms used in the claims and specification are defined as set forth below unless otherwise specified.

It must be noted that, as used in the specification and the appended claims, the singular forms "a," "an" and "the" include plural referents unless the context clearly dictates otherwise.

Definitions

An "agriculturally-derived food product" is a food product resulting from the cultivation of soil or rearing of animals.

The term "ameliorating" refers to any therapeutically beneficial result in the treatment of a disease state, e.g., including prophylaxis, lessening in the severity or progression, remission, or cure thereof.

As used herein, the term "autotrophic" refers to an organism that produces complex organic compounds (such as carbohydrates, fats, and proteins) from simple inorganic molecules using energy from light (by photosynthesis) or inorganic chemical reactions (chemosynthesis).

As used herein, a "body mass index" or "BMI" or "Quetelet index" is a subject's weight in kilograms divided by the square of the subject's height in meters ($kg/m^2$). For adults, a frequent use of the BMI is to assess how much an individual's body weight departs from what is normal or desirable for a person of his or her height. The weight excess or deficiency may, in part, be accounted for by body fat, although other factors such as muscularity also affect BMI significantly. The World Health Organization regards a BMI of less than 18.5 as underweight and may indicate malnutrition, an eating disorder, or other health problems, while a BMI greater than 25 is considered overweight and above 30 is considered obese. (World Health Organization. BMI classification).

As used herein, a "branched chain amino acid" is an amino acid selected from Leucine, Isoleucine, and Valine.

As used herein, "cachexia" refers to a multifaceted clinical syndrome that results in muscle wasting and weight loss. It is a complex condition where protein catabolism exceeds protein anabolism, which makes muscle wasting a primary feature of the condition. In addition to the metabolic derangements in protein metabolism, it is also characterized by anorexia and inflammation. These derangements plus impaired protein metabolism are responsive to nutrition therapy to varying degrees.

As used herein, "calorie control" and "calorie restriction" refer to the process of reducing a subject's calorie intake from food products, either relative to the subject's prior calorie intake or relative to an appropriate calorie intake standard.

Generally, the terms "cancer" and "cancerous" refer to or describe the physiological condition in mammals that is typically characterized by unregulated cell growth. More specifically, cancers that are treated using any one or more tyrosine kinase inhibitors, other drugs blocking the receptors or their ligands, or variants thereof, and in connection with the methods provided herein include, but are not limited to, carcinoma, lymphoma, blastoma, sarcoma, leukemia, mesothelioma, squamous cell cancer, lung cancer including small-cell lung cancer and non-small cell lung cancer (which includes large-cell carcinoma, adenocarcinoma of the lung, and squamous carcinoma of the lung), cancer of the peritoneum, hepatocellular cancer, gastric or stomach cancer (including gastrointestinal cancer and gastrointestinal stromal cancer), pancreatic cancer, glioblastoma, cervical cancer, ovarian cancer, liver cancer, bladder cancer, breast cancer, colon cancer, colorectal cancer, endometrial or uterine carcinoma, salivary gland carcinoma, kidney or renal cancer, prostate cancer, cervical cancer, vulval cancer, thyroid cancer, head and neck cancer, melanoma, superficial spreading melanoma, lentigo maligna melanoma, acral lentiginous melanomas, nodular melanomas, T-cell lymphomas, B-cell lymphomas (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute myeloid leukemia (AML); chronic myeloid leukemia (CML); acute lymphoblastic leukemia (ALL); Hairy cell leukemia; chronic myeloblastic leukemia; or post-transplant lymphoproliferative disorder (PTLD), as well as abnormal vascular proliferation associated with phakomatoses, edema (such as that associated with brain tumors), and Meigs' syndrome.

A "comestible product" includes an edible product, while a "non-comestible product" is generally an inedible product or contains an inedible product. To be "substantially free of non-comestible products" means a composition does not have an amount or level of non-comestible product sufficient to render the composition inedible, dangerous or otherwise unfit for consumption by its intended consumer. Alternatively, a polypeptide can be substantially free of non-comestible products, meaning the polypeptide does not contain or have associated therewith an amount or level of non-comestible product sufficient to render a composition containing the polypeptide inedible by, or unsafe or deleterious to, its intended consumer. In preferred embodiments a composition substantially free of non-comestible products can be consumed in a nutritional amount by an intended consumer who does not suffer or is not at increased risk of suffering a deleterious event from such consumption. For example, levels of lead and other metals are well-documented as having significant risk including toxicity to humans when present in food, particularly foods containing an agriculturally-derived product grown in soil contaminated with lead and/or other metals. Thus, products such as foods, beverages, and compounds containing industrially-produced polypeptides having metal content above a certain parts per million (ppm), are considered non-comestible products, such metal content depending upon the metal as recognized in the art. For example, inclusion of lead or cadmium in an industrially-produced polypeptide at levels such that the lead will have a deleterious biological effect when consumed by a mammal will generally render a composition containing the industrially-produced polypeptide non-comestible. Notwithstanding the above, some polypeptides have certain amounts of metals complexed to or incorporated therein (such as iron, zinc, calcium and magnesium) and such metals shall not necessarily render the polypeptides non-comestible.

The term "control sequences" is intended to encompass, at a minimum, any component whose presence is essential for expression, and can also encompass an additional component whose presence is advantageous, for example, leader sequences and fusion partner sequences.

As used herein, a patient is "critically-medically ill" if the patient, because of medical illness, experiences changes in at least one of body mass index and muscle mass (e.g., sarcopenia). In some embodiments the patient is confined to bed for at least 25%, at least 50%, at least 60%, at least 70%, at least 80%, at least 90%, at least 95%, or 100% of their waking time. In some embodiments the patient is unconscious. In some embodiments the patient has been confined to bed as described in this paragraph for at least 1 day, 2 days, 3 days, 4 days, 5 days, 10 days, 2 weeks, 3 weeks, 4 weeks, 5 weeks, 10 weeks or longer.

As used herein, the phrase "degenerate variant" of a reference nucleic acid sequence encompasses nucleic acid sequences that can be translated, according to the standard genetic code, to provide an amino acid sequence identical to that translated from the reference nucleic acid sequence. The term "degenerate oligonucleotide" or "degenerate primer" is used to signify an oligonucleotide capable of hybridizing with target nucleic acid sequences that are not necessarily identical in sequence but that are homologous to one another within one or more particular segments.

As used herein a "desirable body mass index" is a body mass index of from about 18.5 to about 25. Thus, if a subject has a BMI below about 18.5, then an increase in the subject's BMI is an increase in the desirability of the subject's BMI. If instead a subject has a BMI above about 25, then a decrease in the subject's BMI is an increase in the desirability of the subject's BMI.

As used herein, the term "diabetes" includes any metabolic disease in which a subject is unable to produce any or a sufficient amount of insulin or is otherwise unable to regulate blood glucose level. The term "pre-diabetes" is also termed "impaired fasting glucose" includes a condition in which fasting glucose is above an accepted normal limit As used herein, an "elderly" mammal is one who experiences age related changes in at least one of body mass index and muscle mass (e.g., age related sarcopenia). In some embodiments an "elderly" human is at least 50 years old, at least 60 years old, at least 65 years old, at least 70 years old, at least 75 years old, at least 80 years old, at least 85 years old, at least 90 years old, at least 95 years old, or at least 100 years old. In some embodiments and an elderly animal, mammal, or human is a human who has experienced a loss of muscle mass from peak lifetime muscle mass of at least 5%, at least 10%, at least 15%, at least 20%, at least 25%, at least 30%, at least 35%, at least 40%, at least 45%, at least 50%, at least 55%, or at least 60%. Because age related changes to at least one of body mass index and muscle mass are known to correlate with increasing age, in some embodiments an elderly mammal is identified or defined simply on the basis of age. Thus, in some embodiments an "elderly" human is identified or defined simply by the fact that their age is at least 60 years old, at least 65 years old, at least 70 years old, at least 75 years old, at least 80 years old, at least 85 years old, at least 90 years old, at least 95 years old, or at least 100 years old, and without recourse to a measurement of at least one of body mass index and muscle mass.

As used herein, an "essential amino acid" is an amino acid selected from Histidine, Isoleucine, Leucine, Lysine, Methionine, Phenylalanine, Threonine, Tryptophan, and Valine. However, it should be understood that "essential amino acids" can vary through a typical lifespan, e.g., cysteine, tyrosine, and arginine are considered essential amino acids in infant humans. Imura K, Okada A (1998). "Amino acid metabolism in pediatric patients". Nutrition 14 (1): 143-8. In addition, the amino acids arginine, cysteine, glycine, glutamine, histidine, proline, serine and tyrosine are considered "conditionally essential" in adults, meaning they are not normally required in the diet, but must be supplied exogenously to specific populations that do not synthesize them in adequate amounts. Fürst P, Stehle P (1 Jun. 2004). "What are the essential elements needed for the determination of amino acid requirements in humans?". Journal of Nutrition 134 (6 Suppl): 1558S-1565S; and Reeds P J (1 Jul. 2000). "Dispensable and indispensable amino acids for humans". J. Nutr. 130 (7): 1835 S-40S.

As used herein, "exercise" is, most broadly, any bodily activity that enhances or maintains physical fitness and overall health and wellness. Exercise is performed for various reasons including strengthening muscles and the cardiovascular system, honing athletic skills, weight loss or maintenance, as well as for the purpose of enjoyment.

As used herein, an "exercise regimen" includes any course of exercise for the promotion of health, or for the treatment or prevention of disease.

As used herein, an "expression control sequence" refers to polynucleotide sequences which are necessary to affect the expression of coding sequences to which they are operatively linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence.

As used herein, "function" and "functional performance" refers to a functional test that simulates daily activities. "Muscle function" or "functional performance" is measured by any suitable accepted test, including timed-step test (step up and down from a 4 inch bench as fast as possible 5 times), timed floor transfer test (go from a standing position to a supine position on the floor and thereafter up to a standing position again as fast as possible for one repetition), and physical performance battery test (static balance test, chair test, and a walking test) (Borsheim et al., "Effect of amino acid supplementation on muscle mass, strength and physical function in elderly," Clin Nutr 2008; 27:189-195). As used herein, a "performance-associated" injury or damage, such as a tissue injury or tissue damage, results from a functional activity, such as a physical or athletic performance.

The term "fusion protein" refers to a polypeptide comprising a polypeptide or fragment coupled to heterologous amino acid sequences. Fusion proteins are useful because they can be constructed to contain two or more desired functional elements that can be from two or more different proteins. A fusion protein comprises at least 10 contiguous amino acids from a polypeptide of interest, or at least 20 or 30 amino acids, or at least 40, 50 or 60 amino acids, or at least 75, 100 or 125 amino acids. The heterologous polypeptide included within the fusion protein is usually at least 6 amino acids in length, or at least 8 amino acids in length, or at least 15, 20, or 25 amino acids in length. Fusions that include larger polypeptides, such as an IgG Fc region, and even entire proteins, such as the green fluorescent protein ("GFP") chromophore-containing proteins, have particular utility. Fusion proteins can be produced recombinantly by constructing a nucleic acid sequence which encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

Sequence homology for polypeptides, which is also referred to as percent sequence identity, is typically measured using sequence analysis software. See, e.g., the Sequence Analysis Software Package of the Genetics Computer Group (GCG), University of Wisconsin Biotechnology Center, 910 University Avenue, Madison, Wis. 53705. Protein analysis software matches similar sequences using a measure of homology assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild-type polypeptide and a mutein thereof. See, e.g., GCG Version 6. An exemplary algorithm when comparing a particular polypeptide sequence to a database containing a large number of sequences from different organisms is the computer program BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

As used herein, a "gastrointestinal disorder" or a "gastrointestinal disease" includes any disorder or disease involving the gastrointestinal tract or region thereof, namely the esophagus, stomach, small intestine, large intestine or rectum, as well as organs and tissues associated with digestion, e.g., the pancreas, the gallbladder, and the liver.

As used herein, the term "heterotrophic" refers to an organism that cannot fix carbon and uses organic carbon for growth.

As used herein, a polypeptide has "homology" or is "homologous" to a second polypeptide if the nucleic acid sequence that encodes the polypeptide has a similar sequence to the nucleic acid sequence that encodes the second polypeptide. Alternatively, a polypeptide has homology to a second polypeptide if the two polypeptides have similar amino acid sequences. (Thus, the term "homologous polypeptides" is defined to mean that the two polypeptides have similar amino acid sequences.) When "homologous" is used in reference to polypeptides or peptides, it is recognized that residue positions that are not identical often differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a polypeptide. In cases where two or more amino acid sequences differ from each other by conservative substitutions, the percent sequence identity or degree of homology can be adjusted upwards to correct for the conservative nature of the substitution. Means for making this adjustment are well known to those of skill in the art. See, e.g., Pearson, 1994, Methods Mol. Biol. 24:307-31 and 25:365-89. The following six groups each contain amino acids that are conservative substitutions for one another: 1) Serine, Threonine; 2) Aspartic Acid, Glutamic Acid; 3) Asparagine, Glutamine; 4) Arginine, Lysine; 5) Isoleucine, Leucine, Methionine, Alanine, Valine, and 6) Phenylalanine, Tyrosine, Tryptophan. In some embodiments, polymeric molecules (e.g., a polypeptide sequence or nucleic acid sequence) are considered to be homologous to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, %, at least 97%, %, at least 98%, or at least 99% identical. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, %, at least 97%, %, at least 98%, or at least 99% similar. The term "homologous" necessarily refers to a comparison between at least two sequences (nucleotides sequences or amino acid sequences). In some embodiments, two nucleotide sequences are considered to be homologous if the polypeptides they encode are at least about 50% identical, at least about 60% identical, at least about 70% identical, at least about 80% identical, or at least about 90% identical for at least one stretch of at least about 10, 15, 20, 25, 30, 35, 40, 45, 50 or over 50 amino acids. In some embodiments, homologous nucleotide sequences are characterized by the ability to encode a stretch of at least 4-5 uniquely specified amino acids. Both the identity and the approximate spacing of these amino acids relative to one another must be considered for nucleotide sequences to be considered homologous. In some embodiments of nucleotide sequences less than 60 nucleotides in length, homology is determined by the ability to encode a stretch of at least 4-5 uniquely specified amino acids. In some embodiments, two polypeptide sequences are considered to be homologous if the polypeptides are at least about 50% identical, at least about 60% identical, at least about 70% identical, at least about 80% identical, or at least about 90% identical for at least one stretch of at least about 20 amino acids. In other embodiments, two polypeptide sequences are considered to be homologous if the polypeptides are similar, such as at least about 50% similar, at least about 60% similar, at least about 70% similar, at least about 80% similar, or at least about 90% similar, or at least about 95% similar for at least one stretch of at least about 20 amino acids. In some embodiments similarity is demonstrated by fewer nucleotide changes that result in an amino acid change (e.g., a nucleic acid sequence having a single nucleotide change is more similar to a reference nucleic acid sequence than a nucleic acid sequence having two nucleotide changes, even if both changes result in an identical amino acid substitution.

The term "in situ" refers to processes that occur in a living cell growing separate from a living organism, e.g., growing in tissue culture.

As used herein, the term "in vitro" refers to events that occur in an artificial environment, e.g., in a test tube or reaction vessel, in cell culture, in a Petri dish, etc., rather than within an organism (e.g., animal, plant, or microbe). As used herein, the term "ex vivo" refers to experimentation done in or on tissue in an environment outside the organism.

The term "in vivo" refers to processes that occur in a living organism.

As used herein, a "modified derivative" refers to polypeptides or fragments thereof that are substantially homologous in primary structural sequence to a reference polypeptide sequence but which include, e.g., in vivo or in vitro chemical and biochemical modifications or which incorporate amino acids that are not found in the reference polypeptide. Such modifications include, for example, acetylation, carboxylation, phosphorylation, glycosylation, ubiquitination, labeling, e.g., with radionuclides, and various enzymatic modifications, as will be readily appreciated by those skilled in the art. A variety of methods for labeling polypeptides and of substituents or labels useful for such purposes are well known in the art, and include radioactive isotopes such as 125I, 32P, 35S, and 3H, ligands that bind to labeled antiligands (e.g., antibodies), fluorophores, chemiluminescent agents, enzymes, and antiligands that can serve as specific binding pair members for a labeled ligand. The choice of label depends on the sensitivity required, ease of conjugation with the primer, stability requirements, and available instrumentation. Methods for labeling polypeptides are well known in the art. See, e.g., Ausubel et al., Current Protocols in Molecular Biology, Greene Publishing Associates (1992, and Supplements to 2002).

As used herein, "muscle strength" refers to the amount of force a muscle can produce with a single maximal effort. There are two types of muscle strength, static strength and dynamic strength. Static strength refers to isometric contraction of a muscle, where a muscle generates force while the muscle length remains constant and/or when there is no movement in a joint. Examples include holding or carrying an object, or pushing against a wall. Dynamic strength refers to a muscle generating force that results in movement. Dynamic strength can be isotonic contraction, where the muscle shortens under a constant load or isokinetic contraction, where the muscle contracts and shortens at a constant speed. Dynamic strength can also include isoinertial strength. In addition, the term "muscle strength" refers to maximum dynamic muscle strength, as described by the term "one repetition maximum" (1RM). This is a measurement of the greatest load (in kilograms) that can be fully moved (lifted, pushed or pulled) once without failure or injury. This value can be measured directly, but doing so requires that the weight is increased until the subject fails to carry out the activity to completion. Alternatively, 1RM is estimated by counting the maximum number of exercise repetitions a subject can make using a load that is less than the maximum amount the subject can move. Leg extension and leg flexion are often measured in clinical trials (Borsheim et al., "Effect of amino acid supplementation on muscle mass, strength and physical function in elderly," Clin Nutr 2008; 27:189-195; Paddon-Jones, et al., "Essential amino acid and carbohydrate supplementation ameliorates muscle protein loss in humans during 28 days bed rest," J Clin Endocrinol Metab 2004; 89:4351-4358).

As used herein, "muscle mass" refers to the weight of muscle in a subject's body. Similarly, "muscle anabolism" includes the synthesis of muscle proteins, and is a component of the process by which muscle mass is gained. Muscle mass includes the skeletal muscles, smooth muscles (such as cardiac and digestive muscles) and the water contained in these muscles. Muscle mass of specific muscles can be determined using dual energy x-ray absorptiometry (DEXA) (Padden-Jones et al., 2004). Total lean body mass (minus the fat), total body mass, and bone mineral content can be measured by DEXA as well. In some embodiments a change in the muscle mass of a specific muscle of a subject is determined, for example by DEXA, and the change is used as a proxy for the total change in muscle mass of the subject. Thus, for example, if a subject consumes a nutritive protein as disclosed herein and experiences an increase over a period of time in muscle mass in a particular muscle or muscle group, it can be concluded that the subject has experienced an increase in muscle mass. Changes in muscle mass can be measured in a variety of ways including protein synthesis, fractional synthetic rate, and certain key activities such mTor/mTorc. In general, "lean muscle mass" refers to the mass of muscle tissue in the absence of other tissues such as fat.

The term "nucleic acid fragment" as used herein refers to a nucleic acid sequence that has a deletion, e.g., a 5'-terminal or 3'-terminal deletion compared to a full-length reference nucleotide sequence. In an embodiment, the nucleic acid fragment is a contiguous sequence in which the nucleotide sequence of the fragment is identical to the corresponding positions in the naturally-occurring sequence. In some embodiments, fragments are at least 10, 15, 20, or 25 nucleotides long, or at least 20, 30, 40, 50, 60, 70, 80, 90, 100, 110, 120, 130, 140, or 150 nucleotides long. In some embodiments a fragment of a nucleic acid sequence is a fragment of an open reading frame sequence. In some embodiments such a fragment encodes a polypeptide fragment (as defined herein) of the protein encoded by the open reading frame nucleotide sequence.

A composition, formulation or product is "nutritional" or "nutritive" if it provides an appreciable amount of nourishment to its intended consumer, meaning the consumer assimilates all or a portion of the composition or formulation into a cell, organ, and/or tissue. Generally such assimilation into a cell, organ and/or tissue provides a benefit or utility to the consumer, e.g., by maintaining or improving the health and/or natural function(s) of said cell, organ, and/or tissue. A nutritional composition or formulation that is assimilated as described herein is termed "nutrition." By way of non-limiting example, a polypeptide is nutritional if it provides an appreciable amount of polypeptide nourishment to its intended consumer, meaning the consumer assimilates all or a portion of the protein, typically in the form of single amino acids or small peptides, into a cell, organ, and/or tissue. "Nutrition" also means the process of providing to a subject, such as a human or other mammal, a nutritional composition, formulation, product or other material. A nutritional product need not be "nutritionally complete," meaning if consumed in sufficient quantity, the product provides all carbohydrates, lipids, essential fatty acids, essential amino acids, conditionally essential amino acids, vitamins, and minerals required for health of the consumer. Additionally, a "nutritionally complete protein" contains all protein nutrition required (meaning the amount required for physiological normalcy by the organism) but does not necessarily contain micronutrients such as vitamins and minerals, carbohydrates or lipids.

In preferred embodiments, a composition or formulation is nutritional in its provision of polypeptide capable of decomposition (i.e., the breaking of a peptide bond, often termed protein digestion) to single amino acids and/or small peptides (e.g., two amino acids, three amino acids, or four amino acids, possibly up to ten amino acids) in an amount sufficient to provide a "nutritional benefit." In addition, in certain embodiments provided are nutritional polypeptides that transit across the gastrointestinal wall and are absorbed into the bloodstream as small peptides (e.g., larger than single amino acids but smaller than about ten amino acids) or larger peptides, oligopeptides or polypeptides (e.g., >11 amino acids). A nutritional benefit in a polypeptide-containing composition can be demonstrated and, optionally, quantified, by a number of metrics. For example, a nutritional benefit is the benefit to a consuming organism equivalent to or greater than at least about 0.5% of a reference daily intake value of protein, such as about 1%, 2%, 3%, 4%, 5%, 6%, 7%, 8%, 9%, 10%, 15%, 20%, 25%, 30%, 35%, 40%, 45%, 50%, 60%, 65%, 70%, 75%, 80%, 85%, 90%, 95%, 100% or greater than about 100% of a reference daily intake value. Alternatively, a nutritional benefit is demonstrated by the feeling and/or recognition of satiety by the consumer. In other embodiments, a nutritional benefit is demonstrated by incorporation of a substantial amount of the polypeptide component of the composition or formulation into the cells, organs and/or tissues of the consumer, such incorporation generally meaning that single amino acids or short peptides are used to produce polypeptides de novo intracellularly. A "consumer" or a "consuming organism" means any animal capable of ingesting the product having the nutritional benefit. Typically, the consumer will be a mammal such as a healthy human, e.g., a healthy infant, child, adult, or older adult. Alternatively, the consumer will be a mammal such as a human (e.g., an infant, child, adult or older adult) at risk of developing or suffering from a disease, disorder or condition characterized by (i) the lack of adequate nutrition and/or (ii) the alleviation thereof by the nutritional products of the present invention. An "infant" is generally a human under about age 1 or 2, a "child" is generally a human under about age 18, and an "older adult" or "elderly" human is a human aged about 65 or older.

In other preferred embodiments, a composition or formulation is nutritional in its provision of carbohydrate capable of hydrolysis by the intended consumer (termed a "nutritional carbohydrate"). A nutritional benefit in a carbohydrate-containing composition can be demonstrated and, optionally, quantified, by a number of metrics. For example, a nutritional benefit is the benefit to a consuming organism equivalent to or greater than at least about 2% of a reference daily intake value of carbohydrate.

A polypeptide "nutritional domain" as used herein means any domain of a polypeptide that is capable of providing nutrition. Preferably, a polypeptide nutritional domain provides one or more advantages over the full-length polypeptide containing the nutritional domain, such as the nutritional domain provides more nutrition than the full-length polypeptide. For example, a polypeptide nutritional domain has a higher concentration of desirable amino acids, has a lower concentration of undesirable amino acids, contains a site for cleavage by a digestive protease, is easier to digest and/or is easier to produce from the digestion of a larger polypeptide, has improved storage characteristics, or a combination of these and/or other factors, in comparison to (i) a reference polypeptide or a reference polypeptide-containing mixture or composition, (ii) the protein(s) or polypeptide(s) present in an agriculturally-derived food product, and/or (iii) the protein or polypeptide, products present in the diet of a mammalian subject. Other advantages of a polypeptide nutritional domain includes easier and/or more efficient production, different or more advantageous physiochemical properties, and/or has different s or more advantageous safety properties (e.g., elimination of one or more allergy domains) relative to full-length polypeptide. A reference polypeptide can be a naturally occurring polypeptide or a recombinantly produced polypeptide, which in turn may have an amino acid sequence identical to or different from a naturally occurring polypeptide. A reference polypeptide may also be a consensus amino acid sequence not present in a naturally-occurring polypeptide. Additionally, a reference polypeptide-containing mixture or composition can be a naturally-occurring mixture, such as a mixture of polypeptides present in a dairy product such as milk or whey, or can be a synthetic mixture of polypeptides (which, in turn, can be naturally-occurring or synthetic). In certain embodiments the nutritional domain contains an amino acid sequence having an N-terminal amino acid and/or a C-terminal amino acid different from the N-terminal amino acid and/or a C-terminal amino acid of a reference secreted polypeptide, such as a full-length secreted polypeptide. For example, a nutritional domain has an N-terminal amino acid sequence that corresponds to an amino acid sequence internal to a larger secreted polypeptide that contains the nutritional domain. A nutritional domain may include or exclude a signal sequence of a larger secreted polypeptide. As used herein, a polypeptide that "contains" a polypeptide nutritional domain contains the entirety of the polypeptide nutritional domain as well as at least one additional amino acid, either N-terminal or C-terminal to the polypeptide nutritional domain. Generally polypeptide nutritional domains are secreted from the cell or organism containing a nucleic acid encoding the nutritional domain, and are termed "secreted polypeptide nutritional domains," and, in circumstances wherein the nutritional domain is secreted from a unicellular (or single celled) organism, it is termed a "unicellular secreted polypeptide nutritional domain."

In other preferred embodiments, a composition or formulation is nutritional in its provision of lipid capable of digestion, incorporation, conversion, or other cellular uses by the intended consumer (termed a "nutritional lipid"). A nutritional benefit in a lipid-containing composition can be demonstrated and, optionally, quantified, by a number of metrics. For example, a nutritional benefit is the benefit to a consuming organism equivalent to or greater than at least about 2% of a reference daily intake value of lipid (i.e., fat).

As used herein, an "obese" subject has a level of excess body fat that, increasing the likelihood of the subject suffering from diseases including heart disease, type II diabetes, osteoporosis and osteoarthritis, and cancer, while an "overweight" subject is above a weight recognized as normal, acceptable, or desirable, but not obese. In Western countries, a subject having a BMI value exceeding 30 is considered obese, while a subject having a BMI value between 25-30 is considered overweight.

As used herein, "operatively linked" or "operably linked" expression control sequences refers to a linkage in which the expression control sequence is contiguous with the gene of interest to control the gene of interest, as well as expression control sequences that act in trans or at a distance to control the gene of interest.

The term "percent sequence identity" or "identical" in the context of nucleic acid sequences refers to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990).

The term "polynucleotide", "nucleic acid molecule," "nucleic acid," or "nucleic acid sequence" refers to a polymeric form of nucleotides of at least 10 bases in length. The term includes DNA molecules (e.g., cDNA or genomic or synthetic DNA) and RNA molecules (e.g., mRNA or synthetic RNA), as well as analogs of DNA or RNA containing non-natural nucleotide analogs, non-native internucleoside bonds, or both. The nucleic acid can be in any topological conformation. For instance, the nucleic acid can be single-stranded, double-stranded, triple-stranded, quadruplexed, partially double-stranded, branched, hairpinned, circular, or in a padlocked conformation. A "synthetic" RNA, DNA or a mixed polymer is one created outside of a cell, for example one synthesized chemically. The term "nucleic acid fragment" as used herein refers to a nucleic acid sequence that has a deletion, e.g., a 5'-terminal or 3'-terminal deletion of one or more nucleotides compared to a full-length reference nucleotide sequence. In an embodiment, the nucleic acid fragment is a contiguous sequence in which the nucleotide sequence of the fragment is identical to the corresponding positions in the naturally-occurring sequence. In some embodiments, fragments are at least 10, 15, 20, or 25 nucleotides long, or at least 20, 30, 40, 50, 60, 70, 80, 90, 100, 110, 120, 130, 140, 150, 200, 250, 300, 350, 400, 450, 500, 550, 600, 650, 700, 750, 800, 850, 900, 950, 1000, 1100, 1200, 1300, 1400, 1500, 1600, 1700, 1800 or greater than 1800 nucleotides long. In some embodiments a fragment of a nucleic acid sequence is a fragment of an open reading frame sequence. In some embodiments such a fragment encodes a polypeptide fragment (as defined herein) of the polypeptide encoded by the open reading frame nucleotide sequence.

The terms "polypeptide" and "protein" can be interchanged, and these terms encompass both naturally-occurring and non-naturally occurring polypeptides, and, as provided herein or as generally known in the art, fragments, mutants, derivatives and analogs thereof. A polypeptide can be monomeric, meaning it has a single chain, or polymeric, meaning it is composed of two or more chains, which can be covalently or non-covalently associated. Further, a polypeptide may comprise a number of different domains each of which has one or more distinct activities. For the avoidance of doubt, a polypeptide can be any length greater than or equal to two amino acids. The term "isolated polypeptide" is a polypeptide that by virtue of its origin or source of derivation (1) is not associated with naturally associated components that accompany it in any of its native states, (2) exists in a purity not found in nature, where purity can be adjudged with respect to the presence of other cellular material (e.g., is free of other polypeptides from the same species or from the host species in which the polypeptide was produced) (3) is expressed by a cell from a different species, (4) is recombinantly expressed by a cell (e.g., a polypeptide is an "isolated polypeptide" if it is produced from a recombinant nucleic acid present in a host cell and separated from the producing host cell, (5) does not occur in nature (e.g., it is a domain or other fragment of a polypeptide found in nature or it includes amino acid analogs or derivatives not found in nature or linkages other than standard peptide bonds), or (6) is otherwise produced, prepared, and/or manufactured by the hand of man. Thus, an "isolated polypeptide" includes a polypeptide that is produced in a host cell from a recombinant nucleic acid (such as a vector), regardless of whether the host cell naturally produces a polypeptide having an identical amino acid sequence. A "polypeptide" includes a polypeptide that is produced by a host cell via overexpression, e.g., homologous overexpression of the polypeptide from the host cell such as by altering the promoter of the polypeptide to increase its expression to a level above its normal expression level in the host cell in the absence of the altered promoter. A polypeptide that is chemically synthesized or synthesized in a cellular system different from a cell from which it naturally originates will be "isolated" from its naturally associated components. A polypeptide may also be rendered substantially free of naturally associated components by isolation, using protein purification techniques well known in the art. As thus defined, "isolated" does not necessarily require that the protein, polypeptide, peptide or oligopeptide so described has been physically removed from a cell in which it was synthesized.

The term "polypeptide fragment" or "protein fragment" as used herein refers to a polypeptide or domain thereof that has less amino acids compared to a reference polypeptide, e.g., a full-length polypeptide or a polypeptide domain of a naturally occurring protein. A "naturally occurring protein" or "naturally occurring polypeptide" includes a polypeptide having an amino acid sequence produced by a non-recombinant cell or organism. In an embodiment, the polypeptide fragment is a contiguous sequence in which the amino acid sequence of the fragment is identical to the corresponding positions in the naturally-occurring sequence. Fragments typically are at least 5, 6, 7, 8, 9 or 10 amino acids long, or at least 12, 14, 16 or 18 amino acids long, or at least 20 amino acids long, or at least 25, 30, 35, 40 or 45, amino acids, or at least 50, 60, 70, 80, 90 or 100 amino acids long, or at least 110, 120, 130, 140, 150, 160, 170, 180, 190 or 200 amino acids long, or 225, 250, 275, 300, 325, 350, 375, 400, 425, 450, 475, 500, 525, 550, 575, 600 or greater than 600 amino acids long. A fragment can be a portion of a larger polypeptide sequence that is digested inside or outside the cell. Thus, a polypeptide that is 50 amino acids in length can be produced intracellularly, but proteolyzed inside or outside the cell to produce a polypeptide less than 50 amino acids in length. This is of particular significance for polypeptides shorter than about 25 amino acids, which can be more difficult than larger polypeptides to produce recombinantly or to purify once produced recombinantly. The term "peptide" as used herein refers to a short polypeptide or oligopeptide, e.g., one that typically contains less than about 50 amino acids and more typically less than about 30 amino acids, or more typically less than about 15 amino acids, such as less than about 10, 9, 8, 7, 6, 5, 4, or 3 amino acids. The term as used herein encompasses analogs and mimetics that mimic structural and thus biological function.

As used herein, "polypeptide mutant" or "mutein" refers to a polypeptide whose sequence contains an insertion, duplication, deletion, rearrangement or substitution of one or more amino acids compared to the amino acid sequence of a reference protein or polypeptide, such as a native or wild-type protein. A mutein may have one or more amino acid point substitutions, in which a single amino acid at a position has been changed to another amino acid, one or more insertions and/or deletions, in which one or more amino acids are inserted or deleted, respectively, in the sequence of the reference protein, and/or truncations of the amino acid sequence at either or both the amino or carboxy termini. A mutein may have the same or a different biological activity compared to the reference protein. In some embodiments, a mutein has, for example, at least 85% overall sequence homology to its counterpart reference protein. In some embodiments, a mutein has at least 90% overall sequence homology to the wild-type protein. In other embodiments, a mutein exhibits at least 95% sequence identity, or 98%, or 99%, or 99.5% or 99.9% overall sequence identity.

As used herein, a "polypeptide tag for affinity purification" is any polypeptide that has a binding partner that can be used to isolate or purify a second protein or polypeptide sequence of interest fused to the first "tag" polypeptide. Several examples are well known in the art and include a His-6 tag, a FLAG epitope, a c-myc epitope, a Strep-TAGII, a biotin tag, a glutathione 5-transferase (GST), a chitin binding protein (CBP), a maltose binding protein (MBP), or a metal affinity tag.

As used herein, "protein-energy malnutrition" refers to a form of malnutrition where there is inadequate protein intake. Types include Kwashiorkor (protein malnutrition predominant), Marasmus (deficiency in both calorie and protein nutrition), and Marasmic Kwashiorkor (marked protein deficiency and marked calorie insufficiency signs present, sometimes referred to as the most severe form of malnutrition). "Malnourishment" and "malnutrition" are used equivalently herein.

The terms "purify," "purifying" and "purified" refer to a substance (or entity, composition, product or material) that has been separated from at least some of the components with which it was associated either when initially produced (whether in nature or in an experimental setting), or during any time after its initial production. A substance such as a nutritional polypeptide will be considered purified if it is isolated at production, or at any level or stage up to and including a final product, but a final product may contain other materials up to about 10%, about 20%, about 30%, about 40%, about 50%, about 60%, about 70%, about 80%, about 90%, or above 90% and still be considered "isolated." Purified substances or entities can be separated from at least about 10%, about 20%, about 30%, about 40%, about 50%, about 60%, about 70%, about 80%, about 90%, or more of the other components with which they were initially associated. In some embodiments, purified substances are more than about 80%, about 85%, about 90%, about 91%, about 92%, about 93%, about 94%, about 95%, about 96%, about 97%, about 98%, about 99%, or more than about 99% pure. In the instance of polypeptides and other polypeptides provided herein, such a polypeptide can be purified from one or more other polypeptides capable of being secreted from the unicellular organism that secretes the polypeptide. As used herein, a polypeptide substance is "pure" if it is substantially free of other components or other polypeptide components.

As used herein, "recombinant" refers to a biomolecule, e.g., a gene or polypeptide, that (1) has been removed from its naturally occurring environment, (2) is not associated with all or a portion of a polynucleotide in which the gene is found in nature, (3) is operatively linked to a polynucleotide which it is not linked to in nature, or (4) does not occur in nature. Also, "recombinant" refers to a cell or an organism, such as a unicellular organism, herein termed a "recombinant unicellular organism," a "recombinant host" or a "recombinant cell" that contains, produces and/or secretes a biomolecule, which can be a recombinant biomolecule or a non-recombinant biomolecule. For example, a recombinant unicellular organism may contain a recombinant nucleic acid providing for enhanced production and/or secretion of a recombinant polypeptide or a non-recombinant polypeptide. A recombinant cell or organism, is also intended to refer to a cell into which a recombinant nucleic acid such as a recombinant vector has been introduced. A "recombinant unicellular organism" includes a recombinant microorganism host cell and refers not only to the particular subject cell but to the progeny of such a cell. Because certain modifications may occur in succeeding generations due to either mutation or environmental influences, such progeny may not, in fact, be identical to the parent cell, but are still included within the scope of the terms herein. The term "recombinant" can be used in reference to cloned DNA isolates, chemically-synthesized polynucleotide analogs, or polynucleotide analogs that are biologically synthesized by heterologous systems, as well as polypeptides and/or mRNAs encoded by such nucleic acids. Thus, for example, a polypeptide synthesized by a microorganism is recombinant, for example, if it is produced from an mRNA transcribed from a recombinant gene or other nucleic acid sequence present in the cell.

As used herein, an endogenous nucleic acid sequence in the genome of an organism (or the encoded polypeptide product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous (originating from the same host cell or progeny thereof) or exogenous (originating from a different host cell or progeny thereof). By way of example, a promoter sequence can be substituted (e.g., by homologous recombination) for the native promoter of a gene in the genome of a host cell, such that this gene has an altered expression pattern. This gene would now become "recombinant" because it is separated from at least some of the sequences that naturally flank it. A nucleic acid is also considered "recombinant" if it contains any modifications that do not naturally occur to the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

The term "recombinant host cell" (or simply "recombinant cell" or "host cell"), as used herein, is intended to refer to a cell into which a recombinant nucleic acid such as a recombinant vector has been introduced. In some instances the word "cell" is replaced by a name specifying a type of cell. For example, a "recombinant microorganism" is a recombinant host cell that is a microorganism host cell and a "recombinant cyanobacteria" is a recombinant host cell that is a cyanobacteria host cell. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "recombinant host cell," "recombinant cell," and "host cell", as used herein. A recombinant host cell can be an isolated cell or cell line grown in culture or can be a cell which resides in a living tissue or organism.

As used herein, "sarcopenia" refers to the degenerative loss of skeletal muscle mass (typically 0.5-1% loss per year after the age of 25), quality, and strength associated with aging. Sarcopenia is a component of the frailty syndrome. The European Working Group on Sarcopenia in Older People (EWGSOP) has developed a practical clinical definition and consensus diagnostic criteria for age-related sarcopenia. For the diagnosis of sarcopenia, the working group has proposed using the presence of both low muscle mass and low muscle function (strength or performance). Sarcopenia is characterized first by a muscle atrophy (a decrease in the size of the muscle), along with a reduction in muscle tissue "quality," caused by such factors as replacement of muscle fibres with fat, an increase in fibrosis, changes in muscle metabolism, oxidative stress, and degeneration of the neuromuscular junction. Combined, these changes lead to progressive loss of muscle function and eventually to frailty. Frailty is a common geriatric syndrome that embodies an elevated risk of catastrophic declines in health and function among older adults. Contributors to frailty can include sarcopenia, osteoporosis, and muscle weakness. Muscle weakness, also known as muscle fatigue, (or "lack of strength") refers to the inability to exert force with one's skeletal muscles. Weakness often follows muscle atrophy and a decrease in activity, such as after a long bout of bedrest as a result of an illness. There is also a gradual onset of muscle weakness as a result of sarcopenia. Thus, sarcopenia is an exemplary condition associated with muscle wasting.

As used herein, "satiation" is the act of becoming full while eating or a reduced desire to eat. This halts or diminishes eating.

As used herein, "satiety" is the act of remaining full after a meal which manifests as the period of no eating follow the meal.

As used herein, "secrete," "secretion" and "secreted" all refer to the act or process by which a polypeptide is relocated from the cytoplasm of a cell of a multicellular organism or unicellular organism into the extracellular milieu thereof. As provided herein, such secretion may occur actively or passively. Further, the terms "excrete," "excretion" and "excreted" generally connote passive clearing of a material from a cell or unicellular organism; however, as appropriate such terms can be associated with the production and transfer of materials outwards from the cell or unicellular organism.

In general, "stringent hybridization" is performed at about 25° C. below the thermal melting point (Tm) for the specific DNA hybrid under a particular set of conditions. "Stringent washing" is performed at temperatures about 5° C. lower than the Tm for the specific DNA hybrid under a particular set of conditions. The Tm is the temperature at which 50% of the target sequence hybridizes to a perfectly matched probe. See Sambrook et al., Molecular Cloning: A Laboratory Manual, 2d ed., Cold Spring Harbor Laboratory Press, Cold Spring Harbor, N.Y. (1989), page 9.51, hereby incorporated by reference. For purposes herein, "stringent conditions" are defined for solution phase hybridization as aqueous hybridization (i.e., free of formamide) in 6×SSC (where 20×SSC contains 3.0 M NaCl and 0.3 M sodium citrate), 1% SDS at 65° C. for 8-12 hours, followed by two washes in 0.2×SSC, 0.1% SDS at 65° C. for 20 minutes. It will be appreciated by the skilled worker that hybridization at 65° C. will occur at different rates depending on a number of factors including the length and percent identity of the sequences which are hybridizing.

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the nucleotide bases, as measured by any well-known algorithm of sequence identity, such as FASTA, BLAST or Gap, as discussed above.

The term "sufficient amount" means an amount sufficient to produce a desired effect, e.g., an amount sufficient to modulate protein aggregation in a cell.

A "synthetic" RNA, DNA or a mixed polymer is one created outside of a cell, for example one synthesized chemically.

The term "therapeutically effective amount" is an amount that is effective to ameliorate a symptom of a disease. A therapeutically effective amount can be a "prophylactically effective amount" as prophylaxis can be considered therapy.

As used herein, "thermogenesis" is the process of heat production in a mammal. Thermogenesis is accompanied by an increase in energy expenditure. Thermogenesis is specifically the energy burned following the metabolism of a food component (such as protein). This may also be referred to as the thermic effect of food. Total energy expenditure by an individual equals the sum of resting energy expenditure (energy consumed at restrin a fasting state to support basal metabolism), the thermic effect of food, and energy expenditure related to physical activity. Resting energy expenditure accounts for about 65-75% of total energy expenditure in humans. The amount and activity of muscle mass is one influencer of resting energy expenditure. Adequate protein consumption to support muscle also influences resting energy expenditure. The ingestion of protein tends to increase energy expenditure following a meal; this is the thermic effect of food. The thermic effect of food accounts for about 10% of total energy expenditure in humans. While this is a small proportion of total energy expenditure, small increases in this value can impact body weight. Protein has a higher thermic effect than fat or carbohydrate; this effect along with other metabolic influences of protein makes it a useful substrate for weight control, diabetes management and other conditions.

As used herein, a "vector" is intended to refer to a nucleic acid molecule capable of transporting another nucleic acid to which it has been linked. One type of vector is a "plasmid," which generally refers to a circular double stranded DNA loop into which additional DNA segments can be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments can be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

Nutritive Polypeptides and Amino Acid Sequences

Proteins present in dietary food sources can vary greatly in their nutritive value. Provided are nutritive polypeptides that have enhanced nutritive value and physiological and pharmacological effects due to their amino acid content and digestibility. Provided are nutritive polypeptides that have enhanced levels of essential amino acids, the inadequate availability of such essential amino acids in a person negatively impacts general health and physiology through the perturbation of a network of cellular functions, and is associated with a wide array of health issues and diseases. Also provided are nutritive polypeptides that have reduced levels of certain amino acids, the presence or overabundance of such amino acids in the diet of an affected subject results in increased morbidity and mortality.

Traditionally, nutritionists and health researchers have utilized specific source ingredients (e.g., whey protein, egg whites, soya) or fractionates and isolates (e.g., soy protein isolates) to modulate the relative concentration of total protein in the diet, without the ability to modulate the specific amino acid constituents.

Herein provided are nutritive polypeptides capable of transforming health and treating, preventing and reducing the severity of a multitude of diseases, disorders and conditions associated with amino acid pathophysiology, as they are selected for specific physiologic benefits to improve health and address many nutrition-related conditions, including gastrointestinal malabsorption, muscle wasting, diabetes or pre-diabetes, obesity, oncology, metabolic diseases, and other cellular and systemic diseases. Also provided are the compositions and formulations that contain the nutritive polypeptides, as food, beverages, medical foods, supplements, and pharmaceuticals.

Herein are provided important elucidations in the genomics, proteomics, protein characterization and production of nutritive polypeptides. The present invention utilizes the synergistic advancements, described herein, of (a) the genomics of edible species—those human food source organisms, and human genomics, (b) substantial advances in protein identification and quantification in food protein and food nucleic acid libraries, (c) new correlations between protein physical chemistry, solubility, structure-digestibility relationships and amino acid absorption and metabolism in animals and humans, (d) physiology and pathophysiology information of how amino acids, the components of nutritive polypeptides, affect protein malnutrition, chronic disease, responses to acute injury, and aging, (e) recombinant nutritive polypeptide production utilizing a phylogenetically broad spectrum of host organisms, (f) qualification of allergenicity and toxicogenicity and in vitro and in vivo tests to assess human safety of orally consumed nutritive polypeptides.

Identification and Selection of Amino Acid Sequences Encoding Nutritive Polypeptides.

In its broadest sense, a nutritive polypeptide encompasses a polypeptide capable of delivering amino acid and peptide nutrition to its intended consumer, who derives a benefit from such consumption. Each nutritive polypeptide contains one or more amino acid sequences, and the present invention provides methods by which an amino acid sequence is identified and utilized in production, formulation and administration of the nutritive polypeptide having such an amino acid sequence.

In some embodiments, the source of a nutritive polypeptide amino acid sequence encompasses any protein-containing material, e.g., a food, beverage, composition or other product, known to be eaten, or otherwise considered suitable for consumption, without deleterious effect by, e.g., a human or other organism, in particular a mammal.

Nutritive Polypeptide Amino Acid Sequences Derived from Edible Species.

In some embodiments a nutritive polypeptide comprises or consists of a protein or fragment of a protein that naturally occurs in an edible product, such as a food, or in the organism that generates biological material used in or as the food. In some embodiments an "edible species" is a species known to produce a protein that can be eaten by humans without deleterious effect. A protein or polypeptide present in an edible species, or encoded by a nucleic acid present in the edible species, is termed an "edible species protein" or "edible species polypeptide" or, if the edible species is a species consumed by a human, the term "naturally occurring human food protein" is used interchangeably herein. Some edible products are an infrequent but known component of the diet of only a small group of a type of mammal in a limited geographic location while others are a dietary staple throughout much of the world. In other embodiments an edible product is one not known to be previously eaten by any mammal, but that is demonstrated to be edible upon testing or analysis of the product or one or more proteins contained in the product.

Food organisms include but are not limited to those organisms of edible species disclosed in PCT/US2013/032232, filed Mar. 15, 2013, PCT/US2013/032180, filed Mar. 15, 2013, PCT/US2013/032225, filed Mar. 15, 2013, PCT/US2013/032218, filed Mar. 15, 2013, PCT/US2013/032212, filed Mar. 15, 2013, PCT/US2013/032206, filed Mar. 15, 2013, and PCT/US2013/038682, filed Apr. 29, 2013 and any phylogenetically related organisms.

In some embodiments a nutritive polypeptide amino acid sequence is identified in a protein that is present in a food source, such as an abundant protein in food, or is a derivative or mutein thereof, or is a fragment of an amino acid sequence of a protein in food or a derivative or mutein thereof. An abundant protein is a protein that is present in a higher concentration in a food relative to other proteins present in the food. Alternatively, a nutritive polypeptide amino acid sequence is identified from an edible species that produces a protein containing the amino acid sequence in relatively lower abundance, but the protein is detectable in a food product derived from the edible species, or from biological material produced by the edible species. In some embodiments a nucleic acid that encodes the protein is detectable in a food product derived from the edible species, or the nucleic acid is detectable from a biological material produced by the edible species. An edible species can produce a food that is a known component of the diet of only a small group of a type of mammal in a limited geographic location, or a dietary staple throughout much of the world.

Exemplary edible species include animals such as goats, cows, chickens, pigs and fish. In some embodiments the abundant protein in food is selected from chicken egg proteins such as ovalbumin, ovotransferrin, and ovomucuoid; meat proteins such as myosin, actin, tropomyosin, collagen, and troponin; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1,6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Nutritive polypeptides may contain amino acid sequences present in edible species polypeptides. In one embodiment, a biological material from an edible species is analyzed to determine the protein content in the biological material. An exemplary method of analysis is to use mass spectrometry analysis of the biological material, as provided in the Examples below. Another exemplary method of analysis is to generate a cDNA library of the biological material to create a library of edible species cDNAs, and then express the cDNA library in an appropriate recombinant expression host, as provided in the Examples below. Another exemplary method of analysis is query a nucleic acid and/or protein sequence database as provided in the Examples below.

Determination of Amino Acid Ratios and Amino Acid Density in a Nutritive Polypeptide.

In some instances herein the portion of amino acid(s) of a particular type within a polypeptide, protein or a composition is quantified based on the weight ratio of the type of amino acid(s) to the total weight of amino acids present in the polypeptide, protein or composition in question. This value is calculated by dividing the weight of the particular amino acid(s) in the polypeptide, protein or a composition by the weight of all amino acids present in the polypeptide, protein or a composition.

In other instances the ratio of a particular type of amino acid(s) residues present in a polypeptide or protein to the total number of amino acids present in the polypeptide or protein in question is used. This value is calculated by dividing the number of the amino acid(s) in question that is present in each molecule of the polypeptide or protein by the total number of amino acid residues present in each molecule of the polypeptide or protein. A skilled artisan appreciates that these two methods are interchangeable and that the weight proportion of a type of amino acid(s) present in a polypeptide or protein can be converted to a ratio of the particular type of amino acid residue(s), and vice versa.

In some aspects the nutritive polypeptide is selected to have a desired density of one or more essential amino acids (EAA). Essential amino acid deficiency can be treated or, prevented with the effective administration of the one or more essential amino acids otherwise absent or present in insufficient amounts in a subject's diet. For example, EAA density is about equal to or greater than the density of essential amino acids present in a full-length reference nutritional polypeptide, such as bovine lactoglobulin, bovine beta-casein or bovine type I collagen, e.g., EAA density in a nutritive polypeptide is at least about 5%, 10%, 15%, 20%, 25%, 30%, 35%, 40%, 45%, 50%, 55%, 60%, 65%, 70%, 75%, 80%, 85%, 90%, 95%, 100%, 200%, 300%, 400%, 500% or above 500% greater than a reference nutritional polypeptide or the polypeptide present in an agriculturally-derived food product.

In some aspects the nutritive polypeptide is selected to have a desired density of aromatic amino acids ("AAA", including phenylalanine, tryptophan, tyrosine, histidine, and thyroxine). AAAs are useful, e.g., in neurological development and prevention of exercise-induced fatigue. For example, AAA density is about equal to or greater than the density of essential amino acids present in a full-length reference nutritional polypeptide, such as bovine lactoglobulin, bovine beta-casein or bovine type I collagen, e.g., AAA density in a nutritive polypeptide is at least about 5%, 10%, 15%, 20%, 25%, 30%, 35%, 40%, 45%, 50%, 55%, 60%, 65%, 70%, 75%, 80%, 85%, 90%, 95%, 100%, 200%, 300%, 400%, 500% or above 500% greater than a reference nutritional polypeptide or the polypeptide present in an agriculturally-derived food product.

In some aspects the nutritive polypeptide is selected to have a desired density of branched chain amino acids (BCAA). For example, BCAA density, either individual BCAAs or total BCAA content is about equal to or greater than the density of branched chain amino acids present in a full-length reference nutritional polypeptide, such as bovine lactoglobulin, bovine beta-casein or bovine type I collagen, e.g., BCAA density in a nutritive polypeptide is at least about 5%, 10%, 15%, 20%, 25%, 30%, 35%, 40%, 45%, 50%, 55%, 60%, 65%, 70%, 75%, 80%, 85%, 90%, 95%, 100%, 200%, 300%, 400%, 500% or above 500% greater than a reference nutritional polypeptide or the polypeptide present in an agriculturally-derived food product. BCAA density in a nutritive polypeptide can also be selected for in combination with one or more attributes such as EAA density.

In some aspects the nutritive polypeptide is selected to have a desired density of amino acids arginine, glutamine and/or leucine (RQL amino acids). For example, RQL amino acid density is about equal to or greater than the density of essential amino acids present in a full-length reference nutritional polypeptide, such as bovine lactoglobulin, bovine beta-casein or bovine type I collagen, e.g., RQL amino acid density in a nutritive polypeptide is at least about 5%, 10%, 15%, 20%, 25%, 30%, 35%, 40%, 45%, 50%, 55%, 60%, 65%, 70%, 75%, 80%, 85%, 90%, 95%, 100%, 200%, 300%, 400%, 500% or above 500% greater than a reference nutritional polypeptide or the polypeptide present in an agriculturally-derived food product.

In some aspects the nutritive polypeptide is selected to have a desired density or distribution of post-translational modifications (PTMs). For example, PTMs include addition, removal or redistribution of biotinylation, pegylation, acylation, alkylation, butyrylation, glycosylation, hydroxylation, iodination, oxidation, propionylation, malonylation, myristoylation, palmitoylation, isoprenylation, succinylation, selenoylation, SUMOylation, ubiquitination, and glypiation removal or redistribution of disulfide bridges.

In certain embodiments herein the weight proportion of branched chain amino acids, leucine, and/or essential amino acids in whey, egg, or soy is used as a benchmark to measure the amino acid composition of a polypeptide, a protein, or a composition comprising at least one of a polypeptide and a protein. In those embodiments it is understood that the two measures are not completely equivalent, but it is also understood that the measures result in measurements that are similar enough to use for this purpose. For example, when a protein of interest is characterized as comprising a ratio of branched chain amino acid residues to total amino acid residues that is equal to or greater than 24% (the weight proportion of branched chain amino acid residues present in whey), that is a precise description of the branched chain amino acid content of the protein. At the same time, the weight proportion of branched chain amino acid residues present in that protein is not necessarily exactly equal to 24%. Even so, the skilled artisan understands that this is a useful comparison. If provided with the total number of amino acid residues present in the protein of interest the skilled artisan can also determine the weight proportion of branched chain amino acid residues in the protein of interest.

In some embodiments a protein according to this disclosure comprises a first polypeptide sequence comprising a fragment of an edible species polypeptide. In some embodiments of the nutritrive protein, the protein consists of the first polypeptide sequence. In some embodiments of the nutritrive protein, the protein consists of the fragment of an edible species polypeptide.

In some embodiments a protein according to this disclosure comprises a first polypeptide sequence that comprises ratio of branched chain amino acid residues to total amino acid residues that is equal to or greater than the ratio of branched chain amino acid residues to total amino acid residues present in at least one of whey protein, egg protein, and soy protein. Thus, in such embodiments the protein comprises a first polypeptide sequence that comprises a ratio of branched chain amino acid residues to total amino acid residues that is equal to or greater than a ratio selected from 24%, 20%, and 18%. In other embodiments, the protein comprises a first polypeptide sequence that comprises a ratio of branched chain amino acid residues to total amino acid residues that is equal to or greater than a percentage ratio selected from 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 75, 80, 85, 90, 95, or 100%.

In some embodiments a protein according to this disclosure comprises a first polypeptide sequence that comprises a ratio of L (leucine) residues to total amino acid residues that is equal to or greater than the ratio of L residues to total amino acid residues present in at least one of whey protein, egg protein, and soy protein. In other embodiments, the protein comprises a first polypeptide sequence that comprises a ratio of leucine residues to total amino acid residues that is equal to or greater than a percentage ratio selected from 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or greater than 30%.

In some embodiments a protein according to this disclosure comprises a first polypeptide sequence that comprises a ratio of essential amino acid residues to total amino acid residues that is equal to or greater than the ratio of essential amino acid residues to total amino acid residues present in at least one of whey protein, egg protein, and soy protein. In other embodiments, the protein comprises a first polypeptide sequence that comprises a ratio of essential chain amino acid residues to total amino acid residues that is equal to or greater than a percentage ratio selected from 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 75, 80, 85, 90, 95, or 100%.

In some embodiments the protein comprises a first polypeptide sequence that comprises a ratio of branched chain amino acid residues to total amino acid residues that is equal to or greater than the ratio of branched chain amino acid residues to total amino acid residues present in at least one of whey protein, egg protein, and soy protein; and/or comprises a first polypeptide sequence that comprises a ratio of L (leucine) residues to total amino acid residues that is equal to or greater than the ratio of L residues to total amino acid residues present in at least one of whey protein, egg protein, and soy protein, and/or comprises a first polypeptide sequence that comprises a ratio of essential amino acid residues to total amino acid residues that is equal to or greater than the ratio of essential amino acid residues to total amino acid residues present in at least one of whey protein, egg protein, and soy protein.

In some embodiments the protein comprises a first polypeptide sequence that comprises a ratio of branched chain amino acid residues to total amino acid residues that is equal to or greater than the ratio of branched chain amino acid residues to total amino acid residues present in at least one of whey protein, egg protein, and soy protein; and comprises a first polypeptide sequence that comprises a ratio of essential amino acid residues to total amino acid residues that is equal to or greater than the ratio of essential amino acid residues to total amino acid residues present in at least one of whey protein, egg protein, and soy protein. In some embodiments the protein comprises a first polypeptide sequence that comprises a ratio of branched chain amino acid residues to total amino acid residues equal to or greater than 24% and a ratio of essential amino acid residues to total amino acid residues that is equal to or greater than 49%. In some embodiments the protein comprises a first polypeptide sequence that comprises a ratio of branched chain amino acid residues to total amino acid residues equal to or greater than 20% and a ratio of essential amino acid residues to total amino acid residues that is equal to or greater than 51%. In some embodiments the protein comprises a first polypeptide sequence that comprises a ratio of branched chain amino acid residues to total amino acid residues equal to or greater than 18% and a ratio of essential amino acid residues to total amino acid residues that is equal to or greater than 40%.

In some embodiments the protein comprises a first polypeptide sequence that comprises a ratio of L (leucine) residues to total amino acid residues that is equal to or greater than the ratio of L residues to total amino acid residues present in at least one of whey protein, egg protein, and soy protein; and comprises a first polypeptide sequence that comprises a ratio of essential amino acid residues to total amino acid residues that is equal to or greater than the ratio of essential amino acid residues to total amino acid residues present in at least one of whey protein, egg protein, and soy protein. In some embodiments the protein comprises a first polypeptide sequence that comprises a ratio of L (leucine) residues to total amino acid residues equal to or greater than 11% and a ratio of essential amino acid residues to total amino acid residues that is equal to or greater than 49%. In some embodiments the protein comprises a first polypeptide sequence that comprises a ratio of L (leucine) amino acid residues to total amino acid residues equal to or greater than 9% and a ratio of essential amino acid residues to total amino acid residues that is equal to or greater than 51%. In some embodiments the protein comprises a first polypeptide sequence that comprises a ratio of L (leucine) amino acid residues to total amino acid residues equal to or greater than 8% and a ratio of essential amino acid residues to total amino acid residues that is equal to or greater than 40%. In some embodiments of the protein, the first polypeptide sequence comprises a first polypeptide sequence comprising a ratio of branched chain amino acid residues to total amino acid residues equal to or greater than 24%, a ratio of L (leucine) residues to total amino acid residues that is equal to or greater than 11%, and comprises at least one of every essential amino acid. In some embodiments of the protein, the first polypeptide sequence comprises a first polypeptide sequence comprising a ratio of branched chain amino acid residues to total amino acid residues equal to or greater than 24% and a ratio of essential amino acid residues to total amino acid residues equal to or greater than 49%.

Provided are nutritive polypeptides that are nutritionally complete. In some embodiments of the protein, the first polypeptide sequence comprises a first polypeptide sequence that contains at least one of every essential amino acid.

Nutritive Glycoproteins and Nutritive Polypeptides with Modulated Glycosylation.

The term "glycan" or "glycoyl" refers to a polysaccharide or oligosaccharide which may be linked to a polypeptide, lipid, or proteoglycan. In some embodiments, a glycan is linked covalently or non-covalently to the polypeptide. In some embodiments the linkage occurs via a glycosidic bond. In some embodiments, the linkage is directly between the glycan (or glycoyl) and polypeptide or via an intermediary molecule. In some embodiments, the glycosidic bond is N-linked or O-linked. The term "polysaccharide" or "oligosaccharide" refers to one or more monosaccharide units joined together by glycosidic bonds. In some embodiments, the polysaccharide or oligosaccharide has a linear or branched structure. In some embodiments, the monosaccharide units comprise N-acetyl galactosamine, N-acetylglucosamine, galactose, neuraminic acid, fructose, mannose, fucose, glucose, xylose, N-acetylneuraminic acid, N-glycolylneuraminic acid, O-lactyl-N-acetylneuraminic acid, O-acetyl-N-acetylneuraminic acid, or O-methyl-N-acetylneuraminic acid. In some embodiments, the monosaccharide is modified by a phosphate, sulfate, or acetate group. The term "glycosylation acceptor site" refers to an amino acid along a polypeptide which carries a glycan or glycoyl in the native composition. In some embodiments the acceptor site consists of a nucleophilic acceptor of a glycosidic bond. In some embodiments, the nucleophilic acceptor site consists of an amino group. In some embodiments the amino acid consists of an asparagine, arginine, serine, threonine, hydroxyproline, hydroxylysine, tryptophan, phosphothreonine, serine, or phosphoserine. The term "exogenous glycosylation acceptor site" refers to a glycosylation acceptor site not present in the native composition of the polypeptide. In some embodiments the amino acid for the exogenous glycosylation acceptor site did not carry a glycan or glycoyl in the native composition. In some embodiments, the amino acid does not occur in the primary sequence of the polypeptide in the native composition. The term "exogenous glycan" or "exogenous glycoyl" refers to a glycan or glycoyl that occupies a glycosylation acceptor site, which was not present in the native composition on the same glycosylation acceptor site. In some embodiments, the glycosylation acceptor site is an exogenous glycosylation site or a native glycosylation site. The term "glycoprotein" refers to a polypeptide that is bound to at least one glycan or glycoyl.

Disclosed herein are formulations containing isolated nutritive polypeptides at least one exogenous glycosylation acceptor site present on an amino acid of the nutritive polypeptide. In some aspects, the at least one exogenous glycosylation acceptor site is occupied by an exogenous glycoyl or glycan, or alternatively, is unoccupied or is occupied by a non-natively occupying glycol or glycan. In some embodiments, the nutritive polypeptide is a polypeptide having an amino acid sequence at least 90% identical to SEQID 00001-03909 and SEQID 04129-44483, or is an edible species polypeptide sequence or fragment thereof at least 50 amino acids in length, or is a polypeptide having substantial immunogenicity when the glycosylation acceptor site is not present or is unoccupied. The nutritive polypeptide is more thermostable, is more digestible, and/or has a lower aggregation score than a reference polypeptide that has an amino acid sequence identical to the nutritive polypeptide but the glycosylation acceptor site is not present or is unoccupied in the reference polypeptide. The amino acids, e.g., asparagine, arginine, serine, threonine, hydroxyproline, and hydroxylysine, containing an exogenous glycosylation acceptor site are resistant to proteolysis. Exemplary glycans are N-acetyl galactosamine, N-acetylglucosamine, galactose, neuraminic acid, fructose, mannose, fucose, glucose, xylose, N-acetylneuraminic acid, N-glycolylneuraminic acid, O-lactyl-N-acetylneuraminic acid, O-acetyl-N-acetylneuraminic acid, and O-methyl-N-acetylneuraminic acid.

In some embodiments provided are formulations containing a nutritive polypeptide that is identical to the amino acid sequence of a polypeptide in a reference edible species glycoprotein, but the carbohydrate component of the nutritive polypeptide differs from a carbohydrate component of the reference edible species glycoprotein. The nutritive polypeptide is produced, for example, by expressing the polypeptide of the reference glycoprotein in a non-native host such as Aspergillus, Bacillus, Saccharomyces or a mammalian cell. Also provided are variant nutritive polypeptides, where the amino acid sequence differs from the amino acid sequence of a polypeptide in a reference glycoprotein by <1%, <5%, <10%, or more than 10%, and the mass of the carbohydrate component of the nutritive polypeptide is different from the mass of the carbohydrate component of the reference glycoprotein. The nutritive polypeptide variant is created by the insertion, deletion, substitution, or replacement of amino acid residues in the amino acid sequence of the polypeptide of the reference glycoprotein. Preferably, the nutritive polypeptide has distinguishable chemical, biochemical, biophysical, biological, or immunological properties from the reference glycoprotein. For example, the nutritive polypeptide is more hygroscopic, hydrophilic, or soluble in aqueous solutions than the reference glycoprotein. Alternatively, the nutritive polypeptide is less hygroscopic, hydrophilic, or soluble in aqueous solutions than the reference glycoprotein.

In another example, the nutritive polypeptide is more antigenic, immunogenic, or allergenic than the reference glycoprotein, or alternatively, the nutritive polypeptide is less antigenic, immunogenic, or allergenic than the reference glycoprotein. The nutritive polypeptide is more stable or resistant to enzymatic degradation than the reference glycoprotein or the nutritive polypeptide is more unstable or susceptible to enzymatic degradation than the reference glycoprotein. The carbohydrate component of the nutritive polypeptide is substantially free of N-glycolylneuraminic acid or has reduced N-glycolylneuraminic acid in comparison to the reference glycoprotein. Alternatively, the carbohydrate component of the nutritive polypeptide has elevated N-glycolylneuraminic acid in comparison to the reference glycoprotein.

Also provided is a nutritive polypeptide that has at least one exogenous glycosylation acceptor site present on an amino acid of the nutritive polypeptide, and the at least one exogenous glycosylation acceptor site is occupied by an exogenous glycoyl or glycan, and the nutritive polypeptide includes a polypeptide having an amino acid sequence at least 90% identical to SEQID 00001-03909 and SEQID 04129-44483, where the nutritive polypeptide is present in at least 0.5 g at a concentration of at least 10% on a mass basis, and where the formulation is substantially free of non-comestible products Reference Nutritional Polypeptides and Reference Nutritional Polypeptide Mixtures.

Three natural sources of protein generally regarded as good sources of high quality amino acids are whey protein, egg protein, and soy protein. Each source comprises multiple proteins. Table RNP1 presents the weight proportional representation of each amino acid in the protein source (g AA/g protein) expressed as a percentage.

TABLE RNP1

| Amino Acid | Whey | Egg | Soy |
|---|---|---|---|
| Isoleucine | 6.5% | 5.5% | 5.0% |
| Leucine | 11.0% | 8.6% | 8.0% |
| Lysine | 9.1% | 7.2% | 6.3% |
| Methionine | 2.1% | 3.1% | 1.3% |
| Phenylalanine | 3.4% | 5.3% | 1.2% |
| Threonine | 7.0% | 4.8% | 3.7% |
| Tryptophan | 1.7% | 1.2% | 1.3% |
| Valine | 6.2% | 6.1% | 4.9% |
| Histidine | 2.0% | 2.4% | 2.7% |
| Other | 51.7% | 49.5% | 60.4% |

Table RNP2 presents the weight proportion of each protein source that is essential amino acids, branched chain amino acids (L, I, and V), and leucine (L) (alone).

TABLE RNP2

| Protein Source | Essential Amino Acids | Branched Chain Amino Acids | Leucine |
|---|---|---|---|
| Whey | 49.0% | 23.7% | 11.0% |
| Egg | 50.5% | 20.1% | 8.6% |
| Soy | 39.6% | 17.9% | 8.0% |

The sources relied on to determine the amino acid content of Whey are: Belitz H. D., Grosch W., and Schieberle P. Food Chemistry (4th Ed). Springer-Verlag, Berlin Heidelberg 2009; gnc.com/product/index.jsp?productId=2986027; nutrabio.com/Products/whey_protein_concentrate.htm; and nutrabio.com/Products/whey_protein_isolate.htm. The amino acid content values from those sources were averaged to give the numbers presented in Tables RNP1 and RNP2. The source for soy protein is Egg, National Nutrient Database for Standard Reference, Release 24 (ndb.nal.usda.gov/ndb/foods/list). The source for soy protein is Self Nutrition Data (nutritiondata.self.com/facts/legumes-and-legume-products/4389/2).

According to the USDA nutritional database whey can include various non-protein components: water, lipids (such as fatty acids and cholesterol), carbohydrates and sugars, minerals (such as Ca, Fe, Mg, P, K, Na, and Zn), and vitamins (such as vitamin C, thiamin, riboflavin, niacin, vitamin B-6, folate, vitamin B-12, and vitamin A). According to the USDA nutritional database egg white can include various non-protein components: water; lipids, carbohydrates, minerals (such as Ca, Fe, Mg, P, K, Na, and Zn), and vitamins (such as thiamin, riboflavin, niacin, vitamin B-6, folate, and vitamin B-12). According to the USDA nutritional database soy can include various non-protein components: water, lipids (such as fatty acids), carbohydrates, minerals (such as Ca, Fe, Mg, P, K, Na, and Zn), and vitamins (such as thiamin, riboflavin, niacin, vitamin B-6, folate).

Engineered Nutritive Polypeptides.

In some embodiments a protein comprises or consists of a derivative or mutein of a protein or fragment of an edible species protein or a protein that naturally occurs in a food product. Such a protein can be referred to as an "engineered protein." In such embodiments the natural protein or fragment thereof is a "reference" protein or polypeptide and the engineered protein or a first polypeptide sequence thereof comprises at least one sequence modification relative to the amino acid sequence of the reference protein or polypeptide. For example, in some embodiments the engineered protein or first polypeptide sequence thereof is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% identical to at least one reference protein amino acid sequence. Typically the ratio of at least one of branched chain amino acid residues to total amino acid residues, essential amino acid residues to total amino acid residues, and leucine residues to total amino acid residues, present in the engineered protein or a first polypeptide sequence thereof is greater than the corresponding ratio of at least one of branched chain amino acid residues to total amino acid residues, essential amino acid residues to total amino acid residues, and leucine residues to total amino acid residues present in the reference protein or polypeptide sequence.

Nutritive Polypeptides—Orthologs and Homologs.

In another aspect, provided are nutritive polypeptides that contain amino acid sequences homologous to edible species polypeptides, which are optionally secreted from unicellular organisms and purified therefrom. Such homologous polypeptides can be 70%, 75%, 80%, 85%, 90%, 91%, 92%, 93%, 94%, 95%, 96%, 97%, 98%, 99% or greater than 99% similar, or can be 70%, 75%, 80%, 85%, 90%, 91%, 92%, 93%, 94%, 95%, 96%, 97%, 98%, 99% or greater than 99% identical to an edible species polypeptide. Such nutritive polypeptides can be endogenous to the host cell or exogenous, can be naturally secreted in the host cell, or both, and can be engineered for secretion.

Also provided are orthologs of nutritive polypeptides. The disclosure of a nutritive polypeptide sequence encompasses the disclosure of all orthologs of such a nutritive polypeptide sequence, from phylogenetically related organisms or, alternatively, from a phylogenetically diverse organism that is homologous to the nutrititve polypeptide, such as 30%, 35%, 40%, 45%, 50%, 55%, 60%, 65%, 70%, 75%, 80%, 85%, 90%, 91%, 92%, 93%, 94%, 95%, 96%, 97%, 98%, 99% or greater than 99% similar, or can be 70%, 75%, 80%, 85%, 90%, 91%, 92%, 93%, 94%, 95%, 96%, 97%, 98%, 99% or greater than 99% identical.

Nutritive Polypeptide Fragments, Nutritive Polypeptide Length.

In some embodiments herein a nutritive polypeptide contains a fragment of an edible species polypeptide. In some embodiments the fragment comprises at least 25 amino acids. In some embodiments the fragment comprises at least 50 amino acids. In some embodiments the fragment consists of at least 25 amino acids. In some embodiments the fragment consists of at least 50 amino acids. In some embodiments an isolated recombinant protein is provided. In some embodiments the protein comprises a first polypeptide sequence, and the first polypeptide sequence comprises a fragment of at least 25 or at least 50 amino acids of an edible species protein. In some embodiments the proteins is isolated. In some embodiments the proteins are recombinant. In some embodiments the proteins comprise a first polypeptide sequence comprising a fragment of at least 50 amino acids of an edible species protein. In some embodiments the proteins are isolated recombinant proteins. In some embodiments the isolated recombinant proteins disclosed herein are provided in a non-isolated and/or non-recombinant form.

In some embodiments the protein comprises from 10 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 10 amino acids, at least 11 amino acids, at least 12 amino acids, at least 13 amino acids, at least 14 amino acids, at least 15 amino acids, at least 16 amino acids, at least 17 amino acids, at least 18 amino acids, at least 19 amino acids, at least 20 amino acids, at least 21 amino acids, at least 22 amino acids, at least 23 amino acids, at least 24 amino acids, at least 25 amino acids, at least 30 amino acids, at least 35 amino acids, at least 40 amino acids, at least 45 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids. In some embodiments the protein consists of from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 2455 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids. In some aspects, a protein or fragment thereof includes at least two domains: a first domain and a second domain. One of the two domains can include a tag domain, which can be removed if desired. Each domain can be 1, 2, 3, 4, 5, 6, 7, 8, 9, 10, 11, 12, 13, 14, 15, 16, 17, 18, 19, 20, 21, 22, 23, 24, 25, or greater than 25 amino acids in length. For example, the first domain can be a polypeptide of interest that is 18 amino acids in length and the second domain can be a tag domain that is 7 amino acids in length. As another example, the first domain can be a polypeptide of interest that is 17 amino acids in length and the second domain can be a tag domain that is 8 amino acids in length.

In some embodiments herein a fragment of an edible species polypeptide is selected and optionally isolated. In some embodiments the fragment comprises at least 25 amino acids. In some embodiments the fragment comprises at least 50 amino acids. In some embodiments the fragment consists of at least 25 amino acids. In some embodiments the fragment consists of at least 50 amino acids. In some embodiments an isolated recombinant protein is provided. In some embodiments the protein comprises a first polypeptide sequence, and the first polypeptide sequence comprises a fragment of at least 25 or at least 50 amino acids of an edible species protein. In some embodiments the proteins is isolated. In some embodiments the proteins are recombinant. In some embodiments the proteins comprise a first polypeptide sequence comprising a fragment of at least 50 amino acids of an edible species protein. In some embodiments the proteins are isolated recombinant proteins. In some embodiments the isolated nutritive polypeptides disclosed herein are provided in a non-isolated and/or non-recombinant form.

Nutritive Polypeptide Physicochemical Properties.

Digestibility.

In some aspects the nutritive polypeptide is substantially digestible upon consumption by a mammalian subject. Preferably, the nutritive polypeptide is easier to digest than at least a reference polypeptide or a reference mixture of polypeptides, or a portion of other polypeptides in the consuming subject's diet. As used herein, "substantially digestible" can be demonstrated by measuring half-life of the nutritive polypeptide upon consumption. For example, a nutritive polypeptide is easier to digest if it has a half-life in the gastrointestinal tract of a human subject of less than 60 minutes, or less than 50, 40, 30, 20, 15, 10, 5, 4, 3, 2 minutes or 1 minute. In certain embodiments the nutritive polypeptide is provided in a formulation that provides enhanced digestion; for example, the nutritive polypeptide is provided free from other polypeptides or other materials. In some embodiments, the nutritive polypeptide contains one or more recognition sites for one or more endopeptidases. In a specific embodiment, the nutritive polypeptide contains a secretion leader (or secretory leader) sequence, which is then cleaved from the nutritive polypeptide. As provided herein, a nutritive polypeptide encompasses polypeptides with or without signal peptides and/or secretory leader sequences. In some embodiments, the nutritive polypeptide is susceptible to cleavage by one or more exopeptidases.

Digestion Assays

Digestibility is a parameter relevant to the benefits and utility of proteins. Information relating to the relative completeness of digestion can serve as a predictor of peptide bioavailability (Daniel, H., 2003. Molecular and Integrative Physiology of Intestinal Peptide Transport. Annual Review of Physiology, Volume 66, pp. 361-384). In some embodiments proteins disclosed herein are screened to assess their digestibility. Digestibility of proteins can be assessed by any suitable method known in the art. In some embodiments digestibility is assessed by a physiologically relevant in vitro digestion reaction that includes one or both phases of protein digestion, simulated gastric digestion and simulated intestinal digestion (see, e.g., Moreno, et al., 2005. Stability of the major allergen Brazil nut 2S albumin (Ber e 1) to physiologically relevant in vitro gastrointestinal digestion. FEBS Journal, pp. 341-352; Martos, G., Contreras, P., Molina, E. & Lopez-Fandino, R., 2010. Egg White Ovalbumin Digestion Mimicking Physiological Conditions. Journal of Agricultural and food chemistry, pp. 5640-5648; Moreno, F. J., Mackie, A. R. & Clare Mills, E. N., 2005). Phospholipid interactions protect the milk allergen a-Lactalbumin from proteolysis during in vitro digestion. Journal of agricultural and food chemistry, pp. 9810-9816). Briefly, test proteins are sequentially exposed to a simulated gastric fluid (SGF) for 120 minutes (the length of time it takes 90% of a liquid meal to pass from the stomach to the small intestine; see Kong, F. & Singh, R. P., 2008. Disintegration of Solid Foods in Human Stomach. Journal of Food Science, pp. 67-80) and then transferred to a simulated duodenal fluid (SDF) to digest for an additional 120 minutes. Samples at different stages of the digestion (e.g., 2, 5, 15, 30, 60 and 120 min) are analyzed by electrophoresis (e.g., chip electrophoresis or SDS-PAGE) to monitor the size and amount of intact protein as well as any large digestion fragments (e.g., larger than 4 kDa). The disappearance of protein over time indicates the rate at which the protein is digested in the assay. By monitoring the amount of intact protein observed over time, the half-life ($\tau\frac{1}{2}$) of digestion is calculated for SGF and, if intact protein is detected after treatment with SGF, the $\tau\frac{1}{2}$ of digestion is calculated for SIF. This assay can be used to assess comparative digestibility (i.e., against a benchmark protein such as whey) or to assess absolute digestibility. In some embodiments the digestibility of the protein is higher (i.e., the SGF $\tau\frac{1}{2}$ and/or SIF $\tau\frac{1}{2}$ is shorter) than whey protein. In some embodiments the protein has a SGF $\tau\frac{1}{2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the protein has a SIF $\tau\frac{1}{2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the protein is not detectable in one or both of the SGF and SIF assays by 2 minutes, 5 minutes, 15 minutes, 30 minutes, 60 minutes, or 120 minutes. In some embodiments the protein is digested at a constant rate and/or at a controlled rate in one or both of SGF and SIF. In such embodiments the rate of digestion of the protein may not be optimized for the highest possible rate of digestion. In such embodiments the rate of absorption of the protein following ingestion by a mammal can be slower and the total time period over which absorption occurs following ingestion can be longer than for proteins of similar amino acid composition that are digested at a faster initial rate in one or both of SGF and SIF. In some embodiments the protein is completely or substantially completely digested in SGF. In some embodiments the protein is substantially not digested or not digested by SGF; in most such embodiments the protein is digested in SIF.

Assessing protein digestibility can also provide insight into a protein's potential allergenicity, as proteins or large fragments of proteins that are resistant to digestive proteases can have a higher risk of causing an allergenic reaction (Goodman, R. E. et al., 2008. Allergenicity assessment of genetically modified crops—what makes sense? Nature Biotechnology, pp. 73-81). To detect and identify peptides too small for chip electrophoresis analysis, liquid chromatography and mass spectrometry can be used. In SGF samples, peptides can be directly detected and identified by LC/MS. SIF protein digestions may require purification to remove bile acids before detection and identification by LC/MS.

In some embodiments digestibility of a protein is assessed by identification and quantification of digestive protease recognition sites in the protein amino acid sequence. In some embodiments the protein comprises at least one protease recognition site selected from a pepsin recognition site, a trypsin recognition site, and a chymotrypsin recognition site.

As used herein, a "pepsin recognition site" is any site in a polypeptide sequence that is experimentally shown to be cleaved by pepsin. In some embodiments it is a peptide bond after (i.e., downstream of) an amino acid residue selected from Phe, Trp, Tyr, Leu, Ala, Glu, and Gln, provided that the following residue is not an amino acid residue selected from Ala, Gly, and Val.

As used herein, a "trypsin recognition site" is any site in a polypeptide sequence that is experimentally shown to be cleaved by trypsin. In some embodiments it is a peptide bond after an amino acid residue selected from Lys or Arg, provided that the following residue is not a proline.

As used herein, a "chymotrypsin recognition site" is any site in a polypeptide sequence that is experimentally shown to be cleaved by chymotrypsin. In some embodiments it is a peptide bond after an amino acid residue selected from Phe, Trp, Tyr, and Leu.

Disulfide bonded cysteine residues in a protein tend to reduce the rate of digestion of the protein compared to what it would be in the absence of the disulfide bond. For example, it has been shown that the rate of digestion of the protein b-lactoglobulin is increased when its disulfide bridges are cleaved (I. M. Reddy, N. K. D. Kella, and J. E. Kinsella. "Structural and Conformational Basis of the Resistance of B-Lactoglobulin to Peptic and Chymotryptic Digestion". J. Agric. Food Chem. 1988, 36, 737-741). Accordingly, digestibility of a protein with fewer disulfide bonds tends to be higher than for a comparable protein with a greater number of disulfide bonds. In some embodiments the proteins disclosed herein are screened to identify the number of cysteine residues present in each and in particular to allow selection of a protein comprising a relatively low number of cysteine residues. For example, edible species proteins or fragments can be identified that comprise a no Cys residues or that comprise a relatively low number of Cys residues, such as 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments one or more Cys residues in an edible species protein or fragment thereof is removed by deletion and/or by substitution with another amino acid. In some embodiments 1 Cys residue is deleted or replaced, 1 or more Cys residues are deleted or replaced, 2 or more Cys residues are deleted or replaced, 3 or more Cys residues are deleted or replaced, 4 or more Cys residues are deleted or replaced, 5 or more Cys residues are deleted or replaced, 6 or more Cys residues are deleted or replaced, 7 or more Cys residues are deleted or replaced, 8 or more Cys residues are deleted or replaced, 9 or more Cys residues are deleted or replaced, or 10 or more Cys residues are deleted or replaced. In some embodiments the protein of this disclosure comprises a ratio of Cys residues to total amino acid residues equal to or lower than 5%, 4%, 3%, 2%, or 1%. In some embodiments the protein comprises 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments, the protein comprises 1 or fewer Cys residues. In some embodiments, the protein comprises no Cys residues.

Alternatively or in addition, disulfide bonds that are or can be present in a protein can be removed. Disulfides can be removed using chemical methods by reducing the disulfide to two thiol groups with reducing agents such as beta-mercaptoethanol, dithiothreitol (DTT), or tris(2-carboxyethyl)phosphine (TCEP). The thiols can then be covalently modified or "capped" with reagents such as iodoacetamide, N-ethylmaleimide, or sodium sulfite (see, e.g., Crankshaw, M. W. and Grant, G. A. 2001. Modification of Cysteine. Current Protocols in Protein Science. 15.1.1-15.1.18).

Nutritive Polypeptides and Nutritive Polypeptide Formulations with Modulated Viscosity.

Disclosed herein are compositions, formulations, and food products that contain viscosity-modulating nutritive polypeptides. In one aspect, provided are formulations substantially free of non-comestible products that contain nutritive polypeptides present in a nutritional amount, and the nutritive polypeptide decreases the viscosity of a food product. In some embodiments, the nutritive polypeptide is present at about 10 g/l and the viscosity of the formulation is from about 1,000 mPas to about 10,000 mPas at 25 degrees C., such as from about 2,500 mPas to about 5,000 mPas at 25 degrees C.

The formulations are incorporated into food products having advantages over similar food products lacking the nutritive polypeptides, or the formulations are incorporated into other products such as beverage products or animal feed products. For example, the food products have a reduced fat content, a reduced sugar content, and/or a reduced calorie content compared to a food product not having the nutritive polypeptide. Preferably, the nutritive polypeptide is present in the food product such that consumption of a nutritional amount of the food product is satiating. In an embodiment of the invention, gelatin, an animal-derived material, is replaced by a non-animal derived product, containing one or more nutritive polypeptides. Typically the nutritive polypeptide is present in an amount effective to replace gelatin in the product. The gelatin replacement is incorporated into a food product, a beverage product, or an animal feed product, and the formulation is substantially free of non-comestible products.

Also provided are formulations containing a nutritive polypeptide present in a functional and/or nutritional amount, which increases the viscosity of a food or beverage product, such as formulations containing viscosity-increasing nutritive polypeptides incorporated into food products having advantages over similar food products lacking the nutritive polypeptides. For example, the food products have a reduced fat content, a reduced sugar content, and/or a reduced caloric content compared to a food product not having the nutritive polypeptide. Viscous nutritive polypeptides can be used as a nutritionally favorable low calorie substitute for fat. Additionally, it may be desired to add to the compositions and products one or more polysaccharides or emulsifiers, resulting in a further improvement in the creamy mouthfeel.

In some embodiments, the viscosity of nutritive polypeptide-containing materials is enhanced by crosslinking the nutritive polypeptides or crosslinking nutritive polypeptides to other proteins present in the material. An example of an effective crosslinker is transglutaminase, which crosslinks proteins between an $\in$-aminogroup of a lysine residue and a γ-carboxamide group of glutamine residue, forming a stable covalent bond. The resulting gel strength and emulsion strength of nutritive polypeptides identified and produced as described herein are examined by preparing a transglutaminase-coupled nutritive protein composition, followed by gel strength and emulsion strength assays. A suitable transglutaminase derived from microorganisms in accordance with the teachings of U.S. Pat. No. 5,156,956 is commercially available. These commercially available transglutaminases typically have an enzyme activity of about 100 units. The amount of transglutaminase (having an activity of about 100 units) added to isolated nutritive polypeptide is expressed as a transglutaminase concentration which is the units of transglutaminase per 100 grams of isolated nutritive polypeptide. The isolated nutritive polypeptide contains from 5 to 95%, preferably 20 to 80%, preferably 58% to 72% protein and also preferably from 62% to 68% protein. The transglutaminase concentration is at least 0.15, preferably 0.25 and most preferably 0.30 units transglutaminase per gram protein up to 0.80 and preferably 0.65 units transglutaminase per gram protein. Higher and lower amounts may be used. This enzyme treatment can also be followed by thermal processing to make a viscous solution containing a nutritive polypeptide. To generate nutritive polypeptide samples containing crosslinks, a sample is mixed with a transglutaminase solution at pH 7.0 to give an enzyme to protein weight ratio of 1:25. The enzyme-catalyzed cross-linking reaction is conducted at 40° C. in most of the experiments.

Oscillatory shear measurements can be used to investigate the rheological properties of nutritive polypeptides. Also, to determine the viscosity of nutritive polypeptide solutions and gels viscoelasticity is investigated by dynamic oscillatory rheometry. A 2 mL sample of nutritive polypeptide solution or nutritive polypeptide solution containing transglutaminase is poured into the Couette-type cylindrical cell (2.5 cm i.d., 2.75 cm o.d.) of the rheometer and covered with a thin layer of low-viscosity silicone oil to prevent evaporation. For samples with enzyme present, gelation is induced in situ by incubation at 40° C. For nutritive polypeptide samples without enzyme, gelation is induced by subjecting the sample to the following thermal treatment process: temperature increased at constant rate of 2 K min−1 from 40 to 90° C., kept at 90° C. for 30 min, cooled at 1 K min−1 from 90 to 30° C., and kept at 30° C. for 15 min. Some samples can be subjected to this thermal treatment after the enzyme treatment. Small deformation shear rheological properties are mostly determined in the linear viscoelastic regime (maximum strain amplitude 0.5%) with storage and loss moduli (G' and G") measured at a constant frequency of 1 Hz. In addition, some small deformation measurements are made as a function of frequency e.g., 2×10-3 to 2 Hz, and some large deformation measurements are carried out at strains up to nearly 100%.

Nutritive Polypeptides for Treatment of Gastrointestinal Tract Malabsorption Diseases and Inflammatory Conditions Provided are nutritive polypeptides, and compositions and formulations containing nutritive polypeptides, which are useful for the treatment of gastrointestinal tract malabsorption diseases and inflammatory conditions. The nutritive polypeptides are also useful for treating and preventing loss of muscle mass and muscle function in a subject suffering from a gastrointestinal tract malabsorption disease and inflammatory condition. Moreover, the nutritive polypeptides are further useful for reducing or preventing a side effect (meaning a secondary effect, usually undesirable, of a pharmaceutical agent or medical treatment) of other therapeutic or prophylactic regimens for gastrointestinal tract malabsorption diseases, as such regimens may result in decreased amino acid availability to the subject, in addition to causing loss of muscle mass and muscle function.

Gastrointestinal diseases affect an estimated 60 to 70 million subjects in the United States. (See, e.g., Peery, A. F. et al. (2012) Burden of Gastrointestinal Disease in the United States: 2012 Update. *Gastroenterology.* 143(5): 1179-1187.e3). As used herein, a "gastrointestinal tract malabsorption disease" includes any disease, disorder or condition causing or resulting in reduced absorption of polypeptides, peptides and/or amino acids through the gastrointestinal tract of a subject, and the term "protein malabsorption syndrome" may be used interchangeably. Gastrointestinal tract malabsorption diseases may include, for example, structural defects, and malabsorption caused by infection, drugs, surgical procedures (such as bariatric surgery), mucosal abnormalities, inflammation, enzyme deficiency, radiation, digestive failures, systemic diseases, or other causes. Gastrointestinal diseases result in over 21 million hospitalizations (CDC/NCHS national hospital discharge survey: United States, 2010. Centers for Disease Control and Prevention) and over 250,000 deaths annually. (National Institutes of Health, U.S. Department of Health and Human Services. Opportunities and Challenges in Digestive Diseases Research: Recommendations of the National Commission on Digestive Diseases. Bethesda, Md.: National Institutes of Health; 2009. NIH Publication 08-6514.)

Adequate treatment regimens do not exist to treat and prevent gastrointestinal diseases or the gastrointestinal malabsorption associated with them. Gastrointestinal diseases therefore represent a significant morbidity, mortality and health economic burden.

The Center for Disease Control estimates that irritable bowel disease (IBD), one of the most prevalent gastrointestinal diseases, results in annual US healthcare costs in excess of $1.7 billion.

The nutritive polypeptides, compositions and formulations disclosed herein are useful for the treatment and prevention of gastrointestinal protein malabsorption diseases, in particular in human subjects at risk of loss of muscle mass and/or muscle function due to the disease or another treatment regimen therefor. By way of non-limiting example, a human subject may suffer from or be at risk of a gastrointestinal protein malabsorption disease due to an infection. Exemplary infections include viral infections, bacterial infections, and other parasitic infections, which cause or exacerbate diseases including HIV related malabsorption, Traveler's diarrhea, Tropical sprue, Whipple's disease, Intestinal tuberculosis, and hepatitis.

A human subject may suffer from or be at risk of a gastrointestinal protein malabsorption disease due to structural complications of the GI tract or inflammatory diseases or resulting from gastrointestinal reparative surgery. Exemplary diseases include Crohn's Disease, Ulcerative Colitis, Short bowel Syndrome, Mucositis, Fistulae, Diverticulae and Strictures, Eosinophilic gastroenteritis, Radiation enteritis, Systemic Sclerosis and Collagen Vascular Diseases, Ménétrier's disease, Ulcers, Necrotizing Enterocolitis, Polyps, Esophagitis and Gastroparesis, Gastrointestinal Occlusions, Bariatric surgery and Gastrointestinal resection.

In addition, a human subject may suffer from or be at risk of a gastrointestinal protein malabsorption disease due to enzymatic deficiencies. Exemplary diseases include Intestinal Enteropeptidase deficiency, Enterokinase deficiency, Zollinger-Ellison syndrome, Pancreatic enzyme deficiency, Lactase deficiency inducing lactose intolerance (constitutional, secondary, congenital); Sucrose intolerance; Intestinal Disaccharidase deficiency.

A human subject may suffer from or be at risk of a gastrointestinal protein malabsorption disease due to other systemic disease states. Exemplary diseases include Hypothyroidism and Hyperthyroidism, Addison's disease, Diabetes mellitus, Hyperparathyroidism and Hypoparathyroidism, Carcinoid syndrome, Protein Malnutrition (Hypoproteinemia, Anemia, edema, asthenia, alopecia, hypoalbuminemia), Fiber Deficiency, Abeta-lipoproteinaemia, amyloidosis, Proctitis, Gastroesophageal reflux disease, Pancreatitis, Porphyria, Lysinuric protein intolerance, Shwachman-Diamond syndrome.

Further, a human subject may suffer from or be at risk of a gastrointestinal protein malabsorption disease due to eating disorders. Exemplary diseases include Anorexia, Anorexia Nervosa, Bulimia Nervosa, Binge Eating Disorder, Eating Disorder Not Otherwise Specified (EDNOS) and Dysphagias. (See, e.g., Yamada, T. (Ed) (2009) Textbook of Gastroenterology. Blackwell Publishing Ltd).

Short bowel syndrome (SBS) can occur congenitally or from surgery to treat diseases such as Crohn's disease, ulcerative colitis, necrotizing enterocolitis or trauma. Since the gastrointestinal tract is the primary absorptive surface for dietary nutrients, a shortened bowel can cause malabsorption of nutrients and fluids, resulting in nutrient deficiencies, severe diarrhea, dehydration, electrolyte imbalances, weight loss, and frequently, a long-term dependence on parenteral nutrition. Jeppesen, P. B. (2014). Spectrum of Short Bowel Syndrome in Adults: Intestinal Insufficiency to Intestinal Failure. *J. Parent. Ent. Nutr.* 38:8S-13S. Patients with SBS, particularly those patients who are dependent on PN/IV support, can manifest deficiencies in protein-calorie malnutrition, which may result in delayed wound healing.

Glucagon-like peptide-2 (GLP-2), a peptide hormone, may act to control nutrient absorptive capacity within the bowel. Amino acids also function as signals of nutrient status, and therefore nutritive polypeptides can be used to deliver GLP-2 secretagogues into the gastrointestinal tract. GLP-2 receptors are found throughout the small and large bowel in humans, mice, marmoset, and rat. (See, Ørskov, C., (2005) GLP-2 stimulates colonic growth via KGF, released by subepithelial myofibroblasts with GLP-2 receptors. *Regul. Pept.* 124: 105-112.) GLP-2 is co-secreted with GLP-1 from intestinal L cells in response to nutrient ingestion and acts to maintain epithelial barrier function while increasing crypt cell proliferation and weight gain. (Martin, G R., (2006). Gut hormones, and short bowel syndrome: The enigmatic role of glucagon-like peptide-2 in the regulation of intestinal adaptation. *World J Gastroenterol.* 12(26): 4117-4129).

A further example of gastrointestinal malabsorption is eating disorders, including but not limited to anorexia nervosa. Anorexia is characterized by extreme dietary restriction. Dietary restriction and the resulting reduction in total stomach capacity in these individuals can lead to eventual multi organ failure, Hypothermia, Gastrointestinal complications, Cardiac complications including arrhythmia, bradycardia, hypotension and damaged heart muscle. Long term side effects of anorexia are significant and debilitating and include osteoporosis, growth arrest, and amenorrhea. (See, Katzman, D K. (2005). Medical complications in adolescents with anorexia nervosa: a review of the literature. *Int. J. Eat. Disord.* (37)S52-9; Salvioli, B. Et al. (2013). Audit of digestive complaints and psychopathological traits in patients with eating disorders: A prospective study. *Digestive and Liver Disease.* 45(8) 639-644)

Amino acids are key effectors of gut protein turnover, both as constituents of proteins and as regulatory molecules limiting intestinal injury and maintaining intestinal functions. Low glutamine levels are reported in gastrointestinal malabsorption diseases, e.g. Crohn's disease (See, Sido B, (2006) Low intestinal glutamine level and low glutaminase activity in Crohn's disease: a rational for glutamine supplementation? Dig Dis Sci 51(12):2170-2179)). Thus, glutamine delivery via nutritive polypeptides is a useful treatment for Crohn's disease and other indications such as IBS (See, Zhou Q, (2010) MicroRNA-29a regulates intestinal membrane permeability in patients with irritable bowel syndrome. Gut 59(6):775-78.) It has been noted that glutamine supplementation improves gut barrier function in several experimental conditions of injury (Amasheh et al. (2009) Barrier effects of nutritional factors. Ann. NY Acad. SCi. 1165:267-73).

Diseases characterized by inflammation can be treated and prevented with nutritive polypeptides containing levels of certain amino acids, such as arginine, glutamine, or cysteine, or combinations thereof.

Studies in rodents and humans show that supplemental free arginine, administered either orally or parenterally, accelerates wound healing mainly by increasing collagen deposition in wounds. (See, e.g., Barbul A., Lazarou S., Efron D. T., Wasserkrug H. L., and Efron G. (1990). Arginine enhances wound healing in humans. *Surgery.* 108: 331.) Further, Arginine improves epithelial reconstitution after intestinal injury. (See, e.g., Singh K., Coburn L. A., Barry D. P., Boucher J., Chaturvedi R., and Wilson, K. T. (2012)). L-arginine uptake by cationic amino acid transporter 2 is essential for colonic epithelial cell restitution. (Am J Physiol Gastrointest Liver Physiol. 302:G1061). Cysteine has been shown to reduce NF-κB activation and inhibitor κBa (IκBa) degradation in human coronary arterial endothelial cells stimulated with TNF-α. (Hasegawa S, (2012). Cysteine, histidine and glycine exhibit anti-inflammatory effects inhuman coronary arterial endothelial cells. *Clin Exp Immunol.* 167(2):269-74.) L-cysteine administration aids in restoring gut immune homeostasis by attenuating inflammatory responses and restores susceptibility of activated immune cells to apoptosis. (Kim C J, (2009). L-cysteine supplementation attenuates local inflammation and restores gut homeostasis in a porcine model of colitis. *Biochim Biophys Acta.* 1790(10):1161-9.) Thus, the gastrointestinal delivery of cysteine in cysteine-containing nutritive polypeptides is useful for prevention of gut inflammation, and for the reduction of gut inflammation and sequelae thereof.

Amino Acid Pharmacology.

Amino acids are organic molecules containing both amino and acid groups. All amino acids have asymmetric carbon except for glycine and all protein amino acids, except proline, have an alpha-carbon bound to a carboxyl group and a primary amino group.

Amino acids exhibit a diverse range of biochemical properties and biological function due to their varying side chains. They are stable in solution at physiological pH, save for glutamine and cysteine. In the context of some proteins, conditional upon the host and translational machinery, amino acids can undergo post-translational modification. This can have significant effects on their bioavailability, metabolic function, and bioactivity in vivo. Sugar moieties appended to proteins post-translationally may reduce the usefulness of the nutritive proteins by affecting the gastrointestinal release of amino acids and embedded peptides. A comparison of digestion of glycosylated and non-glycosylated forms of the same proteins shows that the non-glycosylated forms are digested more quickly than the glycosylated forms (our data).

Although over 300 amino acids exist in nature, 20 serve as building blocks in protein. Non-protein alpha-AAs and non-alpha AAs are direct products of these 20 protein amino acids and play significant roles in cell metabolism. Due to the metabolic reactions of amino acid catabolism that drive the interconversion between amino acids, a subset of II of the 20 standard protein amino acids are considered non-essential for humans because they can be synthesized from other metabolites (amino acids, ketones, etc.) in the body: Alanine; Arginine; Asparagine; Aspartic acid; Cysteine; Glutamic acid; Glutamine; Glycine; Proline; Serine; and Tyrosine.

Arginine, cysteine, glycine, glutamine, histidine, proline, serine and tyrosine are considered conditionally essential, as they are not normally used in the diet, and are not synthesized in adequate amounts in specific populations to meet optimal needs where rates of utilization are higher than rates of synthesis. Functional needs such as reproduction, disease prevention, or metabolic abnormalities, however, can be taken into account when considering whether an amino acid is truly non-essential or can be conditionally essential in a population. The other 9 protein amino acids, termed essential amino acids, are taken as food because their carbon skeletons are not synthesized de novo by the body to meet optimal metabolic requirements: Histidine; Isoleucine; Leucine; Lysine; Methionine; Phenylalanine; Threonine; Tryptophan; and Valine.

All 20 protein amino acids (and non-protein metabolites) are used for normal cell functionality, and shifts in metabolism driven by changing availability of a single amino acid can affect whole body homeostasis and growth. Additionally, amino acids function as signaling molecules and regulators of key metabolic pathways used for maintenance, growth, reproduction, immunity.

In the body skeletal muscle represents the largest store of both free and protein-bound amino acids due to its large composition of body mass (around 40-45%). The small intestine is another important site for amino acid catabolism, governing the first pass metabolism and entry of dietary amino acids into the portal vein and into the peripheral plasma. 30-50% of EAA in the diet may be catabolized by the small intestine in first-pass metabolism. The high activity of BCAA transaminases in the intestinal mucosa leads to BCAA conversion to branched-chain alpha-ketoacids to provide energy for enterocytes similar as is done in skeletal muscle. Differences in physiological state of muscle and small intestine metabolism have large implications on amino acid biology systemically across tissues in humans.

Amino acids can exist in both L- and D-isoforms, except for glycine (non-chiral). Almost all amino acids in proteins exist in the L-isoform, except for cysteine (D-cys) due to its sulfur atom at the second position of the side-chain, unless otherwise enzymatically postranslationally modified or chemically treated for storing or cooking purposes. Most D-amino acids, except for D-arg, D-cys, D-his, D-lys, and D-thr, can be converted into the L chirality by D-AA oxidases and transaminases. In order to be catabolized, these D enantiomers are transported across the plasma and other biological membranes and undergo D-oxidation or deaminate the amino acid to convert to its alpha-ketoacid or racemization to convert the D-AA to its L-isoform. The transport of D-isomers is limited by a lower affinity of L-AA transporters to D-AAs. For this reason the efficiency of D-AA utilization, on a molar basis of the L-isomer, can range from 20-100% depending on the amino acid and the species.

Alanine:

Alanine is a glucogenic non-essential amino acid due to its ability to be synthesized in muscle cells from BCAAs and pyruvate as part of the glucose-alanine cycle. This involves a tightly regulated process by which skeletal muscle frees energy from protein stores for the generation of glucose distally in the liver for use by extrahepatic cells (including immunocytes) and tissues. The resulting stimulation of gluconeogenesis provides a source of energy in the form of glucose during periods of food deprivation. Alanine becomes a very sensitive intermediary to balance the utilization of BCAAs in the muscle for protein production and generation of available energy through gluconeogenesis in the liver. Furthermore, the alanine induction of gluconeogenesis is integral to support the function of many tissues, not limited to muscle, liver, and immunocytes. Beyond acting as simply an intermediate, however, it also directly regulates activity of a key enzyme in this energy balance, pyruvate kinase. Alanine has the ability to inhibit pyruvate kinase by facilitating its phosphorylation, slowing glycolysis and driving the reverse reaction of pyruvate to phosphoenolpyruvate (PEP) for initiation of gluconeogenesis.

High Alanine

A lack of ATP-producing substrates, as occurs in a fasted state, can lead to autophagy and the turnover of intracellular protein in the lysosome to provide an energy source. Low levels of the glucogenic amino acids, including alanine can stimulate hepatic autophagy, leading to degradation of liver function.

Beta-cells show increased autophagy when under high fat diet feeding as a response to increased demand for insulin production and protein turnover as the body reacts to rising plasma glucose concentrations. This progression towards increased insulin production in obesity is an early marker for pre-diabetes, an indicator of insulin resistance, and a risk factor for the deterioration of islet beta cell functionality which eventually leads to the onset of diabetes in overweight individuals. The ability to regulate alanine levels via nutrition may provide a powerful lever for shifting hepatic and beta cell autophagy to perturb impaired insulin metabolism in overweight individuals.

Alanine directly produces beta-alanine, important to the biosynthesis of panthothenic acid (vitamin b5), coenzyme A, and carnosine (or which it is the rate-limiting precursor). Carnosine, as well as other beta-alanine derived di-peptides (which don't incorporate into proteins) carcinine, anserine, and balenine act as antioxidant buffers in the muscle tissue, constituting up to 20% of the buffer capacity in type I and II muscle fibres. This buffering is important for maintaining tissue pH in muscle during the breakdown of glycogen to lactic acid. In weight loss/gain trials in college athletes, supplementation with beta-alanine was shown to prevent loss of lean mass in weight loss and larger increases in lean mass during weight gain compared to placebo. Beta-alanine is also implicated in decreasing fatigue and increasing muscular work done.

Carnosine is an antioxidant and transition metal ion-sequestering agent. It acts as an anti-glycating agent by inhibiting the formation of advanced glycation end products (AGEs). AGEs are prevalent in diabetic vasculature and contribute to the development of atherosclerosis. The presence of AGEs in various cells types affect both the extracellular and intracellular structure and function. (Golden, A. et. al. Advanced Glycosylation End Products, Circulation 2006). Also, the accumulation of AGEs in the brain is a characteristic of aging and degeneration, particularly in Alzheimer's disease. AGE accumulation explains many neuropathological and biochemical features of Alzheimer's disease such as protein crosslinking, oxidative stress, and neuronal cell death. Because of its combination of antioxidant and antiglycating properties, carnosine is able to diminish cellular oxidative stress and inhibit the intracellular formation of reactive oxygen species and reactive nitrogen species.

Low Alanine

In states of obesity and diabetes, animals have been shown to exhibit reduced hepatic autophagy, leading to increased insulin resistance. Autophagy is important for maintenance of the ER and cellular homeostasis, which when stressed can lead to impaired insulin sensitivity. High fat diet feeding in animal models stresses the ER, while leading to depressed hepatic autophagy through over-stimulation of mTORC1, which reinforces the progression towards insulin sensitivity impaired beta cell function in diabetes. Reducing the level of systemic Alanine provides an opportunity to lower mTORC1 activity and restore healthy levels of autophagy.

Arginine:

Arginine is a glucogenic non-essential amino acid, which can be synthesized via glutamate, aspartate, glutamine, and proline. It is produced by the mammalian small intestine via oxidation of glutamate, glutamine, and aspartate, which generates ornithine, citrulline, arginine, and alanine. It can also be produced (along with ornithine and citrulline) via the proline oxidase pathway from active degradation of proline in enterocytes. Arginine is converted from citrulline released into circulation by the enterocytes in the kidneys and some endothelial cells (leukocytes and smooth muscle). Newborns utilize most of the free citrulline locally in the small intestine for arginine synthesis rather than systemic release. Arginine and proline oxidation is constrained to the mucosa due to reduced activity of pyrroline-5-carboxylate dehydrogenase across the other tissues.

High Arginine

Citrulline is produced from arginine as a by-product of a reaction catalyzed by the NOS family. Dietary supplement of either arginine or citrulline is known to reduce plasma levels of glucose, homocysteine, and asymmetric dimethyl-arginine, which are risk factors for metabolic syndrome. L-citrulline accelerates the removal of lactic acid from muscles, likely due to the affects on vascular tone and endothelial function. Recent studies have also shown that L-citrulline from watermelon juice provides greater recovery from exercise, and less soreness the next day. It also appears that delivery of L-citrulline as a free form results in less uptake into cells in vitro than in the context of watermelon juice (which contains high levels of L-citrulline). This suggests an opportunity to deliver peptide doses, which can traffic arginine into muscle tissue for conversion into citrulline by eNOS at the endothelial membrane for improved efficacy.

Arginine is a highly functional amino acid implicated in many signaling pathways and as a direct precursor of nitric oxide (NO), which facilitates systemic signaling between tissues and regulation of nutrient metabolism and immune function. NO is important for normal endothelial function and cardiovascular health (including vascular tone, hemodynamics, and angiogenesis). Arginine stimulates insulin secretion by directly depolarizing the plasma membrane of the β cell, leading to the influx of $Ca^{2+}$ and subsequent insulin exocytosis.

Arginine supplementation was shown to improve endothelium-dependent relaxation, an indicator of cardiovascular function in type I and type II models of diabetes mellitus. Notably, arginine supplementation reduced white adipose tissue but increased brown fat mass in Zucker diabetic rats and diet-induced obese rats. Arginine and/or its metabolites may enhance the proliferation, differentiation, and function of brown adipocytes. In addition, both skeletal muscle mass and whole body insulin sensitivity were enhanced in response to arginine supplementation via mechanisms involving increases in muscle mTOR and NO signaling. Surprisingly, long-term oral administration of arginine decreased fat mass in adult obese humans with type II diabetes (Lucotti et al 2006). Moreover, supplementation with arginine to a conventional corn- and soybean-based diet reduced fat accretion and promoted protein deposition in the whole body of growing-finishing pigs. In a small pilot trial in humans data indicated that defective insulin-mediated vasodilatation in obesity and non-insulin dependent diabetics (NIDDM) can be normalized by intravenous L-arginine; L-arginine also improved insulin sensitivity in healthy subjects, obese patients and NIDDM patients, indicating a possible mechanism that is different from the restoration of insulin-mediated vasodilatation. In addition, a chronic administration of L-arginine improved glucose levels, insulin induced-hepatic glucose production, and insulin sensitivity in type II diabetic patients (Piatti et al 2001). Arginine rich peptides have not been isolated and tested.

Amino acid administration at high doses (10-20× that available in diet, or 0.1-0.3 g/kg body weight dosed over 20 minutes, via intravenous or oral routes, can stimulate hormone secretion from the gut via endocrine cells. Arginine is a well-studied secretagogue that can stimulate the systemic release of insulin, growth hormone, prolactin, glucagon, progesterone, and placental lactogen. This biology has direct implications on both digestive biology and the absorption of nutrients present in the intestine, as well as affecting energy balance by triggering satiety signals mediated by endocrine hormones. The ability to modulate these hormones provides a therapeutic opportunity for decreasing caloric intake in metabolic disorders such as obesity or alternatively triggering appetite in muscle wasting, sarcopenia, and cachexia, as well as by shifting insulin sensitivity in the onset of diabetes.

Arginine is an important signaling molecule for stimulating mTOR1 phosphorylation in a cell-specific manner. This regulates cellular protein turnover (autophagy) and integrates insulin-like growth signals to protein synthesis initiation across tissues. This biology has been directly linked to biogenesis of lean tissue mass in skeletal muscle, metabolic shifts in disease states of obesity and insulin resistance, and aging. It is also a central signaling pathway which can be hijacked for the proliferation of fast-growing cancer cells.

There is evidence for Arginine increasing levels of protein synthesis in the small intestine under catabolic states such as viral infection and malnutrition, where amino acid levels are dramatically shifted from their normal post-absorptive states. Additionally, demonstrated mTOR activation in the intestinal epithelial cells by Arginine provides a mechanism to repair intestinal epithelium by stimulating protein synthesis and cell proliferation. Similar anabolic signaling has been observed in myocytes in response to rising plasma levels of Arginine, leading to increased whole body and skeletal muscle protein synthesis. Arginine is an amino acid maintained at sufficient levels to support the anabolic effects of EAAs. Lysine, Methionine, Threonine, Tryptophan, Leucine, Isoleucine, and Valine have been shown unable to support increased protein synthesis and whole-body growth when added to a 12.7% crude protein diet, indicating a deficiency in the anabolic mediating non-essential amino acids, including Arginine.

Arginine also up-regulates proteins and enzymes related to mitochondrial biogenesis and substrate oxidation, stimulating metabolism of fatty acid stores and reducing fat tissue mass. Supplementation of dietary Arginine provides a therapeutic benefit in obese and pre-diabetic populations who suffer from insulin resistance due to their increased caloric intake. Likewise, the ability to stimulate mitochondrial biogenesis has direct implications in aging and the ability to regenerate functional proteins and healthy cells subject to oxidative stress.

It is established that dietary deficiency of protein reduces the availability of most amino acids, including Arginine despite it not being considered essential. Arginine deficiency is known to cause decreases in sperm counts by 90% after 9 days, increasing the proportion of non-motile sperm by a factor of 10. Arginine supplementation has been demonstrated in animals to increase levels of Arginine, Proline, Ornithine, and other Arginine metabolites such as Polyamines in seminal fluid, corresponding with increased sperm counts and sperm motility. Changes in NO synthesis and polyamines (via), likewise are seen during gestation when placental growth rate peaks, indicating a role for Arginine in fetal development during pregnancy. In uterine fluids during early gestation, Arginine levels also decrease in response to expression of specific amino acid transporters at the embryo. Arginine supplementation to the diet of animals during early gestation has shown embryonic survival and increase in litter size, indicating a significant potential for delivering high levels of arginine during pregnancy.

Arginine has an extensively studied effect on enhancing immune function, based on direct effects on NO production (which can potentiate a phagocyte's killing ability), hormonal secretagogue activity, and stimulation of mTOR. Proline catabolism by proline oxidase is known to have high levels of activity in the placentae and small intestine of mammals. This activity points to a crucial role for Arginine in gut and placentae immunity, both through generation of $H_2O_2$, which is cytotoxic to pathogenic bacteria, and synthesis of arginine. In critically injured patients leukocyte count normalizes more quickly after 6 days of Arginine enriched diet, with recovery to normal TNF response after 10 days (100% improvement). A clinical study in 296 surgery, trauma, or sepsis patients examining Arginine enriched (12.5 g/L Arginine) formulation vs enteral formula indicates highly reduced hospital stay (8-10 days) and major reduction in frequency of acquired infections. A separate clinical study of 181 septic patients fed Arginine enriched (12.5 g/L Arginine) vs. enteral formula show significantly reduced bacteremia (8% vs 22%), nosocomial infection (6% vs 20%).

Arginine is also a key substrate for the synthesis of collagen. Oral supplementation of arginine enhances wound healing and lymphocyte immune response in healthy subjects. A 2.4× increase in collagen deposition was observe at wound sites (24 nmol/cm vs. 10.1 nmol/cm), along with increased lymphocyte proliferation vs. control.

Arginine is an allosteric activator of N-acetylglutamate synthase, an enzyme which converts glutamate and acetyl-CoA into N-acetylglutamate in the mitochondria. This pushes the hepatic urea cycle towards the active state, useful for ammonia detoxification. This means that dietary delivery of nutrients with low doses of arginine may be useful in the context of kidney disease, where patients struggle to clear urea from their circulation. Elimination of arginine to limit uremia from the available nitrogen sources, while being able to maintain a limited protein intake to prevent tissue catabolism, is a novel strategy against a disruptive nutritional consequence of kidney disease.

Arginine up-regulates the activity of GTP cyclohydrolase-1, freeing tetrahydrobiopterin (THB) for NO synthesis and the hydroxylation of aromatic amino acids (ArAAs) by aromatic amino acid hydroxylase (AAAH). For this reason, delivery of high levels of Arginine to raise cellular levels of THB directly stimulates the biosynthesis of many neurotransmitters in the CNS capillary endothelial cells. ArAAs serve as precursors for biosynthesis of monoamine neurotransmitters, including melatonin, dopamine, norepinephrine (noradrenaline), and epinephrine (adrenaline).

Low Arginine

Excessive arginine intake, stimulating production of high levels of NO in the blood can lead to oxidative injury and apoptosis of cells.

Arginine excess or depletion affects global gene expression in mammalian hepatocytes. Depletion leads to 1419 genes with significantly (p<0.05) altered expression using in-vitro models, of which 56 showed at least 2-fold variation using a 9-way bioinformatics analysis. The majority rise in expression, including multiple growth, survival, and stress-related genes such as GADD45, TA1/LAT1, and caspases 11 and 12. Many are relevant in luminal ER stress response. LDLr, a regulator of cholesterol and steroid biosynthesis, was also modulated in response to arginine depletion. Consistent with Arginine affecting gene expression, dietary arginine supplementation up-regulates anti-oxidative genes and lowers expression of proinflammatory genes in the adipose and small intestinal tissues.

Lower arginine levels inhibit neurotransmitter biosynthesis, which has shown clinical efficacy in indications such as mania, parkinsons, and dyskenisia.

Asparagine:

Asparagine is a glucogenic nonessential amino acid, whose precursor is oxaloacetate (OAA) and which is synthesized via glutamine and aspartate by a transaminase enzyme. It is used for the function of some neoplastic cells such as lymphoblasts.

Asparagine is typically located at the ends of alpha helices of proteins and provides important sites for N-linked glycosylation to add carbohydrate chains, which affects immune response to amino acid ingestion.

Acyrlamide is formed by heat-induced reactions between Asparagine and carbonyl groups of glucose and fructose in many plant-derived foods. Acrylamide is an oxidant that can be cytotoxic, cause gene mutations, and generally affect food quality. Compositions with low levels of asparagine are useful in making safer food products that may be subject to cooking or non-refrigerated storage conditions.

Aspartate:

Aspartate is a glucogenic nonessential amino acid synthesized via the oxaloacetate (OAA) precursor by a transaminase enzyme. As part of the urea cycle, it can also be produced from ornithine and citrulline (or arginine) as the released fumarate is converted to malate and subsequently recycled to OAA. Aspartate provides a nitrogen atom in the synthesis of inosine, which is the precursor in purine biosynthesis. It is also involved in the synthesis of beta-alanine. Aspartate oxidizes in enterocytes of the small intestine, leading to nitrogenous products ornithine, citrulline, arginine, and alanine.

Aspartate is an agonist of NMDA receptors (Glutamate receptors), releasing Ca2+ as a second messenger in many cellular signaling pathways. There are dopaminergic and glutaminergic abnormalities implicated in schitzophrenia, with NMDA antagonists mimicking some positive and negative symptoms of schitzophrenia, while carrying less risk of brain harm than do dopamine agonists. Ketamine and PCP, for example, produce similar phenotypes observed in schitzophrenia, with PCP showing less representative symptomology yet similar brain structure changes. Glutamate receptors have increased function, contributing to the onset of schizophrenia. An increased proportion of post-synaptic glutamate receptors to pre-synaptic glutamate receptors result in increased glutamate signaling. Both agonizing and antagonizing NMDA receptors has shown some benefit in treating Alzheimer's dementia, depending on the MOA and receptor specificity. Thus delivering proteins with either high or low levels of Aspartate, which also as NMDA agonist activity, could be therapeutic for this patient population. Proteins with low levels of Aspartate would likely provide a synergistic benefit along side NMDA antagonists, such as Memantine. Likewise, clinical trials on LY2140023 have demonstrated glutamate-based treatments as having potential for treating schizophrenia without the side effects seen with xenochemical anti-psychotics. Similar studies combining co-agonist glycine with anti-psychotics, showed improved symptomology, suggesting that delivering high doses of Aspartate, also a NMDA agonist, will yield similar therapeutic benefits in this patient population.

Aspartate is an acidic amino acid, with a low Pka of 3.9. Aspartate in the dipeptide form with phenylalanine via a methyl ester yields aspartame, which is used as a commercial artificial sweetener.

Cysteine:

Cysteine is a nonessential amino acid, and is synthesized from homocysteine, which is itself synthesized from the metabolism of methionine. Serine is involved in cysteine's synthesis by condensing with homocysteine to form cystathionine. Cystathionine is then deaminated and hydrolyzed to form cysteine and alpha ketobutyrate. Cysteine's sulfur comes from homocysteine, but the rest of the molecule comes from the initial serine residue. The biosynthesis of cysteine occurs via a different mechanism in plants and prokaryotes. Cysteine is a vital amino acid because it plays an important role in protein folding. The disulfide linkages formed between cysteine residues helps to stabilize the tertiary and quaternary structure of proteins, and these disulfide linkages are most common among the secreted proteins, where proteins are exposed to more oxidizing conditions that are found in the cellular interior. Despite the benefits of homocysteine, having high systemic levels is a risk factor for developing cardiovascular disease. Elevated homocysteine may be caused by a genetic deficiency of cystathionine beta-synthase and excess methionine intake may be another explanation. Control of methionine intake and supplementation with folic acid and vitamin B12 in the diet has been used to lower homocysteine levels. Furthermore, because the availability of cysteine is a key component that limits the synthesis of glutathionine, dietary supplementation with N-acetyl-cysteine, a precursor for cysteine, is highly effective in enhancing immunity under a wide range of disease states.

Cysteine undergoes rapid oxidation to Cystine. It facilitates the biosynthesis of glutathionine, a powerful antioxidant which can donate a reducing equivalent to unstable molecules such as reactive oxygen species (ROS) free radicals. After reducing an oxidative species, it can form a glutathionine sulfide with another reactive glutathionine, providing a mechanism of depleting oxidative stress inducing molecules from cells (The liver can maintain concentrations of up to 5 mM). Glutathionine is a powerful neutralizer of toxins in the liver, and helps to protect the liver from the damaging effects of toxins. Additionally, this detoxifying ability helps to diminish muscle weakness, prevents brittle hair, and protects against radiation associated with these toxins. As a result, it is beneficial for those suffering from chemical allergies or exposed to high levels of air pollution. Glutathionine also is a cofactor for iNOS, allow maximal synthesis of NO in the arg-NO pathway. NO is important for normal endothelial function and cardiovascular health (including vascular tone, hemodynamics, angiogenesis).

In addition to being a precursor to glutatithionine, cysteine is a precursor for the H2S, which can induce endothelial-dependent relaxation, and can be further converted to cysteine sulfinate. Cysteine sulfunate can be converted to taurine, which has the ability to decrease methionine uptake. An excess of methionine increases the risks of the development of atherosclerosis by inducing hyperhomocysteinemia because homocysteine is an intermediate between methionine and cysteine. However, it is not known whether cysteine decreases homocysteine directly or through the reduction of methionine (Sebastiaan Wesseling, et al., Hypertension. 2009; 53: 909-911).

Furthermore, Cysteine is a precursor for Taurine, which modulates the arginine-NO pathway. Taurine has several potentially protective effects. First, taurine has the ability to reduce oxidative stress by binding to hypochlorite. It has been hypothesized that taurine conjugates to mitochondrial transfer RNA, and in so doing, prevents the formation of mitochondrial superoxide. Additionally, taurine inhibits homocysteine-induced stress of the endoplasmic reticulum of vascular smooth muscle cells and thus restores the expression and secretion of extracellular superoxide dismutase.

Glutamate:

Glutamate oxidizes in enterocytes of the small intestine, leading to nitrogeneous products ornithine, citrulline, arginine, and alanine. Glutamate also modulates the arginine-NO pathway. NO is important for normal endothelial function and cardiovascular health (including vascular tone, hemodynamics, angiogenesis).

High Glutamate

A lack of ATP-producing substrates, as occurs in a fasted state, can lead to autophagy and the turnover of intracellular protein in the lysosome to provide an energy source. Low levels of the glucogenic amino acids, including glutamate can stimulate hepatic autophagy, leading to degradation of liver function.

Citrulline is produced from Glutamate as a by-product of a reaction catalyzed by the NOS family. Dietary supplement of citrulline is known to reduce plasma levels of glucose, homocysteine, and asymmetric dimethylarginine, which are risk factors for metabolic syndrome. L-citrulline accelerates the removal of lactic acid from muscles, likely due to the effects on vascular tone and endothelial function. Recent studies have also shown that L-citrulline from watermelon juice provides greater recovery from exercise, and less soreness the next day. It also appears that delivery of L-citrulline as a free form results in less uptake into cells in vitro than in the context of watermelon juice (which contains high levels of L-citrulline). This suggests an opportunity to deliver peptide doses, which can traffic arginine into muscle tissue for conversion into citrulline by eNOS at the endothelial membrane for improved efficacy.

Glutamate facilitates the biosynthesis of glutathione, which can donate a reducing equivalent to unstable molecules such as reactive oxygen species (ROS) and free radicals. After reducing an oxidative species, it can form a glutathione disulfide with another reactive glutathione, providing a mechanism of depleting oxidative stress inducing molecules from cells (maintains high concentrations of up to 5 mM in the liver). Glutathione also is a cofactor for iNOS, allow maximal synthesis of NO in the arg-NO pathway.

Gluatamate with co-agonists glycine or serine is an agonist of NMDA receptors, releasing Ca2+ as a second messenger in many cellular signaling pathways. There are dopaminergic and glutaminergic abnormalities implicated in schitzophrenia, with NMDA antagonists mimicking some positive and negative symptoms of schitzophrenia, while carrying less risk of brain harm than do dopamine agonists. Ketamine and PCP, for example, produce similar phenotypes observed in schitzophrenia, with PCP showing less representative symptomology yet similar brain structure changes. Glutamate receptors have increased function, contributing to the onset of schizophrenia. An increased proportion of post-synaptic glutamate receptors to pre-synaptic glutamate receptors result in increased glutamate signaling. Both agonizing and antagonizing NMDA receptors has shown some benefit in treating Alzheimer's dementia, depending-on the MOA and receptor specificity. Thus delivering proteins with either high or low levels of Glutamate, which also as NMDA agonist activity, could be therapeutic for this patient population. Proteins with low levels of Glutamate would likely provide a synergistic benefit alongside NMDA antagonists, such as Memantine. Likewise, clinical trials on LY2140023 have demonstrated Glutamate-based treatments as having potential for treating schizophrenia without the side effects seen with xenochemical anti-psychotics. Similar studies combining co-agonist Glycine with anti-psychotics, showed improved symptomology, suggesting that delivering high doses of Aspartate, also a NMDA agonist, will yield similar therapeutic benefits in this patient population.

Low Glutamate

Glutamate and acetyl-CoA are converted into N-acetylglutamate in the mitochondria. This pushes the hepatic urea cycle towards the active state, useful for ammonia detoxification. This means that dietary delivery of nutrients with low doses of Glutamate may be useful in the context of kidney disease, where patients struggle to clear urea from their circulation. Elimination of Glutamate to limit uremia from the available nitrogen sources, while being able to maintain a limited protein intake to prevent tissue catabolism, is a novel strategy against a disruptive nutritional consequence of kidney disease.

Glutamine:

Gluatamine oxidizes in enterocytes of the small intestine, leading to nitrogeneous products ornithine, citrulline, arginine, and alanine.

Citrulline is produced from Glutamine as a by-product of a reaction catalyzed by the NOS family. Dietary supplement of citrulline is known to reduce plasma levels of glucose, homocysteine, and asymmetric dimethylarginine, which are risk factors for metabolic syndrome. L-citrulline accelerates the removal of lactic acid from muscles, likely due to the affects on vascular tone and endothelial function. Recent studies have also shown that L-citrulline from watermelon juice provides greater recovery from exercise, and less soreness the next day. It also appears that delivery of L-citrulline as a free form results in less uptake into cells in vitro than in the context of watermelon juice (which contains high levels of L-citrulline). This suggests an opportunity to deliver peptide doses, which can traffic arginine into muscle tissue for conversion into citrulline by eNOS at the endothelial membrane for improved efficacy.

High Glutamine

Glutamine is a well studied secretagogue that can stimulate the systemic release of insulin from beta-cells, growth hormone, prolactin, glucagon, progesterone, and placental lactogen. It has also been shown to reduce circulating glucocorticoids and stress hormones. This biology has direct implications on both digestive biology and the absorption of nutrients present in the intestine, as well as affecting energy balance by triggering satiety signals mediated by endocrine hormones. The ability to modulate these hormones provides a therapeutic opportunity for decreasing caloric intake in metabolic disorders such as obesity or alternatively triggering appetite in muscle wasting, sarcopenia, and cachexia, as well as by shifting insulin sensitivity in the onset of diabetes.

Dietary Glutamine supplementation up-regulates antioxidative genes and lowers expression of proinflammatory genes in the adipose and small intestinal tissues.

Glutamine is an important signaling molecule for stimulating mTOR1 phosphorylation in a cell-specific manner. This regulates cellular protein turnover (autophagy) and integrates insulin-like growth signals to protein synthesis initiation across tissues. This biology has been directly linked to biogenesis of lean tissue mass in skeletal muscle, metabolic shifts in disease states of obesity and insulin resistance, and aging.

Glutamine is an amino acid that is maintained at sufficient levels to support the anabolic effects of EAAs. Lysine, Methionine, Threonine, Tryptophan, Leucine, Isoleucine, and Valine have been shown unable to support increased protein synthesis and whole-body growth when added to a 12.7% crude protein diet, indicating a deficiency in the anabolic mediating non-essential amino acids, including Glutamine.

Glutamine is slowly cyclized to pyroglutamate. Glutamine is the preferred source of fuel for rapidly dividing cells, including enterocytes, lymphocytes, macrophages, and tumors. Supplementation with glutamine in the diet has significant demonstrated benefits in gut integrity and immune function in surgery, critical illness, burn and infection. A 12-day burn injury study of Glutamine supplementation (0.35 g/kg) showed decreased intestinal permeability, lower endotoxin levels, and shorter length of hospital stay. It provided 8.8× decrease vs 5.5× decrease in Lactulose/mannitol ratio after 3 days and a 6-day reduction in hospital stay. 2 week Glutamine total parenteral nutrition (TPN) (0.23 g/kg) vs Glutamine-Free TPN study of malnourished patients waiting for surgery showed increased gut permeability in Glutamine-Free group. It provided a 3.6× vs 0.81× increase in Lactulose/Mannitol ratio after 2 weeks. These improvements point to an opportunity to deliver high levels of Glutamine in the clinic to improve intestinal immunity and reduced bacteraemia.

This also improves lymphocyte counts systemically and reduces infectious complications during a hospital stay. A study of glutamine supplementation (26 g/day until discharge) in patients with serious burn injury shows 3× more frequent positive blood culture in standard total enteral nutrition (TEN) vs Glutamine-enriched, significantly reducing mortality rate. Additionally, Glutamine supplementation shows increased lymphocyte count and function, increased HGH, reduced infectious complications, reduced hospital stay, reduced morbidity, reduced mortality, and reduced gut permeability.

Intramuscular levels of Glutamine decrease under catabolic states such as stress, burn, injury, and sepsis. This decrease causes an net negative protein in lean tissue. Administration of Glutamine to the skeletal muscle has been shown to increase protein synthesis while inhibiting breakdown in-vitro. Furthermore, dose dependence from physiological concentrations (1 mM Glutamine) up to 15-fold higher concentrations has been observed in skeletal muscle. The effect was further demonstrated in mucosal cells taken from the small intestine.

Branched chain amino acids are all metabolic substrates for glutamine synthesis, providing a source of Glutamine in the fetus, enhancing placental and fetal growth, suggesting a role for Glutamine in mediating their effects on anabolism in mammals. Moreover, it has been shown that Glutamine levels and timing of availability from the plasma affect the cellular uptake of Leucine, and the subsequent profile of mTOR activation. A buildup of intracellular Glutamine is used for uptake of Leucine via the Glutamine/Leucine antiporter, SLC7A5. Administration of glutamine at equal proportions to Leucine in-vitro causes a more sustained stimulation of protein synthesis via mTOR, whereas priming the cells with Glutamine prior to Leucine administration leads to a more rapid, yet transient mTOR activation (Nicklin, P. et. al. Cell 2009).

A lack of ATP-producing substrates, as occurs in a fasted state, can lead to autophagy and the turnover of intracellular protein in the lysosome to provide an energy source. Low levels of the glucogenic amino acids, including glutamine can stimulate hepatic autophagy, leading to degradation of liver function.

Low Glutamine mTOR is a central signaling pathway which can be hijacked for the proliferation of fast-growing cancer cells, as is evidence by oncogenic cells' preferential uptake of Glutamine.

Glycine:

A lack of ATP-producing substrates, as occurs in a fasted state, can lead to autophagy and the turnover of intracellular protein in the lysosome to provide an energy source. Low levels of the glucogenic amino acids, including glycine can stimulate hepatic autophagy, leading to degradation of liver function.

Glycine facilitates the biosynthesis of glutathione, which can donate a reducing equivalent to unstable molecules such as reactive oxygen species (ROS) and free radicals. After reducing an oxidative species, it can form a glutathione disulfide with another reactive glutathione, providing a mechanism of depleting oxidative stress inducing molecules from cells (maintains high concentrations of up to 5 mM in the liver). Glutathione also is a cofactor for iNOS, allow maximal synthesis of NO in the arg-NO pathway.

Histidine:

Histidine is an essential amino acid, and is a precursor for carnosine. Carnosine is an antioxidant and transition metal ion-sequestering agent. It acts as an anti-glycating agent by inhibiting the formation of advanced glycation end products (AGEs). AGEs are prevalent in diabetic vasculature and contribute to the development of atherosclerosis. The presence of AGEs in various cells types affect both the extracellular and intracellular structure and function. (Golden, A. et. al. Advanced Glycosylation End Products, Circulation 2006). Also, the accumulation of AGEs in the brain is a characteristic of aging and degeneration, particularly in Alzheimer's disease. AGE accumulation explains many neuropathological and biochemical features of Alzheimer's disease such as protein crosslinking, oxidative stress, and neuronal cell death. Because of its combination of antioxidant and antiglycating properties, carnosine is able to diminish cellular oxidative stress and inhibit the intracellular formation of reactive oxygen species and reactive nitrogen species.

Histidine has antioxidant, anti-inflammatory, and anti-secretory properties. Histidine's imidazole rings have the ability to scavenge reactive oxygen species (ROS), which are made by cells during acute inflammatory response. Histidine administration inhibits cytokine and growth factors involved in cell and tissue damage. Histidine administration is instrumental in rheumatoid arthritis treatment, and administering 4.5 g daily has been used to effectively treat patients with severe rheumatoid arthritis. Rheumatoid arthritis patients have been found to have low serum histidine levels due to its very rapid removal from the blood. Low plasma Histidine levels have also been found in patients with chronic renal failure, obese women (where it also had negative impact on oxidative stress and inflammation), pediatric patients with pneumonia, and asthma patients. Histidine supplementation has been shown to diminish insulin resistance, reduce BMI and fat mass. Histidine suppresses inflammation and oxidative stress in obese subjects with a metabolic syndrome. Lastly, as a precursor to histamine, histidine increases levels of histamine in the blood and in the brain. Low blood histamine is found in some manic, schizophrenic, high copper and hyperactive groups of psychiatric patients.

Posttranslational modification of proteins involved in transcriptional regulation is a mechanisms used to regulate genes. This modification can alter protein functions in specific ways. One form of modification is protein methylation, which is one of the most abundant protein modifications. Protein methylation carries important biological functions, including gene regulation and signal transduction. Histidine plays a role in protein modification, and ultimately gene regulation, in that it accepts methyl group transferred from S-adenosylmethionine by protein methyltransferases (Young-Ho Lee and Michael R. Stallcup, Mol Endocrinol. 2009 April; 23(4): 425-433).

Histidine supplementation can be instrumental in the treatment of multiple diseases including: Alzheimer's disease, diabetes, atherosclerosis, metabolic syndrome in women, rheumatoid arthritis, and various psychiatric conditions (manic, schizophrenic, high copper, and hyperactive groups). Additionally, due to its role in protein modifications, Histidine provides an avenue to combat diseases resulting from gene deregulation, including cancer.

Low Histidine

There exists a mechanistic understanding of how uncharged tRNA allosterically activates GCN2, leading to downstream phosphorylation of transcription factors related to lipogenesis and protein synthesis, along with many biosynthetic pathways in eukaryotes (SREBP-1c, eIF2a, and GCN4p discussed below). Diets devoid of an essential amino acid remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). An unbalanced diet lacking Histidine has been shown to signal GCN2 for rats on a basal casein diet with 1-5.4% of an amino acid mixture supplemented lacking Histidine. Histidine deprivation, through its action on GCN2, has an effect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Isoleucine:

Isoleucine is an EAA, and is also a BCAA. Isoleucine is used in combination with other BCAAs to improve the nutritional status of patients suffering from hepatic disease. BCAAs, including isoleucine, serve as fuel sources for skeletal muscle during periods of metabolic stress; promote protein synthesis, suppress protein catabolism, and serve as substrates for gluconeogenesis. BCAAs, and specifically isoleucine, are catabolized in the skeletal muscle, and stimulate the production of L-alanine and L-glutamine.

BCAAs have been shown to have anabolic effects on protein metabolism by increasing the rate of protein synthesis and decreasing the rate of protein degradation in resting human muscle. Additionally, BCAAs are shown to have anabolic effects in human muscle during post endurance exercise recovery. These effects are mediated through the phosphorylation of mTOR and sequential activation of 70-kD S6 protein kinase (p70-kD S6), and eukaryotic initiation factor 4E-binding protein 1. P70-kD S6 is known for its role in modulating cell-cycle progression, cell size, and cell survival. P70-kD S6 activation in response to mitogen stimulation up-regulates ribosomal biosynthesis and enhances the translational capacity of the cell (W-L An, et al., Am J Pathol. 2003 August; 163(2): 591-607; E. Blomstrand, et al., J. Nutr. January 2006 136: 269S-273S). Eukaryotic initiation factor 4E-binding protein 1 is a limiting component of the multi-subunit complex that recruits 40S ribosomal subunits to the 5' end of mRNAs. Activation of p70 S6 kinase, and subsequent phosphorylation of the ribosomal protein S6, is associated with enhanced translation of specific mRNAs.

BCAAs given to subjects during and after one session of quadriceps muscle resistance exercise show an increase in mTOR, p70 S6 kinase, and S6 phosphorylation was found in the recovery period after the exercise. However, there was no such effect of BCAAs on Akt or glycogen synthase kinase 3 (GSK-3). Exercise without BCAA intake leads to a partial phosphorylation of p70 S6 kinase without activating the enzyme, a decrease in Akt phosphorylation, and no change in GSK-3. BCAA infusion also increases p70 S6 kinase phosphorylation in an Akt-independent manner in resting subjects. This mTOR activity regulates cellular protein turnover (autophagy) and integrates insulin-like growth signals to protein synthesis initiation across tissues. This biology has been directly linked to biogenesis of lean tissue mass in skeletal muscle, metabolic shifts in disease states of obesity and insulin resistance, and aging.

Isoleucine supplementation can be used to improve athletic performance and muscle formation, prevent muscle loss that accompanies aging, aid those suffering from hepatic disease, support the growing bodies of children, and improve the nutritive quality of foods given to the starving populations. Additionally, as a precursor for L-alanine and L-glutamine, isoleucine mediates their significant metabolic signaling activities.

Low Isoleucine

In states of obesity and diabetes, animals have been shown to exhibit reduced hepatic autophagy, leading to increased insulin resistance. Autophagy is important for maintenance of the ER and cellular homeostasis, which when stressed can lead to impaired insulin sensitivity. High fat diet feeding in animal models stresses the ER, while leading to depressed hepatic autophagy through over-stimulation of mTORC1, which reinforces the progression towards insulin sensitivity impaired beta-cell function in diabetes. Reducing the level of systemic Isoleucine provides an opportunity to lower mTORC1 activity and restore healthy levels of autophagy.

There exists a mechanistic understanding of how uncharged tRNA allosterically activates GCN2, leading to downstream phosphorylation of transcription factors related to lipogenesis and protein synthesis, along with many biosynthetic pathways in eukaryotes (SREBP-1c, eIF2a, and GCN4p discussed below). Diets devoid of any EAAs remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Isoleucine deprivation, through its action on GCN2, has an effect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Leucine:

Leucine is an essential amino acid and a branched chain amino acid. The branched chain amino acids, including Leucine, serve as fuel sources for skeletal muscle during periods of metabolic stress; promote protein synthesis, suppress protein catabolism, and serve as substrates for gluconeogenesis. BCAAs, and including Leucine, are catabolized in the skeletal muscle, and stimulate the production of L-alanine and L-glutamine. Leucine plays a direct role in the regulation of protein turnover through cellular mTOR signaling and gene expression as well as serving to activate glumatate dehydrogenase.

BCAAs have been shown to have anabolic effects on protein metabolism by increasing the rate of protein synthesis and decreasing the rate of protein degradation in resting human muscle. Additionally, BCAAs are shown to have anabolic affects in human muscle during post endurance exercise recovery. These affects are mediated through the phosphorylation of mTOR and sequential activation of 70-kD S6 protein kinase (p70-kD S6), and eukaryotic initiation factor 4E-binding protein 1. P70-kD S6 is known for its role in modulating cell-cycle progression, cell size, and cell survival. P70-kD S6 activation in response to mitogen stimulation up-regulates ribosomal biosynthesis and enhances the translational capacity of the cell (W-L An, et al., Am J Pathol. 2003 August; 163(2): 591-607; E. Blomstrand, et al., J. Nutr. January 2006 136: 269S-273S). Eukaryotic initiation factor 4E-binding protein 1 is a limiting component of the multi-subunit complex that recruits 40S ribosomal subunits to the 5' end of mRNAs. Activation of p70 S6 kinase, and subsequent phosphorylation of the ribosomal protein S6, is associated with enhanced translation of specific mRNAs.

BCAAs given to subjects during and after one session of quadriceps muscle resistance exercise show an increase in mTOR, p70 S6 kinase, and S6 phosphorylation was found in the recovery period after the exercise. However, there was no such effect of BCAAs on Akt or glycogen synthase kinase 3 (GSK-3). Exercise without BCAA intake leads to a partial phosphorylation of p70 S6 kinase without activating the enzyme, a decrease in Akt phosphorylation, and no change in GSK-3. BCAA infusion also increases p70 S6 kinase phosphorylation in an Akt-independent manner in resting subjects. Leucine is furthermore known to be the primary signaling molecule for stimulating mTOR1 phosphorylation in a cell-specific manner. This regulates cellular protein turnover (autophagy) and integrates insulin-like growth signals to protein synthesis initiation across tissues. This biology has been directly linked to biogenesis of lean tissue mass in skeletal muscle, metabolic shifts in disease states of obesity and insulin resistance, and aging.

Leucine is a well-studied secretagogue that can stimulate the systemic release of insulin from beta-cells, growth hormone, prolactin, glucagon, progesterone, and placental lactogen. This biology has direct implications on both digestive biology and the absorption of nutrients present in the intestine, as well as affecting energy balance by triggering satiety signals mediated by endocrine hormones. The ability to modulate these hormones provides a therapeutic opportunity for decreasing caloric intake in metabolic disorders such as obesity or alternatively triggering appetite in muscle wasting, sarcopenia, and cachexia, as well as by shifting insulin sensitivity in the onset of diabetes.

Leucine activates glutamate dehydrogenase, which is an enzyme that catalyzes the reversible interconversion between glutamate, $\alpha$-ketoglutarate, and ammonia. In mammals, glutamate dehydrogenase has high levels of activity in the liver, kidney, brain, and pancreas. In the liver, glutamate dehydrogenase provides the appropriate ratio of ammonia and amino acids for urea synthesis in periportal hepatocytes, and the glutamate dehydrogenase reactions seem to be in a close-to-equilibrium state. Additionally, glutamate dehydrogenase has been shown to produce glutamate for glutamine synthesis in a small rim of pericentral hepatocytes, enabling it to serve as either a source for ammonia or an ammonia scavenger. In the kidney, glutamate dehydrogenase functions to produce ammonia from glutamate to control acidosis (C. Spanaki and A. Plaitakis, Neurotox Res. 2012 January; 21(1):117-27).

Leucine supplementation can be used to improve athletic performance and muscle formation, prevent muscle loss that accompanies aging, aid those suffering from hepatic disease, support the growing bodies of children, and improve the nutritive quality of foods given to the starving populations. Additionally, leucine plays an important role in urea synthesis in hepatocytes, and may be given to treat those who suffer from conditions that cause them to be hyperammonemic. Lastly, leucine may be used to treat acidosis.

Low Leucine

In states of obesity and diabetes, animals have been shown to exhibit reduced hepatic autophagy, leading to increased insulin resistance. Autophagy is important for maintenance of the ER and cellular homeostasis, which when stressed can lead to impaired insulin sensitivity. High fat diet feeding in animal models stresses the ER, while leading to depressed hepatic autophagy through over-stimulation of mTORC1, which reinforces the progression towards insulin sensitivity impaired beta cell function in diabetes. Reducing the level of systemic Leucine provides an opportunity to lower mTORC1 activity and restore healthy levels of autophagy.

mTOR is a central signaling pathway which can be hijacked for the proliferation of fast-growing cancer cells.

Depletion of Leucine may reduce a fast-growing cell's ability to sustain constitutive mTOR activation.

There exists a mechanistic understanding of how uncharged tRNA allosterically activates GCN2, leading to downstream phosphorylation of transcription factors related to lipogenesis and protein synthesis, along with many biosynthetic pathways in eukaryotes (SREBP-1c, eIF2a, and GCN4p discussed below). Diets devoid of an EAA remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Leucine deprivation, through its action on GCN2, has an affect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Leucine deprivation, furthermore, has directly shown up-regulation of UCP1 in brown adipose tissue (BAT), a direct measure of thermogenesis, an increase in energy expenditure (presumably due to an increase in thermogenesis in BAT), and a corresponding decrease in fat mass by stimulation of lipolysis in the white adipose tissue (WAT). UCP1 up-regulation results in decreased food intake, body weight, abdominal fat mass, fat mass, and maintenance of lean mass (Guo, F. The GCN2 eIF2alpha kinase regulates fatty-acid homeostasis in the liver during deprivation of an essential amino acid. Cell Metab., 2007).

Lysine:

Lysine is an EAA that is important for proper growth, and plays a vital role in the production of carnitine. Carnitine is a quaternary amine that plays an important role in the production of energy in the myocardium. Carnitine transports free fatty acids into the mitochondria, and in so doing, increases the preferred substrate for oxidative metabolism in the heart. Additionally, carnitine prevents the fatty acid accumulation that occurs during ischemic events, which may lead to ventricular arrhythmias. As the myocardial carnitine levels are quickly diminished during an ischemic event, exogenous supplementation with carnitine replenishes the depleted myocardial carnitine levels and improve cardiac metabolic and left ventricular function. Additionally, an analysis of 4 studies demonstrated that supplementation with L-carnitine after an acute myocardial infarction (AMI), in comparison to a placebo, significantly reduces left ventricular dilation in the first year after the AMI. This is significant because the prevention of left ventricular dilation and the preservation of cardiac function after an AMI is a powerful predictor of the progression to heart failure and death. Additionally, carnitine aids in lowering cholesterol, which further supports heart health, and aids in the prevention of acute myocardial infarctions (James J. DiNicolantonio, et al., Mayo Clinic Proceedings, 2013; 88, 544-551).

Lysine supplementation is useful to support heart health and during ischemic events to prevent ventricular arrhythmia. In addition, Lysine supplementation may help heart attack patients recover effectively, and aid in the prevention of heart attacks in those with the left ventricular dilation. Also, Lysine can be used for to decrease cholesterol levels in patients with high cholesterol.

Lysine is instrumental in helping the body to absorb calcium and decreases the amount of calcium that is lost in urine. Due to calcium's role in bone health, Lysine supplementation is helpful in preventing the bone loss that is associated with osteoporosis. Furthermore, a combination of L-arginine and Lysine makes the bone building cells more active and enhances production of collagen, which is sub-stance that is important for bones and connective tissues including: skin, tendon, and cartilage.

Lysine supplementation is useful for patients suffering from osteoporosis, and those at risk for developing osteoporosis; the elderly, menopausal women, growing children, in cosmetics due to its role in collagen production, and athletes for improved ligament integrity.

A lysine deficiency causes fatigue, nausea, dizziness, loss of appetite, agitation, bloodshot eyes, slow growth, anemia, and reproductive disorders.

Lysine helps to prevent and suppress outbreaks of cold sores and genital herpes when taken on a regular basis. When 45 patients with frequently recurring herpes infection were given 312-1200 mg of lysine daily in single or multiple doses, recovery from the infection and suppression of recurrence was evidenced (Griffith R. S., et al., Dermatologica 1978; 156:257-267). This is because lysine has antiviral effects, which act by blocking the activity of arginine, which promotes herpes simplex virus (HSV) replication. In tissue culture studies, herpes viral replication is enhanced when the arginine/lysine ratio favors arginine. However, when the arginine/lysine ratio favors lysine, viral replication is suppressed, ad cyto-pathogenicity of HSV is inhibited. (Griffith R. S., et al., Dermatologica 1978; 156:257-267). It has been shown that oral lysine is more effective for preventing an outbreak than it is at reducing the severity and duration of the outbreak.

Supplementing the diet with Lysine for those infected with the HSV suppresses outbreak of cold sores and genital warts, and when actively taken on a regular basis is very beneficial in the prevention of outbreaks.

Lysine modulates the arginine-NO pathway. NO is important for normal endothelial function and cardiovascular health (including vascular tone, hemodynamics, angiogenesis). Lysine is a natural inhibitor of L-arginine transport, and competes with L-arginine for uptake through the system y+, which is the major transport system of cationic amino acids in mammalian cells. Excess nitric oxide contributes to refractory hypotension associated with sepsis, and can be combatted with administration of L-lysine because it inhibits Arginine, which is an important component of NO synthesis (K. G. Allman, et al., British Journal of Anaesthesia (1998) 81: 188-192). Moreover, an excess of NO may lead to diseases, due to its release from cerebral vasculature, brain tissue, and nerve endings, which are prime regions for neurodegeneration. Excess NO may lead to migraines, brain cell damage that can lead to neurodegenerative diseases like Parkinson disease, Alzheimer's disease, Huntington disease, and amyotrophic lateral sclerosis. Furthermore, NO that is produced by the pancreas may damage the beta-cells as occurs in type 1 diabetes.

Lysine supplementation is useful for the prevention of hypotension associated with sepsis by preventing vasodilation. Additionally, lysine may be used to prevent/treat migraines, and prevent/slow down the progression of neurodegenerative diseases like AD, Parkinson's disease, Huntington, and amyotrophic lateral sceloris.

Low Lysine

There exists a mechanistic understanding of how uncharged tRNA allosterically activates GCN2, leading to downstream phosphorylation of transcription factors related to lipogenesis and protein synthesis, along with many biosynthetic pathways in eukaryotes (SREBP-1c, eIF2a, and GCN4p discussed below). Diets devoid of an EAA remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, with an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Lysine deprivation, through its action on GCN2, has an affect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Methionine:

Methionine is an essential amino acid, and is the initiating amino acid in the synthesis of virtually all eukaryotic proteins. Methionine is one of the most hydrophobic AAs. Most of the methionine residues in globular proteins can be found in the interior of the hydrophobic core. Methionine is often found to interact with the lipid bilayer in membrane-spanning protein domains. Due to its location and powerful antioxidative properties, methionine has been regarded as endogenous antioxidants in proteins (John T. Brosnan and Margaret E. Brosnan, J. Nutr. June 2006 vol. 136 no. 6 1636S-1640S). Methionine residues have a high susceptibility to oxidation by oxidases, ozone, hydrogen peroxide, superoxide, γ-irradiation, metal-catalyzed oxidation, "leakage" from the electron transport chain, and auto-oxidation of flavins or xenobiotics. Once oxidized, the Methionine residue is converted to methionine sulfoxide, which can be converted back to Methionine though methionine sulfoxide reductases (Rodney L. Levine, et al., Proc Natl Acad Sci USA, 1996 Dec. 24; 93(26): 15036-15040). As an antioxidant, methionine supplementation can aid in the prevention of cancer, degenerative diseases, heart disease, liver and kidney pathologies. It can also be used in cosmetics to fight the damage of UV rays to the skin.

Methionine is a lipotropic AA, and helps the liver process lipids, and thereby helps prevent the build-up of fat in the liver and arteries that may ultimately lead to an obstruction of blood flow to the brain, heart, and kidneys. Additionally, the build-up of fat in the liver drives a pathology known as hepatic steatosis, which may ultimately lead to cirrhosis of the liver. Methionine supplementation for individuals undergoing drug detoxification may improve the process, as well as for those taking medications which have toxic side effects.

In addition, to being a lipotropic AA, Methionine promotes heart health by increasing of the liver's production of lecithin, which is known to help reduce cholesterol levels. Methionine supplementation can prevent cirrhosis of the liver from fat deposition therein. Additionally, it can promote cardiovascular health by preventing the deposition of fat into the arteries, thereby preventing possible myocardial infarctions and strokes. Further, Methionine may help those with high cholesterol levels lower their cholesterol, improving the risk of cardiovascular disease Methionine aids in the proper functioning of the immune system in that elevated levels of methionine increases the levels of taurine, and homocysteine and glutathione which help improve immune function. The underlying mechanism for the immune functions may involve mTOR activation, NO and glutathionine synthesis, H2S signaling, and cellular redox state. Methionine is a precursor for Taurine, which modulates the arginine-NO pathway. NO is important for normal endothelial function and cardiovascular health (including vascular tone, hemodynamics, angiogenesis).

Methionine is also converted into cysteine, which is a precursor for Glutathionine. Glutathionine is a powerful neutralizer of toxins in the liver, and helps to protect the liver from the damaging effects of toxins. Additionally, this detoxifying ability helps to diminish muscle weakness, prevents brittle hair, and protects against radiation associated with these toxins. As a result; it is beneficial for those suffering from chemical allergies or exposure to high levels of air pollution. Methionine can be helpful to patients with compromised immune systems, such as AIDS patients and cancer patients. Likewise, it can be a useful supplement during flu seasons, particularly to groups who are most susceptible, including: the elderly, children, and pregnant women. Furthermore, it can be used for those travelling to countries where they will likely be susceptible to regional infections. Methionine levels are observed to be lower in patients with AIDS. This decreased level of methionine has been linked to deterioration in the nervous system that leads to symptoms like dementia, and diminished memory recall. Supplementing with 6 grams of methionine per day can lead to improvements in the memory recall in these patients. Likewise, Methionine can be beneficial to those who have diseases that involve nervous system degeneration including Alzheimer's Disease, ALS, MS, and Huntington's.

Methionine participates in one-carbon metabolism, and thereby also participates in the methylation of proteins and DNA, which in turn helps regulate gene expression and the biological activity of proteins. Methionine supplementation for those at risk for related genetic disorders can be used to promote proper gene regulation in all individuals.

Low Methionine

Methionine is a precursor for the toxic homocysteine, which mediates ADMA by down-regulating DDAH in body to metabolize ADMA, interfering with the arginine-NO pathway. NO is important for normal endothelial function and cardiovascular health (including vascular tone, hemodynamics, angiogenesis).

There exists a mechanistic understanding of how uncharged tRNA allosterically activates GCN2, leading to downstream phosphorylation of transcription factors related to lipogenesis, protein synthesis, along with many biosynthetic pathways in eukaryotes (SREBP-1c, eIF2a, and GCN4p discussed below). Diets devoid of any EEAs remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Methionine deprivation, through its action on GCN2, has an affect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Phenylalanine:

Phenylalanine is an EEA, AuAA, and precursor for synthesis of norepinephrine in the brain, as well as a metabolic precursor for tyrosine, which is another aromatic amino acid and precursor for the synthesis of dopamine.

Norepinephrine (NE) is synthesized in the adrenal medulla and postganglionic neurons in the sympathetic nervous system by the β-oxidation of dopamine by β-hydroxylase along with the cofactor ascorbate. It works by being secreted into the synaptic cleft where it stimulates adrenergic receptors and is then either degraded or up-taken by surrounding cells. As a cathecolamine, it does not cross the blood-brain barrier.

NE can be used to combat attention-deficit/hyperactivity disorders (ADHD), depression, and hypotension. In terms of attention disorders, like ADHD, medications prescribed tend to help increase levels of NE and dopamine. Furthermore, depression is typically treated with medications that inhibit the reuptake of serotonin and NE thereby increasing the amount of serotonin and NE that is available in the post-synaptic cells in the brain. Recent evidence has suggested that serotonin-norepinephrine reuptake inhibitors (SNRIs) may also increase dopamine transmission because if the norepinephrine transporter ordinarily recycled dopamine as well, then SNRIs will also enhance the dopaminergic transmission. As a result, the effects antidepressants may also be associated with the increased NE levels may partly be due to the simultaneous increase in dopamine (in particular in the prefrontal cortex of the brain).

NE is used to treat patients with critical hypotension. NE is a vasopressor and acts on both $\alpha 1$ and $\alpha 2$ adrenergic receptors to cause vasoconstriction, thereby increasing the blood pressure.

As a precursor for NE, Phenylalanine can be used to treat attention disorders like ADHD and ADD. Additionally, it can be used to treat those suffering from depression or post-traumatic stress syndrome. Phenylalaline can also be used to treat depression or alter the function of neurotransmitter modulating drugs such as SSRIs. Additionally, due to its ability to increase blood pressure through the increase of vascular tone, it may be used to treat those with a hypotensive tendency. Furthermore, phenylalanine may be used as an upstream regulator of tyrosine levels, and thereby Tyrosine function.

Tyrosine supplementation can help in the treatment of Parkinson's disease due to its role as a precursor to L-DOPA and dopamine. Additionally, it can be used in the treatment of those with emotional/psychiatric disorder like depression and in the treatment of addiction. Furthermore, it can promote learning by increasing the reward/pleasure response during learning difficult or complex concepts or movements.

Dopamine, which is a monoamine catecholamine neurotransmitter, plays a regulatory role in the immune system. Neurotransmitters and neuropeptides that interact with specific receptors present in particular immune effector cells are released by the immune system to influence the functions of these cells in the host against disease and other environmental stress. The immunoregulatory actions of dopamine have been shown to be regulated via five different G protein-coupled receptors that are present in target cells. There are two broad classes of these receptors: G1 and G2, which encompass the varying subtypes. The D1 class of receptors includes D2 and D5 subtypes, and increase intracellular cAMP upon activation. The D2 class of receptors consists of the D2, D3, and D4 subtypes, and has been reported to inhibit intracellular cAMP upon stimulation. Dopamine receptors have been found on normal human leukocytes. Likewise, the lymphoid tissues have dopaminergic innervations through sympathetic nerves, which suggests that dopamine may be able to regulate the immune system effector cells (Basu, Sujit & Sarkar, Chandrani, Dopamine and immune system. SciTopics 2010).

Dopamine affects T cells by activating the resting T cells and inhibiting the activation of stimulated T cells. In normal resting peripheral human T lymphocytes, dopamine activates the D2 and D3 subclass of receptors, which in turn activates integrins ($\alpha 4\beta 1$ and $\alpha 5\beta 1$). These integrins are heterodimeric transmembrane glycoproteins that attach cells to the extracellular matrix component, fibronectin. Fibronectin is used for the trafficking and extravasation of T cells across the tissue barriers and blood vessels. Furthermore, dopamine acts through the D3 receptors to selectively induce the migration and homing of CD8+ T cells. Moreover, dopamine affects T cells by influencing the secretions of cytokines by the T cells. When dopamine stimulates the D3 and D1/D5 receptors, the secretion of TNF-$\alpha$ (a pleiotropic inflammatory cytokine) is increased. When the D2 receptors are stimulated, IL-10 (an anti-inflammatory cytokine) is induced to secrete. Dopamine, however, can inhibit the activated T cell receptor induced cell proliferation and secretion of a number of cytokines like Il-2, IFN-$\gamma$ and IL-4 through the down-regulation of the expression of non-receptor tyrosine kinases lck and fyn, which are important tyrosine kinases in the initiation of TCR activation (Basu, Sujit & Sarkar, Chandrani Dopamine and immune system. SciTopics 2010).

The B cells have a very high expression of dopamine D2, D3, and D5 receptors. Dopamine has the ability to inhibit the proliferation of the resting and the malignant B lymphocytes. Dopamine acts by promoting apoptosis in cycling B cells through oxidative stress. However, this dopaminergic action has not been observed in resting lymphocytes, therefore suggesting a role in the prevention of cancer (Basu, Sujit & Sarkar, Chandrani, Dopamine and immune system. SciTopics 2010).

Tyrosine, as a precursor for Dopamine, can be used to improve immune responses and improve the overall immune system functionality. It can provide a benefit to the elderly, women who are pregnant, children, and those with compromised immune functions like AIDS patients, and cancer patients. It also can be given to teachers, those travelling, and anyone frequently exposed to germs.

Epinephrine, which is popularly known as adrenaline, is a hormone that is secreted by the medulla of the adrenal glands. Epinephrine is released in response to strong emotions such as fear or anger, which causes an increase in heart rate, muscle strength, blood pressure, and sugar metabolism. It is responsible for the flight or fight response that prepares the body for difficult or strenuous activity. Epinephrine is used as a stimulant during cardiac arrest, as a vasoconstrictor during shock to increase blood pressure, and as a bronchodilator and antispasmodic in bronchial asthma. Epinephrine is not found in large quantities in the body, but is nevertheless very important in the maintenance of cardiovascular homeostasis because it has the ability to divert blood to tissues under stress. Epinephrine has this effect by influencing muscle contraction. Contraction of the muscles occurs through the binding calmodulin to calcium ions when the concentration is 10× larger than normal in the cell. The calcium-calmodulin complex then goes on to activate the myosin light chain kinase, which then phosphorylates the LC2 causing the contraction. Epinephrine binds to the epinephrine receptors, which activates adenylyl cyclase, and produces cyclic AMP from ATP. cAMP activates a protein kinase which thus phosphorylates the myosin light chain kinase. This phosphorylated myosin light chain kinase has a lower affinity for the calcium-calmodulin complex, and is thus inactive. As such, the smooth muscle tissue is relaxed. It is this action of epinephrine that makes it very useful in treating asthma, cardiac arrest, and anaphylactic shock. Tyrosine, as a precursor for Epinephrine, can be used for patients who are at risk for cardiac arrest, those suffering from asthma, and those who are at risk for anaphylactic shock.

Epinephrine is one of two main hormones that breakdown glycogen by binding to a receptor on exterior of a liver cell. This binding causes a conformational change to take place thereby allowing G protein to bind and become active. The activation of the G-protein coupled receptor causes a conformational change on the molecule to occur which causes adenylate cyclase to bind. Onceadenylate cyclase binds the complex, adenylate cyclase breaks down ATP into cAMP, which then becomes the second messenger protein in this process and activates protein kinase. The activated protein kinase activates phosphorylase, which is an enzyme that catalyzes breaks down the glycogen to glucose. Tyrosine, as a precursor for Epinephrine, can be used to improve athletic performance by making glucose readily available to fuel exercise.

Melanin is a metabolite of Tyrosine, and is a powerful antioxidant. Additionally, it is influential in the inhibition of the production of inflammatory cytokines and superoxide. When pro-inflammatory cytokines are overproduced, it mediates the damaging effects of inflammation in pathologic conditions like rheumatoid arthritis, graft vs. host reactions, cachexia, and sepsis syndrome. It has been found that melanin inhibits ongoing cytokine synthesis, which strongly suggests that melanin may be useful as a superimposed therapy for conditions that involve proinflammatory cytokines (Mohagheghpour N., et al., Cell Immunol. 2000 Jan. 10; 199(1):25-36).

Tyrosine can be used in the treatment of rheumatoid arthritis, cachexia, sepsis syndrome, those with inflammation related to autoimmune disorder, and other inflammatory sequela of pathologic conditions.

Phenylalanine up-regulates the activity of GTP cyclohydrolase-I, freeing tetrahydrobiopterin (THB) for NO synthesis and the hydroxylation of ArAAs by aromatic amino acid hydroxylase (AAAH). For this reason, delivery of high levels of Phenylalanine to raise cellular levels of THB directly stimulates the biosynthesis of many neurotransmitters in the CNS capillary endothelial cells. ArAAs serve as precursors for biosynthesis of monoamine neurotransmitters, including melatonin, dopamine, norepinephrine (noradrenaline), and epinephrine (adrenaline). In promoting NO synthesis, phenylalanine can be used to treat hypertension, to decrease blood pressure, and may be used in the context of diving, or those travelling to high altitudes to increase vasodilation.

Low Phenylalanine

There exists a mechanistic understanding of how uncharged tRNA allosterically activates GCN2, leading to downstream phosphorylation of transcription factors related to lipogenesis and protein synthesis, along with many biosynthetic pathways in eukaryotes (SREBP-1c, eIF2a, and GCN4p discussed below). Diets devoid of any EAAs remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Phenylalanine deprivation, through its action on GCN2, has an effect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Proline:

Citrulline is produced from Glutamine as a by-product of a reaction catalyzed by the NOS family. Dietary supplement of citrulline is known to reduce plasma levels of glucose, homocysteine, and asymmetric dimethylarginine, which are risk factors for metabolic syndrome. L-citrulline accelerates the removal of lactic acid from muscles, likely due to the effects on vascular tone and endothelial function. Recent studies have also shown that L-citrulline from watermelon juice provides greater recovery from exercise and less soreness the next day. It also appears that delivery of L-citrulline as a free form results in less uptake into cells in vitro than in the context of watermelon juice (which contains high levels of L-citrulline). This suggests an opportunity to deliver peptide doses, which can traffic arginine into muscle tissue for conversion into citrulline by eNOS at the endothelial membrane for improved efficacy.

Changes in NO synthesis and polyamines (via Proline), are seen during gestation when placental growth rate peaks, indicating a role for arginine in fetal development during pregnancy.

Serine:

Serine is a nonessential amino acid, and is biosynthesized from glycolysis via 3-phosphoglycerate. Serine plays a vital role in intermediary metabolism in that it contributes to phospholipid, sphingolipid, and cysteine biosynthesis as well as tryptophan synthesis in bacteria and is a primary source of glycine. The body has a need for glycine, which probably exceeds dietary intake by 10-50 fold. This demand is not only for the synthesis of protein, particularly collagen, but also for glycine being a precursor for 5 major metabolic biosynthetic pathways: creatine, porphyrins, purines, bile acids, and glutathione. Additionally, due to its role in glycine production, serine is also a major donor of folate-linked one-carbon units that are used in the biosynthesis of purines and 2' deoxythymidine 5'-monophosphate and the remethylation of homocystein to methionine. It is important to note that for every glycine molecule that is derived from serine, there is one-carbon unit formed. (Cook, R. Defining the steps of the folate one-carbon shuffle and homocysteine metabolism 1'2; Am. J Clin Nutr; 2000)

In one-carbon metabolism, one-carbon units for biosynthesis are carried and chemically activated by a family of cofactors called tetrahydrofolate (THF) polyglutamates. THF-mediated one-carbon metabolism is a metabolic system of interdependent biosynthetic pathways compartmentalized in the cytoplasm, the mitochondria, and the nucleus. In the cytoplasm, one-carbon metabolism is used for the synthesis of purines and thymidylates and the remethylation of homocysteine to methionine (an overabundance of homocysteine may be harmful to the body). In the mitochondria, one-carbon metabolism is used for the synthesis of formylated methionyl-tRNA; the catabolism of choline, purines, and histidine; and the interconversion of serine and glycine. Additionally, the mitochondria is the primary source for one-carbon units for cytoplasmic metabolism. Disruption of the folate-mediated one-carbon metabolism has been linked with many pathologies and developmental anomalies. (J. T. Fox and P. J. Stover, Chapter 1, Folate-Mediated One-Carbon Metabolism, In: Gerald Litwack, Editor(s), Vitamins & Hormones, Academic Press, 2008, Volume 79, Pages 1-44).

Serine hydroxymethyltransferase (SHMT) catalyzes the freely reversible interconversion of serine and glycine in a reaction that is both folate- and pyridoxal 5-phosphate dependent. The conversion of serine to glycine involves the removal of the C-3 serine and the formation of 5,10-methylenetetrahydrofolate, which can be utilized in the folate-dependent one-carbon metabolism or oxidized to carbon dioxide via 10-forylictrahydrofolate (Robert J Cook, Am J Clin Nutr December 2000 vol. 72 no. 6 1419-1420).

Serine is a precursor for cysteine. Cysteine is synthesized from homocysteine, which is itself synthesized from the metabolism of methionine. Serine is involved in cysteine's synthesis by condensing with homocysteine to form cystathionine. Cystathionine is then deaminated and hydrolyzed to form cysteine and alpha ketobutyrate. Cysteine's sulfur comes from homocysteine, but the rest of the molecule comes from the initial serine residue. The biosynthesis of cysteine occurs via a different mechanism in plants and prokaryotes. Cysteine is a vital amino acid because it plays an important role in protein folding. The disulfide linkages formed between cysteine residues helps to stabilize the tertiary and quaternary structure of proteins, and these disulfide linkages are most common among the secreted proteins, where proteins are exposed to more oxidizing conditions that are found in the cellular interior. Despite the benefits of homocysteine, high levels can be a risk factor for developing cardiovascular disease. Elevated homocysteine may be caused by a genetic deficiency of cystathionine beta-synthase and excess methionine intake may be another explanation. Control of methionine intake and supplementing with folic acid and vitamin B12 in the diet have been used to lower homocysteine levels. Likewise, increased Serine levels to support homocysteine to cysteine conversion can be beneficial.

N-methyl-D-aspartate (NMDA) is one of the most fundamental neurotransmitters in the brain. It is a glutamate receptor and is a vital molecular device for the control of synaptic plasticity and memory function. This receptor is an ionotropic receptor for glutamate and is characterized by high affinity for glutamate, a high unitary conductance, high calcium permeability, and a voltage-dependent block by magnesium ions. In order for the NMDA receptor to open, it is bound by glutamate and glycine or D-serine. D-serine is a neurotransmitter and a gliotransmitter that is biosynthesized in the brain by serine racemase from L-serine. It is a powerful or potent agonist to glycine for the NMDA receptor binding site. (Jean-Pierre Mothet, et al., Proc Natl Acad Sci USA, 2000, 97 (9) 4926-4931; Zito K and Scheuss V. (2009) NMDA Receptor Function and Physiological Modulation. In: Encyclopedia of Neuroscience (Squire L R, ed), volume 6, pp. 1157-1164. Oxford: Academic Press).

Serine plays an important role in learning and synaptic plasticity, as a result, serine supplementation can be useful to the elderly, growing children, school age children, and those experiencing learning difficulties. Additionally, it can be given to anyone trying to learn a new task, be it an instrument, or athletes/dancers trying to improve or learn new exercises and movements. Furthermore, due to its role as a precursor for cysteine, may be given as an upstream regulator for the effects of cysteine. As a precursor for the synthesis of glycine, serine may be used in cosmetic products, to combat aging, and promote proper growth because of its role in collagen synthesis. Furthermore, it can be used to improve athletic abilities because of its role in the creatine biosynthetic pathway. Moreover, it may be very useful in the detoxification and immune health because of its role in the glutathionine metabolic pathway.

Threonine:

Threonine is an EAA, and is one of the few AAs that is not converted into its L-isomer via transaminases and d-AA oxidases. Threonine is used for the synthesis of mucin protein, which is used for maintaining the integrity and function of the intestines. Mucus, which is composed of mucin and inorganic salts suspended in water, serve as a diffusion barrier against contact with noxious substances such as gastric acid and smoke. Mucus also acts as a lubricant to minimize shear stresses (G. K. Law, et al., Am J Physiol Gastroinst Liver Physiol 292:G1293-G1301, 2007).

90% of dietary threonine is used in the gut for mucus synthesis. Mucin is continuously synthesized and is very resistant to intestinal proteolysis, and is therefore not very easily recycled. As such, a substantial and consistent supply of threonine is used in order to effectively maintain gut function and structure. As a result, it is very important that the diet is rich with threonine in order to prevent mucus production from decreasing, which can lead to cancers in the gut, ulcers, etc. (G. K. Law, et al., Am J Physiol Gastroinst Liver Physiol 292:G1293-G1301, 2007; A. Hamard, et al., Journal of Nutritional Biochemistry, October 2010, Volume 21, Issue 10, Pages 914-921). Due to the importance of mucus to the integrity and structure of the gut, threonine supplementation can be useful in the prevention of gut disorder including cancers, ulcers, infections, and erosions.

Threonine plays a key role in humoral immunity because threonine is a major component of immunoglobulins, which are secreted by B lymphocytes in the blood. Once released, they reach the site of infection, recognize, bind, and inactivate their antigens. Because of the high threonine content of immunoglobulins, a threonine deficiency may have negatively affect immunoglobulin production, and thereby decrease immune response. Threonine supplementation is essential for its role in the immune response and can support leukemia patients, AIDS patients, and individuals who have immunodeficiency. Additionally, it can support those susceptible to infection during the flu season, such as the elderly and small children, as well as throughout the year to strengthen immune response.

Low Threonine

There exists a mechanistic understanding of how uncharged tRNA allosterically activates GCN2, leading to downstream phosphorylation of transcription factors related to lipogenesis, protein synthesis, along with many biosynthetic pathways in eukaryotes (SREBP-1c, eIF2a, and GCN4p discussed below). Diets devoid of any EAAs remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). An unbalanced diet lacking Threonine has been shown to signal GCN2 for rats on a basal casein diet with 1-5.4% of an amino acid mixture supplemented lacking Threonine. Threonine deprivation, through its action on GCN2, has an effect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Tryptophan:

Tryptophan is both an EAA that plays an important role in immune functions. For example, concentrations of tryptophan progressively decline due to chronic lung inflammation. This suggests that catabolism of tryptophan via the indoleamine 2,3-dioxygenase (IDO) appears to be very important for function of macrophages and lymphocytes. Thus, antranilic acid (ANS) inhibits the production of proinflammatory T-helper 1 cytokines and prevents autoimmune neuroinflammation. Tryptophan can be used to treat the inflammatory effects of certain diseases include arthritis and asthma or other autoimmune diseases.

It is also a precursor for serotonin (5-HT) synthesis, a neurotransmitter that affects appetite, sleep and is widely implicated in onset of depression. Abnormality in 5-HT activity in recovered depression patients (on SSRIs or other neurotransmitter re-uptake inhibitors) leads to an acute sensitivity to low levels of Tryptophan in the bloodstream. 5-HT production can be increased 2-fold by oral intake of free Tryptophan, indicating a role for Tryptophan administration in depression. Furthermore, Tryptophan can potentiate the effects of SSRIs due to the apparent dependence on 5-HT availability for improvement in patient outcome.

Tryptophan can furthermore be used to help in weight loss/maintenance, benefit those suffering from sleep disorders, recovery from travel and jet lag; in addition to those suffering from mood disorders like depression or the effects of PMS.

Low Tryptophan

There exists a mechanistic understanding of how uncharged tRNA allosterically activates GCN2, leading to downstream phosphorylation of transcription factors related to lipogenesis, protein synthesis, along with many biosynthetic pathways in eukaryotes (SREBP-1c, eIF2a, and GCN4p discussed below). Diets devoid of any EAAs remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Tryptophan deprivation, through its action on GCN2, has an effect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

Tyrosine:

Tyrosine is a nonessential amino acid that is synthesized from phenylalanine. It is used as a precursor for many important neurotransmitters including, epinephrine, norepinephrine, and dopamine. Tyrosine helps produce melanin, and helps the organs that make and regulate hormones, like the adrenal gland, thyroid gland, and pituitary gland. Additionally, tyrosine is involved in the structure of almost every protein in the body.

Tyrosine hydroxylase converts L-tyrosine into Levodopa using tetrahydropteridine as a cofactor or by tyrosinase. The conversion that is mediated by tyrosinase specifically oxidizes Levodopa to Dopaquinone, and levodopa is further decarboxylated to Dopamine by Dopa decarboxylase. Dopamine is a very important hormone and neurotransmitter, and plays a vital role in both mental and physical health. Dopamine helps to control the brain's reward and pleasure centers, helps to regulate movement and emotional responses, and enables one to see rewards and take action to move towards those rewards. The neurons that contain dopamine are clustered in the midbrain, in an area called the susbtantia nigra. In those afflicted with Parkinson's disease, the neurons that transmit dopamine in this area die resulting in an inability to control bodily movement. In order to relieve the symptoms of Parkinson's disease, L-Dopa, which can be converted to dopamine is given to the patients.

Tyrosine supplementation can help in the treatment of Parkinson's disease due to its role as a precursor to L-DOPA and dopamine. Additionally, it can be used in the treatment of those with emotional/psychiatric disorder like depression and in the treatment of addiction. Furthermore, it can promote learning by increasing the reward/pleasure response during learning difficult or complex concepts or movements.

Dopamine, which is a monoamine catecholamine neurotransmitter, plays a regulatory role in the immune system. Neurotransmitters and neuropeptides that interact with specific receptors present in particular immune effector cells are released by the immune system to influence the functions of these cells in the host against disease and other environmental stress. The immunoregulatory actions of dopamine have been shown to be regulated via five different G protein-coupled receptors that are present in target cells. There are two broad classes of these receptors: G1 and G2, which encompass the varying subtypes. The D1 class of receptors includes D2 and D5 subtypes, and increase intracellular cAMP upon activation. The D2 class of receptors consists of the D2, D3, and D4 subtypes, and has been reported to inhibit intracellular cAMP upon stimulation. Dopamine receptors have been found on normal human leukocytes. Likewise, the lymphoid tissues have dopaminergic innervations through sympathetic nerves, which suggests that dopamine may be able to regulate the immune system effector cells (Basu, Sujit & Sarkar, Chandrani, Dopamine and immune system. SciTopics 2010).

Dopamine affects T cells by activating the resting T cells and inhibiting the activation of stimulated T cells. In normal resting peripheral human T lymphocytes, dopamine activates the D2 and D3 subclass of receptors, which in turn activates integrins ($\alpha 4\beta 1$ and $\alpha 5\beta 1$). These integrins are hetrodimeric transmembrane glycoproteins that attach cells to the extracellular matrix component, fibronectin. Fibronectin is used for the trafficking and extravasation of T cells across the tissue barriers and blood vessels. Furthermore, dopamine acts through the D3 receptors to selectively induce the migration and homing of CD8+ T cells. Moreover, dopamine affects T cells by influencing the secretions of cytokines by the T cells. When dopamine stimulates the D3 and D1/D5 receptors, the secretion of TNF-α. (a pleiotropic inflammatory cytokine) is increased. When the D2 receptors are stimulated, IL-10 (an anti-inflammatory cytokine) is induced to secrete. Dopamine, however, can inhibit the activated T cell receptor induced cell proliferation and secretion of a number of cytokines like Il-2, IFN-γ and IL-4 through the down-regulation of the expression of non-receptor tyrosine kinases lck and fyn, which are important tyrosine kinases in the initiation of TCR activation (Basu, Sujit & Sarkar, Chandrani Dopamine and immune system. SciTopics 2010).

The B cells have a very high expression of dopamine D2, D3, and D5 receptors. Dopamine has the ability to inhibit the proliferation of the resting and the malignant B lymphocytes. Dopamine acts by promoting apoptosis in cycling B cells through oxidative stress. However, this dopaminergic action has not been observed in resting lymphocytes, therefore suggesting a role in the prevention of cancer (Basu, Sujit & Sarkar, Chandrani, Dopamine and immune system. SciTopics 2010).

Tyrosine, as a precursor for Dopamine, can be used to improve immune responses and improve the overall immune system functionality. It can provide a benefit to the elderly, women who are pregnant, children, and those with compromised immune functions like AIDS patients and cancer patients. It also can be given to teachers, those travelling, and anyone frequently exposed to germs.

NE is synthesized in the adrenal medulla and postganglionic neurons in the sympathetic nervous system by the β-oxidation of dopamine by β-hydroxylase along with the cofactor ascorbate. It works by being secreted into the synaptic cleft where it stimulates adrenergic receptors, and is then either degraded or up-taken by surrounding cells. As a cathecolamine, it does not cross the blood-brain barrier.

NE can be used to combat ADHD, depression, and hypotension. In terms of attention disorders, like ADHD, medications prescribed tend to help increase levels of NE and dopamine. Furthermore, depression is typically treated with medications that inhibit the reuptake of serotonin and NE thereby increasing the amount of serotonin and NE that is available in the postsynaptic cells in the brain. Recent evidence has suggested that SNRIs may also increase dopamine transmission because if the norepinephrine transporter ordinarily recycled dopamine as well, then SNRIs will also enhance the dopaminergic transmission. As a result, the effects antidepressants may also be associated with the increased NE levels may partly be due to the simultaneous increase in dopamine (in particular in the prefrontal cortex of the brain).

NE is used to treat patients with critical hypotension. NE is a vasopressor and acts on both α1 and α2 adrenergic receptors to cause vasoconstriction, thereby increasing the blood pressure.

As a precursor for NE, Tyrosine can be used to treat attention disorders like ADHD and ADD. Additionally, it can be used to treat those suffering from depression, posttraumatic stress syndrome, and those with acute hypotension.

Epinephrine, which is popularly known as adrenaline, is a hormone that is secreted by the medulla of the adrenal glands. Epinephrine is released in response to strong emotions such as fear or anger, which causes an increase in heart rate, muscle strength, blood pressure, and sugar metabolism. It is responsible for the flight or fight response that prepares the body for difficult or strenuous activity. Epinephrine is used as a stimulant during cardiac arrest, as a vasoconstrictor during shock to increase blood pressure, and as a bronchodilator and antispasmodic in bronchial asthma. Epinephrine is not found in large quantities in the body, but is nevertheless very important in the maintenance of cardiovascular homeostasis because it has the ability to divert blood to tissues under stress. Epinephrine has this effect by influencing muscle contraction. Contraction of the muscles occurs through the binding calmodulin to calcium ions when the concentration is 10× larger than normal in the cell. The calcium-calmodulin complex then goes on to activate the myosin light chain kinase, which then phosphorylates the LC2 causing the contraction. Epinephrine binds to the epinephrine receptors, which activates adenylyl cyclase, and produces cyclic AMP from ATP. cAMP activates a protein kinase which thus phosphorylates the myosin light chain kinase. This phosphorylated myosin light chain kinase has a lower affinity for the calcium-calmodulin complex, and is thus inactive. As such, the smooth muscle tissue is relaxed. It is this action of epinephrine that makes it very useful in treating asthma, cardiac arrest, and anaphylactic shock. Tyrosine, as a precursor for Epinephrine, can be used for patients who are at risk for cardiac arrest, those suffering from asthma, and those who are at risk for anaphylactic shock.

Epinephrine is one of two main hormones that breakdown glycogen by binding to a receptor on exterior of a liver cell. This binding causes a conformational change to take place thereby allowing G protein to bind and become active. The activation of the G-protein coupled receptor causes a conformational change on the molecule to occur which causes adenylate cyclase to bind. Once adenylate cyclase binds the complex, adenylate cyclase breaks down ATP into cAMP, which then becomes the second messenger protein in this process and activates protein kinase. The activated protein kinase activates phosphorylase, which is an enzyme that catalyzes breaks down the glycogen to glucose. Tyrosine, as a precursor for Epinephrine, can be used to improve athletic performance by making glucose readily available to fuel exercise.

Melanin is a metabolite of Tyrosine, and is a powerful antioxidant. Additionally, it is influential in the inhibition of the production of inflammatory cytokines and superoxide. When pro-inflammatory cytokines are overproduced, it mediates the damaging effects of inflammation in pathologic conditions like rheumatoid arthritis, graft vs. host reactions, cachexia, and sepsis syndrome. It has been found that melanin inhibits ongoing cytokine synthesis, which strongly suggests that melanin may be useful as a superimposed therapy for conditions that involve proinflammatory cytokines (Mohagheghpour N., et al., Cell Immunol. 2000 Jan. 10; 199(1):25-36).

Tyrosine can be used in the treatment of rheumatoid arthritis, cachexia, sepsis syndrome, those with inflammation related to autoimmune disorder, and other inflammatory sequela of pathologic conditions.

Valine:

Valine is an EAA, and is also a BCAA. The BCAAs, including valine, serve as fuel sources for skeletal muscle during periods of metabolic stress by promoting protein synthesis, suppressing protein catabolism, and serving as substrates for gluconeogenesis. The BCAAs, including valine, are substrates for glutamine synthesis in animal tissues, and it has been shown that glutamine may play a role in mediating the anabolic effect of BCAAs in animals. Such an effect is likely to be important for the lactating mammary gland because it produces more glutamine than it takes up from arterial blood. Catabolism of BCAAs in the placenta results in glutamine synthesis and its release into the fetal circulation, which is a major source of the glutamine that circulates in the fetus. This suggests that supplementing a diet with Valine as well as the other BCAAs, or a combination thereof, may increase fetal growth in mammals. Additionally, Valine plays a direct role in the synthesis of alanine, and therefore has a regulatory function with regards to alanine.

BCAAs have been shown to have anabolic effects on protein metabolism by increasing the rate of protein synthesis and decreasing the rate of protein degradation in resting human muscle. Additionally, BCAAs are shown to have anabolic effects in human muscle during post endurance exercise recovery. These effects are mediated through the phosphorylation of mTOR and sequential activation of 70-kD S6 protein kinase (p70-kD S6), and eukaryotic initiation factor 4E-binding protein 1. P70-kD S6 is known for its role in modulating cell-cycle progression, cell size, and cell survival. P70-kD S6 activation in response to mitogen stimulation up-regulates ribosomal biosynthesis and enhances the translational capacity of the cell (W-L An, et al., Am J Pathol. 2003 August; 163(2): 591-607; E. Blomstrand, et al., J. Nutr. January 2006 136: 269S-273S). Eukaryotic initiation factor 4E-binding protein 1 is a limiting component of the multi-subunit complex that recruits 40S ribosomal subunits to the 5' end of mRNAs. Activation of p70 S6 kinase, and subsequent phosphorylation of the ribosomal protein S6, is associated with enhanced translation of specific mRNAs.

BCAAs given to subjects during and after one session of quadriceps muscle resistance exercise show an increase in mTOR, p70 S6 kinase, and S6 phosphorylation was found in the recovery period after the exercise. However, there was no such effect of BCAAs on Akt or glycogen synthase kinase 3 (GSK-3). Exercise without BCAA intake leads to a partial phosphorylation of p70 S6 kinase without activating the enzyme, a decrease in Akt phosphorylation, and no change in GSK-3. BCAA infusion also increases p70 S6 kinase phosphorylation in an Akt-independent manner in resting subjects. This mTOR activity regulates cellular protein turnover (autophagy) and integrates insulin-like growth signals to protein synthesis initiation across tissues. This biology has been directly linked to biogenesis of lean tissue mass in skeletal muscle, metabolic shifts in disease states of obesity and insulin resistance, and aging.

Valine plays a key role in muscle metabolism, tissue repair, and the maintenance of proper nitrogen balance in the body. As one of the three BCAAs, it can be utilized as an energy source by muscle tissue. Valine is a glucogenic AA, and therefore provides glucose. Valine may be useful in the treatment of liver and gallbladder disease. Additionally, valine may be useful in correcting the type of severe AA deficiencies caused by drug addiction. Furthermore, Valine has been found to promote mental vigor, muscle coordination, and calm emotions. It may also be used to prevent muscle loss at high altitudes.

Valine supplementation can be used to improve athletic performance and muscle formation, aid in drug addiction rehabilitation, to enhance mental vigor in elderly and growing children, prevent muscle loss that accompanies aging, aid those suffering from hepatic disease, support the growing bodies of children, serve as a therapy for gallbladder and liver disease, to increase lactation in mammals, to increase fetal growth in mammals, and improve the nutritive quality of foods given to the starving populations.

Low Valine

In states of obesity and diabetes, animals have been shown to exhibit reduced hepatic autophagy, leading to increased insulin resistance. Autophagy is important for maintenance of the ER and cellular homeostasis, which when stressed can lead to impaired insulin sensitivity. High fat diet feeding in animal models stresses the ER, while leading to depressed hepatic autophagy through over-stimulation of mTORC1, which reinforces the progression towards insulin sensitivity impaired beta cell function in diabetes. Reducing the level of systemic Valine provides an opportunity to lower mTORC1 activity and restore healthy levels of autophagy.

There exists a mechanistic understanding of how uncharged tRNA allosterically activates GCN2, leading to downstream phosphorylation of transcription factors related to lipogenesis and protein synthesis, along with many biosynthetic pathways in eukaryotes (SREBP-1c, eIF2a, and GCN4p discussed below). Diets devoid of any EAAs remarkably trigger this signaling within minutes after diet introduction (Hao et. Al., science 2005). Signaling through SREBP-1c has been shown in vivo to have dramatic effects on mobilizing lipid stores by repressing genes related to lipogenesis. SREBP-1c has been shown to specifically act on hepatic lipid synthesis, and an ability to cause a hepatic steatosis phenotype as well as increase in visceral fat mass (Knebel, B. et. Al. Liver-Specific Expression of Transcriptionally Active SREBP-1c Is Associated with Fatty Liver and Increased Visceral Fat Mass. PLoS, 2012). Valine deprivation, through its action on GCN2, has an effect on SREBP-1c and decreased physiologic measures of liver weight (and fatty liver phenotype), adipose tissue weight, cholesterol/triglyceride content, and food intake. Driving decreased fat mass, while maintaining lean mass, provides a therapeutic opportunity in areas such as obesity, diabetes, and cardiovascular health.

In Vitro Analyses of Amino Acid Pharmacology.

As provided herein, amino acids behave both as necessary substrates for the synthesis of new proteins and also serve as signaling molecules. Analysis of the pharmacological properties of a given amino acid is dependent on the cell line and model system utilized. For example, the amino acid leucine has been shown to increase phosphorylation of the mammalian target of rapamycin complex 1 and downstream targets involved in anabolism in skeletal muscle cells (Gran P & D Cameron-Smith. 2011. The actions of exogenous leucine on mTOR signaling and amino acid transporters in human myotubes. *BMC Physiol.* 11:10). In vitro assays of amino acid pharmacology can also reveal auxotrophies in certain types of cancer. Auxotrophies to methionine have been reported in multiple immortalized cancer cell lines (Cavuoto P & MF Fenech. 2012. A review of methionine dependency and the role of methionine restriction in cancer growth control and life-span extension. *Cancer Treat Rev.* 38: 726-736).

An in vitro assay may be designed utilizing amino acids, protein digests, or di- and tri-peptides as the independent or manipulated variable after identifying a relevant cell line. An appropriate cell line is selected based on its relevance as a model of cellular processes. For example, C2C12 (ATCC, CRL-1772) is a murine myoblast cell line that differentiates into myofibers and is used as a model of skeletal muscle fiber differentiation and development. Cells are maintained in a complete medium supplemented with fetal bovine serum up to 10% which supplies necessary growth factors, and penicillin and streptomycin. Adherent cell lines are grown in T75 flasks with phenolic caps for filtered gas exchange and incubated at 37° C. at 5% $CO_2$ in a humidified environment. Table AA lists cell lines that are used to assay amino acid pharmacology. For an in vitro assay, cells are seeded in T75 flasks, 6-, 12-, 24-, 48- or 96-well plates at an appropriate cell density, determined empirically. Following an incubation period the complete growth medium is replaced with medium deficient in the test article. Following a period of medium depletion the test article is added in the appropriate medium. Following the treatment period, the relevant dependent variable is measured.

TABLE AA

List of exemplary cell lines utilized in vitro assays of amino acid pharmacology.

| Cell Line | Species | Tissue or Cell Type | Systems Modeled |
|---|---|---|---|
| C2C12 | Mus musculus | Skeletal muscle | Skeletal muscle growth and differentiation |
| RSkMC | Rattus norvegicus | Skeletal muscle | Skeletal muscle growth and differentiation |
| 3T3-L1 | Mus musculus | Embryo | White adipose tissue development |
| CHO-K1 | Cricetulus griseus | Ovary | Heterologous protein expression |
| FHs 74 Int | Homo sapiens | Small intestine | Gastrointestinal and enteroendocrine systems |
| 293T | Homo sapiens | Embryonic kidney | Heterologous protein expression |
| IEC-6 | Rattus norvegicus | Small intestine/epithelium | Gastrointestinal and enteroendocrine systems |
| NCI-H716 | Homo sapiens | Cecum | Gastrointestinal and enteroendocrine systems |
| STC-1 | Mus musculus | Intestine | Gastrointestinal and enteroendocrine systems |
| MCF-7 | Homo sapiens | Lung | Breast cancer adenocarcinoma |
| LNCaP clone FGC | Homo sapiens | Prostate | Prostate cancer carcinoma |
| PC-3 | Homo sapiens | Prostate | Prostate cancer adenocarcinoma |

See, e.g., Wu, G. Amino acids: Metabolism, functions, and nutrition. Amino Acids 37(1):1-17 (2009); Wu, G. Functional amino acids in nutrition and health. Amino Acids 45(3):407-11 (2013); Schworer, C. Glucagon-induced autophagy and proteolysis in rat liver: Mediation by selective deprivation of intracellular amino acids. PNAS 76(7): 3169-73 (1979); Codongo, P. Autophagy: A Potential Link between Obesity and Insulin Resistance. Cell Metabolism 11(6):449-51 (2010); Leong, H et. al. Short-term arginine deprivation results in large-scale modulation of hepatic gene expression in both normal and tumor cells: microarray bioinformatic analysis. Nutrition and metabolism 3:37 (2006); Harbrecht, B. G. Glutathione regulates nitric oxide synthase in cultured hepatocytes. Annals of Surgery 225(1): 76-87 (1997); Watermelon juice: a potential functional drunk for sore muscle relief in athletes. *J. Agric. Food Chem.* 61(31):7522-8 (2013).

Secreted Nutritive Polypeptides.

In another aspect, provided are nutritive polypeptides that contain the amino acid sequences of edible species polypeptides, which are engineered to be secreted from unicellular organisms and purified therefrom. Such nutritive polypeptides can be endogenous to the host cell or exogenous, and can be naturally secreted in either the polypeptide or the host cell, or both, and are engineered for secretion of the nutritive polypeptide.

Advantageous properties of a nutritive polypeptide include the ability to be expressed and secreted in a host cell, solubility in a wide variety of solvents, and when consumed by an intended subject, nutritional benefit, reduced allergenicity or nonallergenicity, lack of toxicity, and digestibility. Such properties can be weighted based, at least in part, on the intended consumer and the reason(s) for consumption of the nutritive polypeptide (e.g., for general health, muscle anabolism, immune health, or treatment or prevention of a disease, disorder or condition). One or multiple nutritional criteria are satisfied for example, by computing the mass fractions of all relevant amino acid(s) based on primary sequence.

By way of non-limiting examples, polypeptides of the present invention are provided in Table 1. The Predicted leader column shows the sequence indices of predicted leaders (if a leader exists). The Fragment Indices column shows the sequence indices of fragment sequences. The DBID column lists either the UniProt or GenBank Accession numbers for each sequence as available as of Sep. 24, 2014, each of which is herein incorporated by reference. DBIDs with only numerical characters are from a GenBank database, and those with mixed alphabetical/numerical characters are from a UniProt database.

Nucleic Acids

Also provided herein are nucleic acids encoding polypeptides or proteins. In some embodiments the nucleic acid is isolated. In some embodiments the nucleic acid is purified.

In some embodiments of the nucleic acid, the nucleic acid comprises a nucleic acid sequence that encodes a first polypeptide sequence disclosed herein. In some embodiments of the nucleic acid, the nucleic acid consists of a nucleic acid sequence that encodes a first polypeptide sequence disclosed herein. In some embodiments of the nucleic acid, the nucleic acid comprises a nucleic acid sequence that encodes a protein disclosed herein. In some embodiments of the nucleic acid, the nucleic acid consists of a nucleic acid sequence that encodes a protein disclosed herein. In some embodiments of the nucleic acid the nucleic acid sequence that encodes the first polypeptide sequence is operatively linked to at least one expression control sequence. For example, in some embodiments of the nucleic acid the nucleic acid sequence that encodes the first polypeptide sequence is operatively linked to a promoter such as a promoter described herein.

Accordingly, in some embodiments the nucleic acid molecule of this disclosure encodes a polypeptide or protein that itself is a polypeptide or protein. Such a nucleic acid molecule can be referred to as a "nucleic acid." In some embodiments the nucleic acid encodes a polypeptide or protein that itself comprises at least one of: a) a ratio of branched chain amino acid residues to total amino acid residues of at least 24%; b) a ratio of Leu residues to total amino acid residues of at least 11%; and c) a ratio of essential amino acid residues to total amino acid residues of at least 49%. In some embodiments the nucleic acid comprises at least 10 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, at least 500 nucleotides, at least 600 nucleotides, at least 700 nucleotides, at least 800 nucleotides, at least 900 nucleotides, at least 1,000 nucleotides. In some embodiments the nutritrive nucleic acid comprises from 10 to 100 nucleotides, from 20 to 100 nucleotides, from 10 to 50 nucleotides, or from 20 to 40 nucleotides. In some embodiments the nucleic acid comprises all or part of an open reading frame that encodes an edible species polypeptide or protein. In some embodiments the nucleic acid consists of an open reading frame that encodes a fragment of an edible species protein, wherein the open reading frame does not encode the complete edible species protein.

In some embodiments the nucleic acid is a cDNA.

In some embodiments nucleic acid molecules are provided that comprise a sequence that is at least 50%, 60%, 70%, 80%, 85%, 90%, 95%, 96%, 97%, 98%, 99%, or 99.9% identical to an edible species nucleic acid. In some embodiments nucleic acids are provided that hybridize under stringent hybridization conditions with at least one reference nucleic acid.

The nucleic acids and fragments thereof provided in this disclosure display utility in a variety of systems and methods. For example, the fragments can be used as probes in various hybridization techniques. Depending on the method, the target nucleic acid sequences can be either DNA or RNA. The target nucleic acid sequences can be fractionated (e.g., by gel electrophoresis) prior to the hybridization, or the hybridization can be performed on samples in situ. One of skill in the art will appreciate that nucleic acid probes of known sequence find utility in determining chromosomal structure (e.g., by Southern blotting) and in measuring gene expression (e.g., by Northern blotting). In such experiments, the sequence fragments are preferably detectably labeled, so that their specific hybridization to target sequences can be detected and optionally quantified. One of skill in the art will appreciate that the nucleic acid fragments of this disclosure can be used in a wide variety of blotting techniques not specifically described herein.

It should also be appreciated that the nucleic acid sequence fragments disclosed herein also find utility as probes when immobilized on microarrays. Methods for creating microarrays by deposition and fixation of nucleic acids onto support substrates are well known in the art. Reviewed in DNA Microarrays: A Practical Approach (Practical Approach Series), Schena (ed.), Oxford University Press (1999) (ISBN: 0199637768); Nature Genet. 21(1) (suppl):1-60 (1999); Microarray Biochip: Tools and Technology, Schena (ed.), Eaton Publishing Company/BioTechniques Books Division (2000) (ISBN: 1881299376), the disclosures of which are incorporated herein by reference in their entireties. Analysis of, for example, gene expression using microarrays comprising nucleic acid sequence fragments, such as the nucleic acid sequence fragments disclosed herein, is a well-established utility for sequence fragments in the field of cell and molecular biology. Other uses for sequence fragments immobilized on microarrays are described in Gerhold et al., Trends Biochem. Sci. 24:168-173 (1999) and Zweiger, Trends Biotechnol. 17:429-436 (1999); DNA Microarrays: A Practical Approach (Practical Approach Series), Schena (ed.), Oxford University Press (1999) (ISBN: 0199637768); Nature Genet. 21(1)(suppl):1-60 (1999); Microarray Biochip: Tools and Technology, Schena (ed.), Eaton Publishing Company/BioTechniques Books Division (2000) (ISBN: 1881299376).

Expression Vectors

Also provided are one or more vectors, including expression vectors, which comprise at least one of the nucleic acid molecules disclosed herein, as described further herein. In some embodiments, the vectors comprise at least one isolated nucleic acid molecule encoding a protein as disclosed herein. In alternative embodiments, the vectors comprise such a nucleic acid molecule operably linked to one or more expression control sequence. The vectors can thus be used to express at least one recombinant protein in a recombinant microbial host cell. In some aspects, a vector or set of vectors can include a nucleic acid sequence coding for a signal peptide, e.g., to cause secretion of a protein disclosed herein. See below for further discussion of signal peptides and secretion.

Suitable vectors for expression of nucleic acids in microorganisms are well known to those of skill in the art. Suitable vectors for use in cyanobacteria are described, for example, in Heidorn et al., "Synthetic Biology in Cyanobacteria: Engineering and Analyzing Novel Functions," Methods in Enzymology, Vol. 497, Ch. 24 (2011). Exemplary replicative vectors that can be used for engineering cyanobacteria as disclosed herein include pPMQAK1, pSL1211, pFC1, pSB2A, pSCR119/202, pSUN119/202, pRL2697, pRL25 C, pRL1050, pSG111M, and pPBH201.

Other vectors such as pJB161 which are capable of receiving nucleic acid sequences disclosed herein may also be used. Vectors such as pJB161 comprise sequences which are homologous with sequences present in plasmids endogenous to certain photosynthetic microorganisms (e.g., plasmids pAQ1, pAQ3, and pAQ4 of certain *Synechococcus* species). Examples of such vectors and how to use them is known in the art and provided, for example, in Xu et al., "Expression of Genes in Cyanobacteria: Adaptation of Endogenous Plasmids as Platforms for High-Level Gene Expression in *Synechococcus* sp. PCC 7002," Chapter 21 in Robert Carpentier (ed.), "Photosynthesis Research Protocols," Methods in Molecular Biology, Vol. 684, 2011, which is hereby incorporated herein by reference. Recombination between pJB161 and the endogenous plasmids in vivo yield engineered microbes expressing the genes of interest from their endogenous plasmids. Alternatively, vectors can be engineered to recombine with the host cell chromosome, or the vector can be engineered to replicate and express genes of interest independent of the host cell chromosome or any of the host cell's endogenous plasmids.

A further example of a vector suitable for recombinant protein production is the pET system (Novagen®). This system has been extensively characterized for use in *E. coli* and other microorganisms. In this system, target genes are cloned in pET plasmids under control of strong bacteriophage T7 transcription and (optionally) translation signals; expression is induced by providing a source of T7 RNA polymerase in the host cell. T7 RNA polymerase is so selective and active that, when fully induced, almost all of the microorganism's resources are converted to target gene expression; the desired product can comprise more than 50% of the total cell protein a few hours after induction. It is also possible to attenuate the expression level simply by lowering the concentration of inducer. Decreasing the expression level may enhance the soluble yield of some target proteins. In some embodiments this system also allows for maintenance of target genes in a transcriptionally silent un-induced state.

In some embodiments of using this system, target genes are cloned using hosts that do not contain the T7 RNA polymerase gene, thus alleviating potential problems related to plasmid instability due to the production of proteins potentially toxic to the host cell. Once established in a non-expression host, target protein expression can be initiated either by infecting the host with λCE6, a phage that carries the T7 RNA polymerase gene under the control of the λpL and pI promoters, or by transferring the plasmid into an expression host containing a chromosomal copy of the T7 RNA polymerase gene under lacUV5 control. In the second case, expression is induced by the addition of IPTG or lactose to the bacterial culture or using an autoinduction medium. Other plasmids systems that are controlled by the lac operator, but do not require the T7 RNA polymerase gene and rely upon E. coli's native RNA polymerase include the pTrc plasmid suite (Invitrogen) or pQE plamid suite (QIAGEN).

In other embodiments it is possible to clone directly into expression hosts. Two types of T7 promoters and several hosts that differ in their stringency of suppressing basal expression levels are available, providing great flexibility and the ability to optimize the expression of a wide variety of target genes.

Suitable vectors for expression of nucleic acids in mammalian cells typically comprise control functions provided by viral regulatory elements. For example, commonly used promoters are derived from polyoma virus, Adenovirus 2, cytomegalovirus, or Simian Virus 40.

Promoters

Promoters useful for expressing the recombinant genes described herein include both constitutive and inducible/repressible promoters. Examples of inducible/repressible promoters include nickel-inducible promoters (e.g., PnrsA, PnrsB; see, e.g., Lopez-Mauy et al., Cell (2002) v.43: 247-256) and urea repressible promoters such as PnirA (described in, e.g., Qi et al., Applied and Environmental Microbiology (2005) v.71: 5678-5684). Additional examples of inducible/repressible promoters include PnirA (promoter that drives expression of the nirA gene, induced by nitrate and repressed by urea) and Psuf (promoter that drives expression of the sufB gene, induced by iron stress). Examples of constitutive promoters include Pcpc (promoter that drives expression of the cpc operon), Prbc (promoter that drives expression of rubisco), PpsbAII (promoter that drives expression of PpsbAII), Pero (lambda phage promoter that drives expression of cro). In other embodiments, a PaphII and/or a lacIq-Ptrc promoter can used to control expression. Where multiple recombinant genes are expressed in an engineered microorganism, the different genes can be controlled by different promoters or by identical promoters in separate operons, or the expression of two or more genes can be controlled by a single promoter as part of an operon.

Further non-limiting examples of inducible promoters may include, but are not limited to, those induced by expression of an exogenous protein (e.g., T7 RNA polymerase, SP6 RNA polymerase), by the presence of a small molecule (e.g., IPTG, galactose, tetracycline, steroid hormone, abscisic acid), by absence of small molecules (e.g., $CO_2$, iron, nitrogen), by metals or metal ions (e.g., copper, zinc, cadmium, nickel), and by environmental factors (e.g., heat, cold, stress, light, darkness), and by growth phase. In some embodiments, the inducible promoter is tightly regulated such that in the absence of induction, substantially no transcription is initiated through the promoter. In some embodiments, induction of the promoter does not substantially alter transcription through other promoters. Also, generally speaking, the compound or condition that induces an inducible promoter is not naturally present in the organism or environment where expression is sought.

In some embodiments, the inducible promoter is induced by limitation of $CO_2$ supply to a cyanobacteria culture. By way of non-limiting example, the inducible promoter can be the promoter sequence of Synechocystis PCC 6803 that are up-regulated under the $CO_2$-limitation conditions, such as the cmp genes, ntp genes, ndh genes, sbt genes, chp genes, and rbc genes, or a variant or fragment thereof.

In some embodiments, the inducible promoter is induced by iron starvation or by entering the stationary growth phase. In some embodiments, the inducible promoter can be variant sequences of the promoter sequence of cyanobacterial genes that are up-regulated under Fe-starvation conditions such as isiA, or when the culture enters the stationary growth phase, such as isiA, phrA, sigC, sigB, and sigH genes, or a variant or fragment thereof.

In some embodiments, the inducible promoter is induced by a metal or metal ion. By way of non-limiting example, the inducible promoter can be induced by copper, zinc, cadmium, mercury, nickel, gold, silver, cobalt, and bismuth or ions thereof. In some embodiments, the inducible promoter is induced by nickel or a nickel ion. In some embodiments, the inducible promoter is induced by a nickel ion, such as $Ni^{2+}$. In another exemplary embodiment, the inducible promoter is the nickel inducible promoter from Synechocystis PCC 6803. In another embodiment, the inducible promoter can be induced by copper or a copper ion. In yet another embodiment, the inducible promoter can be induced by zinc or a zinc ion. In still another embodiment, the inducible promoter can be induced by cadmium or a cadmium ion. In yet still another embodiment, the inducible promoter can be induced by mercury or a mercury ion. In an alternative embodiment, the inducible promoter can be induced by gold or a gold ion. In another alternative embodiment, the inducible promoter can be induced by silver or a silver ion. In yet another alternative embodiment, the inducible promoter can be induced by cobalt or a cobalt ion. In still another alternative embodiment, the inducible promoter can be induced by bismuth or a bismuth ion.

In some embodiments, the promoter is induced by exposing a cell comprising the inducible promoter to a metal or metal ion. The cell can be exposed to the metal or metal ion by adding the metal to the microbial growth media. In certain embodiments, the metal or metal ion added to the microbial growth media can be efficiently recovered from the media. In other embodiments, the metal or metal ion remaining in the media after recovery does not substantially impede downstream processing of the media or of the bacterial gene products.

Further non-limiting examples of constitutive promoters include constitutive promoters from Gram-negative bacteria or a bacteriophage propagating in a Gram-negative bacterium. For instance, promoters for genes encoding highly expressed Gram-negative gene products can be used, such as the promoter for Lpp, OmpA, rRNA, and ribosomal proteins. Alternatively, regulatable promoters can be used in a strain that lacks the regulatory protein for that promoter. For instance $P_{lac}$, $P_{tac}$, and $P_{tre}$, can be used as constitutive promoters in strains that lack LacI. Similarly, P22 $P_R$ and $P_L$ can be used in strains that lack the lambda C2 repressor protein, and lambda $P_R$ and $P_L$ can be used in strains that lack the lambda C1 repressor protein. In one embodiment, the constitutive promoter is from a bacteriophage. In another embodiment, the constitutive promoter is from a Salmonella bacteriophage. In yet another embodiment, the constitutive promoter is from a cyanophage. In some embodiments, the constitutive promoter is a Synechocystis promoter. For instance, the constitutive promoter can be the PpsbAll promoter or its variant sequences, the Prbc promoter or its variant sequences, the $P_{epc}$ promoter or its variant sequences, and the PrnpB promoter or its variant sequences.

Hosts

Also provided are host cells transformed with the nucleic acid molecules or vectors disclosed herein, and descendants thereof. In some embodiments the host cells are microbial cells. In some embodiments, the host cells carry the nucleic acid sequences on vectors, which may but need not be freely replicating vectors. In other embodiments, the nucleic acids have been integrated into the genome of the host cells and/or into an endogenous plasmid of the host cells. The transformed host cells find use, e.g., in the production of recombinant proteins disclosed herein.

A variety of host microorganisms can be transformed with a nucleic acid sequence disclosed herein and can in some embodiments be used to produce a recombinant protein disclosed herein. Suitable host microorganisms include both autotrophic and heterotrophic microbes. In some applications the autotrophic microorganisms allows for a reduction in the fossil fuel and/or electricity inputs required to make a protein encoded by a recombinant nucleic acid sequence introduced into the host microorganism. This, in turn, in some applications reduces the cost and/or the environmental impact of producing the protein and/or reduces the cost and/or the environmental impact in comparison to the cost and/or environmental impact of manufacturing alternative proteins, such as whey, egg, and soy. For example, the cost and/or environmental impact of making a protein disclosed herein using a host microorganism as disclosed herein is in some embodiments lower that the cost and/or environmental impact of making whey protein in a form suitable for human consumption by processing of cow's milk.

Non-limiting examples of heterotrophs include *Escherichia coli, Salmonella typhimurium, Bacillus subtilis, Bacillus megaterium, Corynebacterium glutamicum, Streptomyces coelicolor, Streptomyces lividans, Streptomyces vanezuelae, Streptomyces roseosporus, Streptomyces fradicte, Streptomyces griseus, Streptomyces calvuligerus, Streptomyces hygroscopicus, Streptomyces platensis, Saccharopolyspora erythraea, Corynebacterium glutamicum, Aspergillus niger, Aspergillus nidulans, Aspergillus oryzae, Aspergillus terreus, Aspergillus sojae, Penicillium chrysogenum, Trichoderma reesei, Clostridium acetobutylicum, Clostridium beijerinckii, Clostridium thermocellum, Fusibacter paucivorans, Saccharomyces cerevisiae, Saccharomyces boulardii, Pichia pastoris*, and *Pichia stipitis*.

Photoautotrophic microorganisms include eukaryotic algae, as well as prokaryotic cyanobacteria, green-sulfur bacteria, green non-sulfur bacteria, purple sulfur bacteria, and purple non-sulfur bacteria. Extremophiles are also contemplated as suitable organisms. Such organisms are provided, e.g., in Mixotrophic organisms are also suitable organisms. Algae and cyanobacteria are contemplated as suitable organisms. See the organisms disclosed in, e.g., PCT/US2013/032232, filed Mar. 15, 2013, PCT/US2013/032180, filed Mar. 15, 2013, PCT/US2013/032225, filed Mar. 15, 2013, PCT/US2013/032218, filed Mar. 15, 2013, PCT/US2013/032212, filed Mar. 15, 2013, PCT/US2013/032206, filed Mar. 15, 2013, and PCT/US2013/038682, filed Apr. 29, 2013

Yet other suitable organisms include synthetic cells or cells produced by synthetic genomes as described in Venter et al. US Pat. Pub. No. 2007/0264688, and cell-like systems or synthetic cells as described in Glass et al. US Pat. Pub. No. 2007/0269862.

Still other suitable organisms include *Escherichia coli, Acetobacter aceti, Bacillus subtilis*, yeast and fungi such as *Clostridium ljungdahlii, Clostridium thermocellum, Penicillium chrysogenum, Pichia pastoris, Saccharomyces cerevisiae, Schizosaccharomyces pombe, Pseudomonas fluorescens*, or *Zymomonas mobilis*. In some embodiments those organisms are engineered to fix carbon dioxide while in other embodiments they are not.

In some embodiments eukaryotic cells, such as insect cells or mammalian cells, such as human cells are used as host cells. Vectors and expression control sequences including promoters and enhancers are well known for such cells. Examples of useful mammalian host cell lines for this purpose are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

Transfection

Proteins can be produced in a host cell using, for example, a combination of recombinant DNA techniques and gene transfection methods as is well known in the art (e.g., Morrison, S. (1985) Science 229:1202). For expression of the protein, the expression vector(s) encoding the protien is transfected into a host cell by standard techniques. The various forms of the term transfection are intended to encompass a wide variety of techniques commonly used for the introduction of exogenous DNA into a prokaryotic or eukaryotic host cell, e.g., electroporation, calcium-phosphate precipitation, DEAE-dextran transfection and the like.

Production

Skilled artisans are aware of many suitable methods available for culturing recombinant cells to produce (and optionally secrete) a protein as disclosed herein, as well as for purification and/or isolation of expressed proteins. The methods chosen for protein purification depend on many variables, including the properties of the protein of interest, its location and form within the cell, the vector, host strain background, and the intended application for the expressed protein. Culture conditions can also have an effect on solubility and localization of a given target protein. Many approaches can be used to purify target proteins expressed in recombinant microbial cells as disclosed herein, including without limitation ion exchange and gel filtration.

In some embodiments a peptide fusion tag is added to the recombinant protein making possible a variety of affinity purification methods that take advantage of the peptide fusion tag. In some embodiments, the use of an affinity method enables the purification of the target protein to near homogeneity in one step. Purification may include cleavage of part or all of the fusion tag with enterokinase, factor Xa, thrombin, or HRV 3C proteases, for example. In some embodiments, before purification or activity measurements of an expressed target protein, preliminary analysis of expression levels, cellular localization, and solubility of the target protein is performed. The target protein can be found in any or all of the following fractions: soluble or insoluble cytoplasmic fractions, periplasm, or medium. Depending on the intended application, preferential localization to inclusion bodies, medium, or the periplasmic space can be advantageous, in some embodiments, for rapid purification by relatively simple procedures.

While *Escherichia coli* is widely regarded as a robust host for heterologous protein expression, it is also widely known that over-expression of many proteins in this host is prone to aggregation in the form of insoluble inclusion bodies. One of the most commonly used methods for either rescuing inclusion body formation, or to improve the titer of the protein itself, is to include an amino-terminal maltose-binding protein (MBP) (Austin B P, Nallamsetty S, Waugh D S. Hexahistidine-tagged maltose-binding protein as a fusion partner for the production of soluble recombinant proteins in *Escherichia coli*. Methods Mol Biol. 2009; 498:157-72), or small ubiquitin-related modifier (SUMO) (Saitoh H, Uwada J, Azusa K. Strategies for the expression of SUMO-modified target proteins in *Escherichia coli*. Methods Mol Biol. 2009; 497:211-21; Malakhov M P, Mattern M R, Malakhova O A, Drinker M, Weeks S D, Butt T R. SUMO fusions and SUMO-specific protease for efficient expression and purification of proteins. J Struct Funct Genomics. 2004; 5(1-2):75-86; Panavas T, Sanders C, Butt T R. SUMO fusion technology for enhanced protein production in prokaryotic and eukaryotic expression systems. Methods Mol Biol. 2009; 497:303-17) fusion to the protein of interest. These two proteins are expressed extremely well, and in the soluble form, in *Escherichia coli* such that the protein of interest is also effectively produced in the soluble form. The protein of interest can be cleaved by designing a site specific protease recognition sequence (such as the tobacco etch virus (TEV) protease) in-between the protein of interest and the fusion protein. In some embodiments, a protein of interest can be present in an inclusion body; in some aspects the inclusion body can be formulated for delivery to a subject. Formulation is discussed in further detail below.

In some embodiments the protein is initially not folded correctly or is insoluble. A variety of methods are well known for refolding of insoluble proteins. Most protocols comprise the isolation of insoluble inclusion bodies by centrifugation followed by solubilization under denaturing conditions. The protein is then dialyzed or diluted into a non-denaturing buffer where refolding occurs. Because every protein possesses unique folding properties, the optimal refolding protocol for any given protein can be empirically determined by a skilled artisan. Optimal refolding conditions can, for example, be rapidly determined on a small scale by a matrix approach, in which variables such as protein concentration, reducing agent, redox treatment, divalent cations, etc., are tested. Once the optimal concentrations are found, they can be applied to a larger scale solubilization and refolding of the target protein.

In some embodiments the protein does not comprise a tertiary structure. In some embodiments less than half of the amino acids in the protein participate in a tertiary structure. In some embodiments the protein does not comprise a secondary structure. In some embodiments less than half of the amino acids in the protein participate in a secondary structure. Recombinant proteins can be isolated from a culture of cells expressing them in a state that comprises one or more of these structural features. In some embodiments the tertiary structure of a recombinant protein is reduced or eliminated after the protein is isolated from a culture producing it. In some embodiments the secondary structure of a recombinant protein is reduced or eliminated after the protein is isolated from a culture producing it.

In some embodiments a CAPS buffer at alkaline pH in combination with N-lauroylsarcosine is used to achieve solubility of the inclusion bodies, followed by dialysis in the presence of DTT to promote refolding. Depending on the target protein, expression conditions, and intended application, proteins solubilized from washed inclusion bodies can be >90% homogeneous and may not require further purification. Purification under fully denaturing conditions (before refolding) is possible using His.Tag® fusion proteins and His.Bind® immobilized metal affinity chromatography (Novogen®). In addition, S.Tag™, T7.Tag®, and Strep.Tag® II fusion proteins solubilized from inclusion bodies using 6 M urea can be purified under partially denaturing conditions by dilution to 2 M urea (S.Tag and T7.Tag) or 1 M urea (Strep.Tag 11) prior to chromatography on the appropriate resin. Refolded fusion proteins can be affinity purified under native conditions using His.Tag, S.Tag, Strep.Tag II, and other appropriate affinity tags (e.g., GST.Tag™, and T7.Tag) (Novogen®).

In some embodiments the protein is an endogenous protein of the host cell used to express it. That is, the cellular genome of the host cell comprises an open reading frame that encodes the recombinant protein. In some embodiments regulatory sequences sufficient to increase expression of the protein are inserted into the host cell genome and operatively linked to the endogenous open reading frame such that the regulatory sequences drive overexpression of the recombinant protein from a recombinant nucleic acid. In some embodiments heterologous nucleic acid sequences are fused to the endogenous open reading frame of the protein and cause the protein to be synthesized comprising a hetgerologous amino acid sequence that changes the cellular trafficking of the recombinant protein, such as directing it to an organelle or to a secretion pathway. In some embodiments an open reading frame that encodes the endogeneous host cell protein is introduced into the host cell on a plasmid that further comprises regulatory sequences operatively linked to the open reading frame. In some embodiments the recombinant host cell expresses at least 2 times, at least 3 times, at least 4 times, at least 5 times, at least 10 times, or at least 20 times, at least 30 times, at least 40 times, at least 50 times, or at least 100 times more of the recombinant protein than the amount of the protein produced by a similar host cell grown under similar conditions.

Production of Recombinant Proteins in Plants

Nutritive polypeptides can be produced recombinantly from plants, including but not limited to those organisms and methods of production disclosed in PCT/US2013/032232, filed Mar. 15, 2013, PCT/US2013/032180, filed Mar. 15, 2013, PCT/US2013/032225, filed Mar. 15, 2013, PCT/US2013/032218, filed Mar. 15, 2013, PCT/US2013/032212, filed Mar. 15, 2013, PCT/US2013/032206, filed Mar. 15, 2013, and PCT/US2013/038682, filed Apr. 29, 2013 and any phylogenetically related organisms, and other methods of production known in the art.

Purification

Secreted

It is generally recognized that nearly all secreted bacterial proteins, and those proteins from other unicellular hosts, are synthesized as pre-proteins that contain N-terminal sequences known as signal peptides. These signal peptides influence the final destination of the protein and the mechanisms by which they are transported. Most signal peptides can be placed into one of four groups based on their translocation mechanism (e.g., Sec- or Tat-mediated) and the type of signal peptidase used to cleave the signal peptide from the preprotein. Also provided are N-terminal signal peptides containing a lipoprotein signal peptide. Although proteins carrying this type of signal are transported via the Sec translocase, their peptide signals tend to be shorter than normal Sec-signals and they contain a distinct sequence motif in the C-domain known as the lipo box (L(AS)(GA)C) at the −3 to +1 position. The cysteine at the +1 position is lipid modified following translocation whereupon the signal sequence is cleaved by a type II signal peptidase. Also provided are type IV or prepilin signal peptides, wherein type IV peptidase cleavage domains are localized between the N- and H-domain rather than in the C-domain common in other signal peptides.

As provided herein, the signal peptides can be attached to a heterologous polypeptide sequence (i.e., different than the protein the signal peptide is derived or obtained from) containing a nutritive polypeptide, in order to generate a recombinant nutritive polypeptide sequence. Alternatively, if a nutritive polypeptide is naturally secreted in the host organism, it can be sufficient to use the native signal sequence or a variety of signal sequences that directs secretion. In some embodiments of the nutritive polypeptides, the heterologous nutritive polypeptide sequence attached to the carboxyl terminus of the signal peptide is an edible species eukaryotic protein, a mutein or derivative thereof, or a polypeptide nutritional domain. In other embodiments of the polypeptide, the heterologous nutritive polypeptide sequence attached to the carboxyl terminus of the signal peptide is an edible species intracellular protein, a mutein or derivative thereof, or a polypeptide nutritional domain.

Purification of Nutritive Polypeptides.

Also provided are methods for recovering the secreted nutritive polypeptide from the culture medium. In some embodiments the secreted nutritive polypeptide is recovered from the culture medium during the exponential growth phase or after the exponential growth phase (e.g., in pre-stationary phase or stationary phase). In some embodiments the secreted nutritive polypeptide is recovered from the culture medium during the stationary phase. In some embodiments the secreted nutritive polypeptide is recovered from the culture medium at a first time point, the culture is continued under conditions sufficient for production and secretion of the recombinant nutritive polypeptide by the microorganism, and the recombinant nutritive polypeptide is recovered from the culture medium at a second time point. In some embodiments the secreted nutritive polypeptide is recovered from the culture medium by a continuous process. In some embodiments the secreted nutritive polypeptide is recovered from the culture medium by a batch process. In some embodiments the secreted nutritive polypeptide is recovered from the culture medium by a semi-continuous process. In some embodiments the secreted nutritive polypeptide is recovered from the culture medium by a fed-batch process. Those skilled in the art are aware of many suitable methods available for culturing recombinant cells to produce (and optionally secrete) a recombinant nutritive polypeptide as disclosed herein, as well as for purification and/or isolation of expressed recombinant polypeptides. The methods chosen for polypeptide purification depend on many variables, including the properties of the polypeptide of interest. Various methods of purification are known in the art including diafiltration, precipitation, and chromatography.

Non-Secreted

In some aspects, proteins can be isolated in the absence of secretion. For example, a cell having the protein (e.g., on the cell surface or intracellularly) can be lysed and the protein can be purified using standard methods such as chromatography or antibody-based isolation of the protein from the lysate. In some aspects, a cell surface expressed protein can be enzymatically cleaved from the surface.

Isolation of Nutritive Polypeptides from Biological Materials from Edible Species In some embodiments a nutritive polypeptide having a desired amino acid or plurality of amino acids, which are optionally present in a desired amino acid sequence, is isolated or purified from a food source, or from a biological material from an edible species. For example, a biological material of a plant includes nuts, seeds, leaves, and roots; a biological material of a mammal includes milk, muscle, sera, and liver. Isolation methods include solubilization, chromatography, and precipitation.

Nutritive polypeptides are isolated from biological materials by specific solubilization of the targeted nutritive polypeptide. The biological material is suspended and homogenized in a solubilization solution. The solubilization solution is selected based on the nutritive polypeptides physiochemical properties. Composition of the solubilization solution is a mixture of water, detergent, salt, pH, chaotrope, cosmotrope, and/or organic solvent. As an example, proteins high in proline are known to be soluble in ethanol solutions (Dickey, L. C., et al. Industrial Crops and Products 10.2 (1999): 137-143.). A nutritive polypeptide with high proline content is selected and isolated by suspending the biological material in ethanol at a ratio (w/w) of liquid to biological material of 1:1, 2:1, 3:1, 4:1 or other ratio recognized in the art. The suspension is blended and insoluble material is removed by centrifugation. The ethanol soluble nutritive polypeptide is purified solubly in the ethanol fraction.

Nutritive polypeptides are isolated from biological materials by precipitation of the targeted nutritive polypeptide or precipitation of other proteins. Precipitating agents include salt, pH, heat, flocculants, chaotropes, cosmotropes, and organic solvents. The mode of precipitation is selected for a given nutritive polypeptide based on the proteins physiochemical properties. As an example, a nutritive polypeptide is selected to be thermal stable at pH 7 by low solvation score and low aggregation score as described herein. To purify this protein the biological material is suspended in a neutral pH aqueous solution and homogenized. Insoluble material is removed from solution by centrifugation. To purify the nutritive polypeptide from other proteins, the supernatant is heated to 90 degrees C. for 10 minutes. Insoluble material is removed by centrifugation. Small molecules are removed from the supernatant by dialyzing using a 3 kDa membrane, resulting in pure nutritive polypeptide.

Nutritive polypeptides are isolated from biological materials by various chromatographic methods. The mode of chromatography selected for use depends on the physicochemical properties of the target nutritive polypeptide. Charged nutritive polypeptides bind to ion exchange chromatography resin through electrostatic interactions. Hydrophobic nutritive polypeptides bind to hydrophobic interaction chromatography resin through hydrophobic association. Mixed-mode chromatography can be used for a variety of nutritive polypeptides, and can act through a variety of interactions. Metal affinity chromatography can be used for nutritive polypeptides that bind to metal ions. As an example, a nutritive polypeptide is selected to have a high charge per amino acid at pH 4 so that it binds tightly to a cation-exchange resin. The biological material is added to a low ionic strength pH 4 aqueous solution and homogenized. Insoluble material is removed by centrifugation. The soluble material is added to a cation exchange resin, such as POROS® XS Strong Cation Exchange Resin from Life Technologies, and washed with a low ionic strength pH4 solution. The nutritive polypeptide is eluted from the resin by adding high ionic strength (eg. 500 mM NaCl) pH 4 solution, resulting in purified nutritive polypeptide.

Synthetic Nutritive Polypeptide Amino Acid Compositions

In some embodiments compositions of this disclosure contain a plurality of free amino acids that represents the molar ratio of the plurality of amino acids present in a selected nutritive polypeptide, herein termed a "nutritive polypeptide blend". The compositions in certain embodiments include both free amino acids and nutritive polypeptides. As used herein in these embodiments, disclosure of a nutritive polypeptide and compositions and formulations containing the nutritive polypeptide includes disclosure of a nutritive polypeptide blend and compositions and formulations containing the nutritive polypeptide blend, as well as a composition in which a first amount of amino acids are present in the form of a nutritive polypeptide and a second amount of amino acids are present in free amino acid form.

Synthetic Methods of Production

In some embodiments proteins of this disclosure are synthesized chemically without the use of a recombinant production system. Protein synthesis can be carried out in a liquid-phase system or in a solid-phase system using techniques known in the art (see, e.g., Atherton, E., Sheppard, R. C. (1989). Solid Phase peptide synthesis: a practical approach. Oxford, England: IRL Press; Stewart, J. M., Young, J. D. (1984). Solid phase peptide synthesis (2nd ed.). Rockford: Pierce Chemical Company.

Peptide chemistry and synthetic methods are well known in the art and a protein of this disclosure can be made using any method known in the art. A non-limiting example of such a method is the synthesis of a resin-bound peptide (including methods for deprotection of amino acids, methods for cleaving the peptide from the resin, and for its purification).

For example, Fmoc-protected amino acid derivatives that can be used to synthesize the peptides are the standard recommended: Fmoc-Ala-OH, Fmoc-Arg(Pbp-OH, Fmoc-Asn(Trt)-OH, Fmoc-Asp(OtBu)-OH, Fmoc-Cys(Trt)-OH, Fmoc-Gln(Trt)-OH, Fmoc-Glu(OtBu)-OH, Fmoc-Gly-OH, Fmoc-His(Trt)-OH, Fmoc-Ile-OH, Fmoc-Leu-OH, Fmoc-Lys(BOC)-OH, Fmoc-Met-OH, Fmoc-Phe-OH, Fmoc-Pro-OH, Fmoc-Ser(tBu)-OH, Fmoc-Thr(tBu)-OH, Fmoc-Trp (BOC)-OH, Fmoc-Tyr(tBu)-OH and Fmoc-Val-OH (supplied from, e.g., Anaspec, Bachem, Iris Biotech, or NovabioChem). Resin bound peptide synthesis is performed, for example, using Fmoc based chemistry on a Prelude Solid Phase Peptide Synthesizer from Protein Technologies (Tucson, Ariz. 85714 U.S.A.). A suitable resin for the preparation of C-terminal carboxylic acids is a pre-loaded, low-load Wang resin available from NovabioChem (e.g. low load fmoc-Thr(tBu)-Wang resin, LL, 0.27 mmol/g). A suitable resin for the synthesis of peptides with a C-terminal amide is PAL-ChemMatrix resin available from Matrix-Innovation. The N-terminal alpha amino group is protected with Boc.

Fmoc-deprotection can be achieved with 20% piperidine in NMP for 2×3 min. The coupling chemistry is DIC/HOAt/collidine in NMP. Amino acid/HOAt solutions (0.3 M/0.3 M in NMP at a molar excess of 3-10 fold) are added to the resin followed by the same molar equivalent of DIC (3 M in NMP) followed by collidine (3 M in NMP). For example, the following amounts of 0.3 M amino acid/HOAt solution are used per coupling for the following scale reactions: Scale/ml, 0.05 mmol/1.5 mL, 0.10 mmol/3.0 mL, 0.25 mmol/7.5 mL. Coupling time is either 2×30 min or 1×240 min. After synthesis the resin is washed with DCM, and the peptide is cleaved from the resin by a 2-3 hour treatment with TFA/TIS/water (95/2.5/2.5) followed by precipitation with diethylether. The precipitate is washed with diethylether. The crude peptide is dissolved in a suitable mixture of water and MeCN such as water/MeCN (4:1) and purified by reversed-phase preparative HPLC (Waters Deltaprep 4000 or Gilson) on a column containing C18-silica gel. Elution is performed with an increasing gradient of MeCN in water containing 0.1% TFA. Relevant fractions are checked by analytical HPLC or UPLC. Fractions containing the pure target peptide are mixed and concentrated under reduced pressure. The resulting solution is analyzed (HPLC, LCMS) and the product is quantified using a chemiluminescent nitrogen specific HPLC detector (Antek 8060 HPLC-CLND) or by measuring UV-absorption at 280 nm. The product is dispensed into glass vials. The vials are capped with Millipore glassfibre prefilters. Freeze-drying affords the peptide trifluoroacetate as a white solid. The resulting peptides can be detected and characterized using LCMS and/or UPLC, for example, using standard methods known in the art. LCMS can be performed on a setup consisting of Waters Acquity UPLC system and LCT Premier XE mass spectrometer from Micromass. The UPLC pump is connected to two eluent reservoirs containing: A) 0.1% Formic acid in water; and B) 0.1% Formic acid in acetonitrile. The analysis is performed at RT by injecting an appropriate volume of the sample (preferably 2-10 µl) onto the column which is eluted with a gradient of A and B. The UPLC conditions, detector settings and mass spectrometer settings are: Column: Waters Acquity UPLC BEH, C-18, 1.7 µm, 2.1 mm×50 mm. Gradient: Linear 5%-95% acetonitrile during 4.0 min (alternatively 8.0 min) at 0.4 ml/min. Detection: 214 nm (analogue output from TUV (Tunable UV detector)). MS ionisation mode: API-ES Scan: 100-2000 amu (alternatively 500-2000 amu), step 0.1 amu. UPLC methods are well known. Non-limiting examples of methods that can be used are described at pages 16-17 of US 2013/0053310 A1, published Feb. 28, 2013, for example.

Inactivating Enzyme Activity

In some aspects, a protein is an enzyme or has enzymatic activity. In some aspects, it can be desirable to inactivate or reduce the enzymatic activity of the enzyme. Various methods are known in the art for enzyme inactivation including application of heat, application of one or more detergents, application of one or more metal chelators, reduction, oxidation, application of one or more chaotropes, covalent modification, alterating post translational modifications, e.g., via enzymatic or chemical alteration, altering pH (acidic and basic), or altering the salt concentration. For example, heat inactivation is typically performed at a certain temperature for a certain amount of time, e.g., most endonucleases are inactivated by incubation at 65° C. for 20 minutes. In some aspects, enzymes can be mutated to eliminate or reduce enzymatic activity, e.g., by causing the enzyme to misfold. In addition, high pressure carbon dioxide (HPCD) has been demonstrated to an effective non-thermal processing technique for inactivating enzymes. See Hu et al., Enzyme Inactivation in Food Processing using High Pressure Carbon Dioxide Technology; Critical Review in Food Science and Nutrition; Volume 52, Issue 2, 2013. Various other forms of enzyme inactivation are known in the art, the parameters of which can be adjusted as needed to alter enzyme activity accordingly. Various methods for enzyme inactivation and excipients such as oxidation, e.g., bleach, $H_2O_2$, and ethylene oxide; to reduce disulphides, e.g., DTT, BME, and TCEP; high pH using $Na_2CO_3$, Tris Base, or $Na_2HPO_4$; low pH using Citric Acid, Boric Acid, Acetic Acid, or Tris HCl; Heat using temperatures 30° C.-100° C. over a period of time; protein unfolding with chaotropes such as Thiocyanate, Urea, Guanidine HCl, or $CaCl_2$; protein unfold with surfactants (e.g., detergents) such as MPD, Triton (non-ionic), CHAPS (zwitterionic), or Tween (non-ionic), or to chelate metals with EDTA or Citrate.

Cell Proliferation Assays

Cell proliferation assays can be used to measure the relative importance of a protein or portion thereof to the proliferative process. In some aspects, cell proliferation can be measured under starvation conditions in the presence or absence of a protein or interest. For example, cells can be starved over a period of time (e.g., 48 hours) with a medium having or lacking each, respective protein of interest in a tissue culture incubator. After the incubation, a detection agent such as AlamarBlue can be added and fluorescence measured as an output for proliferation. In some aspects, cell proliferation can be measured as part of a dose response to a protein of interest. For example, cells can be starved in medium having or lacking each, respective protein of interest in a tissue culture incubator. After starvation, the cells can then be treated with varying concentrations of the protein (e.g., 0, 20, 100, or 1000 μM) that was lacking in the initial culture in the same, source medium lacking the respective protein. The cells can then be incubated again in a for tissue culture incubator. After the incubation a detection agent such as AlamarBlue can be added and fluorescence read.

Allergenicity Assays

For some embodiments it is preferred that the protein not exhibit inappropriately high allergenicity. Accordingly, in some embodiments the potential allergenicy of the protein is assessed. This can be done by any suitable method known in the art. In some embodiments an allergenicity score is calculated. The allergenicity score is a primary sequence based metric based on WHO recommendations (fao.org/ag/agn/food/pdf/allergygm.pdf) for assessing how similar a protein is to any known allergen, the primary prediction being that high percent identity between a target and a known allergen is likely indicative of cross reactivity. For a given protein, the likelihood of eliciting an allergic response can be assessed via one or both of a complimentary pair of sequence homology based tests. The first test determines the protein's percent identity across the entire sequence via a global-global sequence alignment to a database of known allergens using the FASTA algorithm with the BLOSUM50 substitution matrix, a gap open penalty of 10, and a gap extension penalty of 2. It has been suggested that proteins with less than 50% global homology are unlikely to be allergenic (Goodman R. E. et al. Allergenicity assessment of genetically modified cropswhat makes sense? Nat. Biotech. 26, 73-81 (2008); Aalberse R. C. Structural biology of allergens. J. Allergy Clin. Immunol. 106, 228-238 (2000)).

In some embodiments of a protein, the protein has less than 50% global homology to any known allergen in the database used for the analysis. In some embodiments a cutoff of less than 40% homology is used. In some embodiments a cutoff of less than 30% homology is used. In some embodiments a cutoff of less than 20% homology is used. In some embodiments a cutoff of less than 10% homology is used. In some embodiments a cutoff of from 40% to 50% is used. In some embodiments a cutoff of from 30% to 50% is used. In some embodiments a cutoff of from 20% to 50% is used. In some embodiments a cutoff of from 10% to 50% is used. In some embodiments a cutoff of from 5% to 50% is used. In some embodiments a cutoff of from 0% to 50% is used. In some embodiments a cutoff of greater than 50% global homology to any known allergen in the database used for the analysis is used. In some embodiments a cutoff of from 50% to 60% is used. In some embodiments a cutoff of from 50% to 70% is used. In some embodiments a cutoff of from 50% to 80% is used. In some embodiments a cutoff of from 50% to 90% is used. In some embodiments a cutoff of from 55% to 60% is used. In some embodiments a cutoff of from 65% to 70% is used. In some embodiments a cutoff of from 70% to 75% is used. In some embodiments a cutoff of from 75% to 80% is used.

The second test assesses the local allergenicity along the protein sequence by determining the local allergenicity of all possible contiguous 80 amino acid fragments via a global-local sequence alignment of each fragment to a database of known allergens using the FASTA algorithm with the BLOSUM50 substitution matrix, a gap open penalty of 10, and a gap extension penalty of 2. The highest percent identity of any 80 amino acid window with any allergen is taken as the final score for the protein of interest. The WHO guidelines suggest using a 35% identity cutoff with this fragment test. In some embodiments of a protein, all possible fragments of the protein have less than 35% local homology to any known allergen in the database used for the analysis using this test. In some embodiments a cutoff of less than 30% homology is used. In some embodiments a cutoff of from 30% to 35% homology is used. In some embodiments a cutoff of from 25% to 30% homology is used. In some embodiments a cutoff of from 20% to 25% homology is used. In some embodiments a cutoff of from 15% to 20% homology is used. In some embodiments a cutoff of from 10% to 15% homology is used. In some embodiments a cutoff of from 5% to 10% homology is used. In some embodiments a cutoff of from 0% to 5% homology is used. In some embodiments a cutoff of greater than 35% homology is used. In some embodiments a cutoff of from 35% to 40% homology is used. In some embodiments a cutoff of from 40% to 45% homology is used. In some embodiments a cutoff of from 45% to 50% homology is used. In some embodiments a cutoff of from 50% to 55% homology is used. In some embodiments a cutoff of from 55% to 60% homology is used. In some embodiments a cutoff of from 65% to 70% homology is used. In some embodiments a cutoff of from 70% to 75% homology is used. In some embodiments a cutoff of from 75% to 80% homology is used.

Skilled artisans are able to identify and use a suitable database of known allergens for this purpose. In some embodiments the database is custom made by selecting proteins from more than one database source. In some embodiments the custom database comprises pooled allergen lists collected by the Food Allergy Research and Resource Program (allergenonline.org/), UNIPROT annotations (uniprot.org/docs/allergen), and the Structural Database of Allergenic Proteins (SDAP, fermi.utmb.edu/SDAP/sdapink.html). This database includes all currently recognized allergens by the International Union of Immunological Socieities (IUIS, allergen.org/) as well as a large number of additional allergens not yet officially named. In some embodiments the database comprises a subset of known allergen proteins available in known databases; that is, the database is a custom selected subset of known allergen proteins. In some embodiments the database of known allergens comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known allergens comprises from 100 to 500 proteins, from 200 to 1,000 proteins, from 500 to 1,000 proteins, from 500 to 1,000 proteins, or from 1,000 to 2,000 proteins.

In some embodiments all (or a selected subset) of contiguous amino acid windows of different lengths (e.g., 70, 60, 50, 40, 30, 20, 10, 8 or 6 amino acid windows) of a protein are tested against the allergen database and peptide sequences that have 100% identity, 95% or higher identity, 90% or higher identity, 85% or higher identity, 80% or higher identity, 75% or higher identity, 70% or higher identity, 65% or higher identity, 60% or higher identity, 55% or higher identity, or 50% or higher identity matches are identified for further examination of potential allergenicity.

Another method of predicting the allergenicity of a protein is to assess the homology of the protein to a protein of human origin. The human immune system is exposed to a multitude of possible allergenic proteins on a regular basis and has the intrinsic ability to differentiate between the host body's proteins and exogenous proteins. The exact nature of this ability is not always clear, and there are many diseases that arise as a result of the failure of the body to differentiate self from non-self (e.g., arthritis). Nonetheless, the fundamental analysis is that proteins that share a degree of sequence homology to human proteins are less likely to elicit an immune response. In particular, it has been shown that for some protein families with known allergenic members (tropomyosins, parvalbumins, caseins), those proteins that bear more sequence homology to their human counterparts relative to known allergenic proteins, are not thought to be allergenic (Jenkins J. A. et al. Evolutionary distance from human homologs reflects allergenicity of animal food proteins. J. Allergy Clin Immunol. 120 (2007): 1399-1405). For a given protein, a human homology score is measured by determining the maximum percent identity of the protein to a database of human proteins (e.g., the UNIPROT database) from a global-local alignment using the FASTA algorithm with the BLOSUM50 substitution matrix, a gap open penalty of 10, and a gap extension penalty of 2. According to Jenkins et al. (Jenkins J. A. et al. Evolutionary distance from human homologs reflects allergenicity of animal food proteins. J. Allergy Clin Immunol. 120 (2007): 1399-1405) proteins with a sequence identity to a human protein above about 62% are less likely to be allergenic. Skilled artisans are able to identify and use a suitable database of known human proteins for this purpose, for example, by searching the UNIPROT database (uniprot.org). In some embodiments the database is custom made by selecting proteins from more than one database source. Of course the database may but need not be comprehensive. In some embodiments the database comprises a subset of human proteins; that is, the database is a custom selected subset of human proteins. In some embodiments the database of human proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins. In some embodiments the database comprises at least 90%, at least 95%, or at least 99% of all known human proteins.

In some embodiments of a protein, the protein is at least 20% homologous to a human protein. In some embodiments a cutoff of at least 30% homology is used. In some embodiments a cutoff of at least 40% homology is used. In some embodiments a cutoff of at least 50% homology is used. In some embodiments a cutoff of at least 60% homology is used. In some embodiments a cutoff of at least 70% homology is used. In some embodiments a cutoff of at least 80% homology is used. In some embodiments a cutoff of at least 62% homology is used. In some embodiments a cutoff of from at least 20% homology to at least 30% homology is used. In some embodiments a cutoff of from at least 30% homology to at least 40% homology is used. In some embodiments a cutoff of from at least 50% homology to at least 60% homology is used. In some embodiments a cutoff of from at least 60% homology to at least 70% homology is used. In some embodiments a cutoff of from at least 70% homology to at least 80% homology is used.

Theromostability Assays

As used herein, a "stable" protein is one that resists changes (e.g., unfolding, oxidation, aggregation, hydrolysis, etc.) that alter the biophysical (e.g., solubility), biological (e.g., digestibility), or compositional (e.g. proportion of Leucine amino acids) traits of the protein of interest.

Protein stability can be measured using various assays known in the art and proteins disclosed herein and having stability above a threshold can be selected. In some embodiments a protein is selected that displays thermal stability that is comparable to or better than that of whey protein. Thermal stability is a property that can help predict the shelf life of a protein. In some embodiments of the assay stability of protein samples is determined by monitoring aggregation formation using size exclusion chromatography (SEC) after exposure to extreme temperatures. Aqueous samples of the protein to be tested are placed in a heating block at 90° C. and samples are taken after 0, 1, 5, 10, 30 and 60 min for SEC analysis. Protein is detected by monitoring absorbance at 214 nm, and aggregates are characterized as peaks eluting faster than the protein of interest. No overall change in peak area indicates no precipitation of protein during the heat treatment. Whey protein has been shown to rapidly form 80% aggregates when exposed to 90° C. in such an assay.

In some embodiments the thermal stability of a protein is determined by heating a sample slowly from 25° C. to 95° C. in presence of a hydrophobic dye (e.g., ProteoStat® Thermal shift stability assay kit, Enzo Life Sciences) that binds to aggregated proteins that are formed as the protein denatures with increasing temperature (Niesen, F. H., Berglund, H. & Vadadi, M., 2007. The use of differential scanning fluorimetry to detect ligand interactions that promote protein stability. Nature Protocols, Volume 2, pp. 2212-2221). Upon binding, the dye's fluorescence increases significantly, which is recorded by an rtPCR instrument and represented as the protein's melting curve (Lavinder, J. J., Hari, S. B., Suillivan, B. J. & Magilery, T. J., 2009. High-Throughput Thermal Scanning: A General, Rapid Dye-Binding Thermal Shift Screen for Protein Engineering. Journal of the American Chemical Society, pp. 3794-3795). After the thermal shift is complete, samples are examined for insoluble precipitates and further analyzed by analytical size exclusion chromatography (SEC).

Solubility Assays

In some embodiments of the proteins disclosed herein the protein is soluble. Solubility can be measured by any method known in the art. In some embodiments solubility is examined by centrifuge concentration followed by protein concentration assays. Samples of proteins in 20 mM HEPES pH 7.5 are tested for protein concentration according to protocols using two methods, Coomassie Plus (Bradford) Protein Assay (Thermo Scientific) and Bicinchoninic Acid (BCA) Protein Assay (SigmadAldrich). Based on these measurements 10 mg of protein is added to an Amicon Ultra 3 kDa centrifugal filter (Millipore). Samples are concentrated by centrifugation at 10,000×g for 30 minutes. The final, now concentrated, samples are examined for precipitated protein and then tested for protein concentration as above using two methods, Bradford and BCA.

In some embodiments the proteins have a final solubility limit of at least 5 g/L, 10 g/L, 20 g/L, 30 g/L, 40 g/L, 50 g/L, or 100 g/L at physiological pH. In some embodiments the proteins are greater than 50%, greater than 60%, greater than 70%, greater than 80%, greater than 90%, greater than 95%, greater than 96%, greater than 97%, greater than 98%, greater than 99%, or greater than 99.5% soluble with no precipitated protein observed at a concentration of greater than 5 g/L, or 10 g/L, or 20 g/L, or 30 g/L, or 40 g/L, or 50 g/L, or 100 g/L at physiological pH. In some embodiments, the solubility of the protein is higher than those typically reported in studies examining the solubility limits of whey (12.5 g/L; Pelegrine et al., Lebensm.-Wiss. U.-Technol. 38 (2005) 77-80) and soy (10 g/L; Lee et al., JAOCS 80(1) (2003) 85-90).

Eukaryotic proteins are often glycosylated, and the carbohydrate chains that are attached to proteins serve various functions. N-linked and O-linked glycosylation are the two most common forms of glycosylation occurring in proteins. N-linked glycosylation is the attachment of a sugar molecule to a nitrogen atom in an amino acid residue in a protein. N-linked glycosylation occurs at Asparagine and Arginine residues. O-linked glycosylation is the attachment of a sugar molecule to an oxygen atom in an amino acid residue in a protein. O-linked glycosylation occurs at Threonine and Serine residues.

Glycosylated proteins are often more soluble than their un-glycosylated forms. In terms of protein drugs, proper glycosylation usually confers high activity, proper antigen binding, better stability in the blood, etc. However, glycosylation necessarily means that a protein "carries with it" sugar moieties. Such sugar moieties may reduce the usefulness of the proteins of this disclosure including recombinant proteins. For example, as demonstrated in the examples, a comparison of digestion of glycosylated and non-glycosylated forms of the same proteins shows that the non-glycosylated forms are digested more quickly than the glycosylated forms. For these reasons, in some embodiments the nutritive proteins according to the disclosure comprise low or no glycosylation. For example, in some embodiments the proteins comprise a ratio of non-glycosylated to total amino acid residues of at least 80%, at least 85%, at least 90%, at least 95%, at least 96%, at least 97%, at least 98%, or at least 99%. In some embodiments the proteins to not comprise any glycosylation.

In some embodiments, the protein according to the disclosure is deglycosylated after it is produced or after it is isolated. Proteins of low or no glycosylation can be made by any method known in the art. For example, enzymatic and/or chemical methods can be used (Biochem. J. (2003) 376, p339-350.). Enzymes are produced commercially at research scales for the removal of N-linked and O-linked oligosaccharides. Chemical methods include use of trifluoromethanesulfonic acid to selectively break N-linked and O-linked peptide-saccharide bonds. This method often results in a more complete deglycosylation than does the use of enzymatic methods.

In other embodiments, the protein according to the disclosure is produced with low or no glycosylation by a host organism. Most bacteria and other prokaryotes have very limited capabilities to glycosylate proteins, especially heterologous proteins. Accordingly, in some embodiments of this disclosure a protein is made recombinantly in a microorganism such that the level of glycosylation of the recombinant protein is low or no glycosylation. In some embodiments the level of glycosylation of the recombinant protein is lower than the level of glycosylation of the protein as it occurs in the organism from which it is derived. Glycosylation of a protein can vary based on the host organism, in other words some hosts will produce more glycosylation relative to one or more other hosts; while other hosts will produce less g glycosylation relative to one or more other hosts. Differences in the amount of glycosylation can be measured based upon, e.g., the mass of glycosylation present and/or the total number of glycosylation sites present.

Toxicity and Anti-Nutricity Assays

For most embodiments it is preferred that the protein not exhibit inappropriately high toxicity. Accordingly, in some embodiments the potential toxicity of the protein is assessed. This can be done by any suitable method known in the art. In some embodiments a toxicity score is calculated by determining the protein's percent identity to databases of known toxic proteins (e.g., toxic proteins identified from the UNIPROT database). A global-global alignment of the protein of interest against the database of known toxins is performed using the FASTA algorithm with the BLOSUM50 substitution matrix, a gap open penalty of 10, and a gap extension penalty of 2. In some embodiments of a protein, the protein is less than 35% homologous to a known toxin. In some embodiments a cutoff of less than 35% homology is used. In some embodiments a cutoff of from 30% to 35% homology is used. In some embodiments a cutoff of from 25% to 35% homology is used. In some embodiments a cutoff of from 20% to 35% homology is used. In some embodiments a cutoff of from 15% to 35% homology is used. In some embodiments a cutoff of from 10% to 35% homology is used. In some embodiments a cutoff of from 5% to 35% homology is used. In some embodiments a cutoff of from 0% to 35% homology is used. In some embodiments a cutoff of greater than 35% homology is used. In some embodiments a cutoff of from 35% to 40% homology is used. In some embodiments a cutoff of from 35% to 45% homology is used. In some embodiments a cutoff of from 35% to 50% homology is used. In some embodiments a cutoff of from 35% to 55% homology is used. In some embodiments a cutoff of from 35% to 60% homology is used. In some embodiments a cutoff of from 35% to 70% homology is used. In some embodiments a cutoff of from 35% to 75% homology is used. In some embodiments a cutoff of from 35% to 80% homology is used. Skilled artisans are able to identify and use a suitable database of known toxins for this purpose, for example, by searching the UNIPROT database (uniprot.org). In some embodiments the database is custom made by selecting proteins identified as toxins from more than one database source. In some embodiments the database comprises a subset of known toxic proteins; that is, the database is a custom selected subset of known toxic proteins. In some embodiments the database of toxic proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins.

Anti-Nutricity and Anti-Nutrients

For some embodiments it is preferred that the protein not exhibit anti-nutritional activity ("anti-nutricity"), i.e., proteins that have the potential to prevent the absorption of nutrients from food. Examples of anti-nutritive sequences causing such anti-nutricity include protease inhibitors, which inhibit the actions of trypsin, pepsin and other proteases in the gut, preventing the digestion and subsequent absorption of protein.

Disclosed herein are formulations containing isolated nutritive polypeptides that are substantially free of anti-nutritive sequences. In some embodiments the nutritive polypeptide has an anti-nutritive similarity score below about 1, below about 0.5, or below about 0.1. The nutritive polypeptide is present, in the formulation in an amount greater than about 10 g, and the formulation is substantially free of anti-nutritive factors. The formulation is present as a liquid, semi-liquid or gel in a volume not greater than about 500 ml or as a solid or semi-solid in a mass not greater than about 200 g. The nutritive polypeptide may have low homology with a protease inhibitor, such as a member of the serpin family of polypeptides, e.g., it is less than 90% identical, or is less than 85%, 80%, 75%, 70%, 65%, 60%, 55%, 50%, 45%, 40%, 35%, 30%, 25%, 20%, 15%, 0.10%, 5%, or less than 5% identical.

Accordingly, in some embodiments the potential anti-nutricity of the protein is assessed. This can be done by any suitable method known in the art. In some embodiments an anti-nutricity score is calculated by determining the protein's percent identity to databases of known protease inhibitors (e.g., protease inhibitors identified from the UNIPROT database). A global-global alignment of the protein of interest against the database of known protease inhibitors is performed using the FASTA algorithm with the BLOSUM50 substitution matrix, a gap open penalty of 10, and a gap extension penalty of 2, to identify whether the protein is homologous to a known anti-protein. In some embodiments of a protein, the protein has less than 35% global homology to any known anti-protein (e.g., any known protease inhibitor) in the database used for the analysis. In some embodiments a cutoff of less than 35% identify is used. In some embodiments a cutoff of from 30% to 35% is used. In some embodiments a cutoff of from 25% to 35% is used. In some embodiments a cutoff of from 20% to 35% is used. In some embodiments a cutoff of from 15% to 35% is used. In some embodiments a cutoff of from 10% to 35% is used. In some embodiments a cutoff of from 5% to 35% is used. In some embodiments a cutoff of from 0% to 35% is used. In some embodiments a cutoff of greater than 35% identify is used. In some embodiments a cutoff of from 35% to 40% is used. In some embodiments a cutoff of from 35% to 45% is used. In some embodiments a cutoff of from 35% to 50% is used. In some embodiments a cutoff of from 35% to 55% is used. In some embodiments a cutoff of from 35% to 60% is used. In some embodiments a cutoff of from 35% to 70% is used. In some embodiments a cutoff of from 35% to 75% is used. In some embodiments a cutoff of from 35% to 80% is used. Skilled artisans are able to identify and use a suitable database of known protease inhibitors for this purpose, for example, by searching the UNIPROT database (uniprot.org). In some embodiments the database is custom made by selecting proteins identified protease-inhibitors as from more than one database source. In some embodiments the database comprises a subset of known protease inhibitors available in databases; that is, the database is a custom selected subset of known protease inhibitor proteins. In some embodiments the database of known protease inhibitor proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known protease inhibitor proteins comprises from 100 to 500 proteins, from 200 to 1,000 proteins, from 500 to 1,000 proteins, from 500 to 1,000 proteins, or from 1,000 to 2,000 proteins, or from 2,000 to 3,000 proteins.

In other embodiments a protein that does exhibit some degree of protease inhibitor activity is used. For example, in some embodiments such a protein can be useful because it delays protease digestion when the nutritive protein is consumed such that the protein traverse a greater distance within the GI tract before it is digested, thus delaying absorption. For example, in some embodiments the protein inhibits gastric digestion but not intestinal digestion. Delaney B. et al. (Evaluation of protein safety in the context of agricultural biotechnology. Food. Chem. Toxicol. 46 (2008: S71-S97)) suggests that one should avoid both known toxic and anti-proteins when assessing the safety of a possible food protein. In some embodiments of a protein, the protein has a favorably low level of global homology to a database of known toxic proteins and/or a favorably low level of global homology to a database of known anti-nutricity proteins (e.g., protease inhibitors), as defined herein.

Antinutrients.

Provided are nutritional compositions that lack anti-nutrients (or antinutrients). Antinutrients are compounds, usually other than proteins, which are typically found in plant foods and have been found to have both adverse effects and, in some situations, certain health benefits. For instance, phytic acid, lectins, phenolic compounds, saponins, and enzyme inhibitors have been shown to reduce the availability of nutrients and to cause the inhibition of growth, and phytoestrogens and lignans have been linked with infertility problems. On the other hand, phytic acid, lectins, phenolic compounds, amylase inhibitors, and saponins have been shown to reduce the blood glucose and insulin response to starch foods and/or the plasma cholesterol and triglycerides. Furthermore, phytic acid, phenolics, saponins, protease inhibitors, phytoestrogens, and lignans have been linked to reduced cancer risks.

Provided are methods for reducing the amount of anti-nutritional factors in a food product, by treating the food product with a thermal treatment comprising steam or hot air having a temperature greater than about 90 degrees C. for at least 1 minute, combining with the treated food product with a composition containing an isolated nutritive polypeptide. Optionally, the step of thermal treatment degrades at least one anti-nutritional factor such as a saponin, a lectin, and a prolamin, a protease inhibitor, or phytic acid.

Anti-nutritional factors are detected in a protein composition as follows. Phytic acid: The procedure of Wheeler and Ferrel (Wheeler, E. L., Ferrel, R. E., Cereal Chem. 1971, 48, 312) is used for the determination of phytic acid extracted in 3% trichloroacetic acid. Raffinose family oligosaccharides: Protein samples are extracted with 70% ethanol using Soxhlet apparatus for 6-8 h and thin-layer chromatography is used for the quantitative determination of raffinose and stachyose in the extract according to the procedure of Tanaka et al. (Tanaka, M., Thananunkul, D., Lee, T. C., Chichester, C. O., J. Food Sci. 1975, 40, 1087-1088). Trypsin inhibitor: The method of Kakade et al. (Kakade, M. L., Rackis, J. J., McGhee, J. E., Puski, G., Cereal Chem. 1974, 51, 376-82) is used for determining the trypsin inhibitor activity in raw and treated samples. One trypsin inhibitor unit (TIU) is defined as a decrease in absorbance at 410 nm by 0.01 in 10 min and data were expressed as TIU*mg-1. Amylase inhibitor: The inhibitor is extracted in 0.15 m NaCl according to the procedure of Baker et al. (Baker, J. E., Woo, S. M., Throne, J. E., Finny, P. L., Environm. Entomol. 1991, 20, 53±60) and assayed by the method of Huesing et al. (Huesing, J. E., Shade, R. E., Chrispeels, M. J., Murdok, L. L., Plant Physiol. 1991, 96, 993±996). One amylase inhibitor unit (AIU) is defined as the amount that gives 50% inhibition of a portion of the amylase that produced one mg maltose monohydrate per min. Lectins: The procedure of Paredes-Lopez et al. (Paredes-Lopez, O., Schevenin, M. L., Guevara-Lara, F., Food Chem. 1989, 31, 129-137) is applied to the extraction of lectins using phosphate-buffered saline (PBS). The hemagglutinin activity (HA) of lectins in the sample extract is determined according to Kortt (Kortt, A. A. (Ed.), Eur. J. Biochem. 1984, 138, 519). Trypsinized human red blood cell (A, B and O) suspensions are prepared according to Lis and Sharon (Lis, H., Sharon, N., Methods Enzymol. 1972, 28, 360±368). HA is expressed as the reciprocal of the highest dilution giving positive agglutination. Tannins: The tannin contents are determined as tannic acid by Folin-Denis reagent according to the procedure of the AOAC (Helrich, K. (Ed.), AOAC, Official Methods of Analysis, Association of Official Analytical Chemists, Arlington, Va. 1990)

Charge Assays and Salvation Scoring

One feature that can enhance the utility of a protein is its charge (or per amino acid charge). Proteins with higher charge can in some embodiments exhibit desirable characteristics such as increased solubility, increased stability, resistance to aggregation, and desirable taste profiles. For example, a charged protein that exhibits enhanced solubility can be formulated into a beverage or liquid formulation that includes a high concentration of protein in a relatively low volume of solution, thus delivering a large dose of protein nutrition per unit volume. A charged protein that exhibits enhanced solubility can be useful, for example, in sports drinks or recovery drinks wherein a user (e.g., an athlete) wants to ingest protein before, during or after physical activity. A charged protein that exhibits enhanced solubility can also be particularly useful in a clinical setting wherein a subject (e.g., a patient or an elderly person) is in need of protein nutrition but is unable to ingest solid foods or large volumes of liquids.

For example, the net charge (ChargeP) of a polypeptide at pH 7 can be calculated using the following formula:

$$ChargeP = -0.002 - (C)(0.045) - (D)(0.999) - (E)(0.998) + (H)(0.091) + (K)(1.0) + (R)(1.0) - (Y)(-0.001)$$

where C is the number of cysteine residues, D is the number of aspartic acid residues, E is the number of glutamic acid residues, H is the number of histidine residues, K is the number of lysine residues, R is the number of arginine residues and Y is the number of tyrosine residues in the polypeptide. The per amino acid charge (ChargeA) of the polypeptide can be calculated by dividing the net charge (ChargeP) by the number of amino acid residues (N), i.e., ChargeA=ChargeP/N. (See Bassi S (2007), "A Primer on Python for Life Science Researchers." PLoS Comput Biol 3(11): e199. doi:10.1371/journal.pcbi.0030199).

One metric for assessing the hydrophilicity and potential solubility of a given protein is the solvation score. Solvation score is defined as the total free energy of solvation (i.e. the free energy change associated with transfer from gas phase to a dilute solution) for all amino acid side chains if each residue were solvated independently, normalized by the total number of residues in the sequence. The side chain solvation free energies are found computationally by calculating the electrostatic energy difference between a vacuum dielectric of 1 and a water dielectric of 80 (by solving the Poisson-Boltzmann equation) as well as the non-polar, Van der Waals energy using a linear solvent accessible surface area model (D. Sitkoff, K. A. Sharp, B. Honig. "Accurate Calculation of Hydration Free Energies Using Macroscopic Solvent Models". J. Phys. Chem. 98, 1994). For amino acids with ionizable sidechains (Arg, Asp, Cys, Glu, His, Lys and Tyr), an average solvation free energy is used based on the relative probabilities for each ionization state at the specified pH. Solvation scores start at 0 and continue into negative values, and the more negative the solvation score, the more hydrophilic and potentially soluble the protein is predicted to be. In some embodiments of a protein, the protein has a solvation score of −10 or less at pH 7. In some embodiments of a protein, the protein has a solvation score of −15 or less at pH 7. In some embodiments of a protein, the protein has a solvation score of −20 or less at pH 7. In some embodiments of a protein, the protein has a solvation score of −25 or less at pH 7. In some embodiments of a protein, the protein has a solvation score of −30 or less at pH 7. In some embodiments of a protein, the protein has a solvation score of −35 or less at pH 7. In some embodiments of a protein, the protein has a solvation score of −40 or less at pH 7.

The solvation score is a function of pH by virtue of the pH dependence of the molar ratio of undissociated weak acid ([HA]) to conjugate base ([A-]) as defined by the Henderson-Hasselbalch equation:

$$pH = pKa + \log(([A^-])/([HA]))$$

All weak acids have different solvation free energies compared to their conjugate bases, and the solvation free energy used for a given residue when calculating the solvation score at a given pH is the weighted average of those two values.

Accordingly, in some embodiments of a protein, the protein has a solvation score of −10 or less at an acidic pH. In some embodiments of a protein, the protein has a solvation score of −15 or less at an acidic pH. In some embodiments of a protein, the protein has a solvation score of −20 or less at an acidic pH. In some embodiments of a protein, the protein has a solvation score of −25 or less at an acidic pH. In some embodiments of a protein, the protein has a solvation score of −30 or less at an acidic pH. In some embodiments of a protein, the protein has a solvation score of −35 or less at an acidic pH. In some embodiments of a protein, the protein has a solvation score of −40 or less at acidic pH.

Accordingly, in some embodiments of a protein, the protein has a solvation score of −10 or less at a basic pH. In some embodiments of a protein, the protein has a solvation score of −15 or less at a basic pH. In some embodiments of a protein, the protein has a solvation score of −20 or less at a basic pH. In some embodiments of a protein, the protein has a solvation score of −25 or less at a basic pH. In some embodiments of a protein, the protein has a solvation score of −30 or less at a basic pH. In some embodiments of a protein, the protein has a solvation score of −35 or less at a basic pH. In some embodiments of a protein, the protein has a solvation score of −40 or less at basic pH.

Accordingly, in some embodiments of a protein, the protein has a solvation score of −10 or less at a pH range selected from 2-3, 3-4, 4-5, 5-6, 6-7, 7-8, 8-9, 9-10, 10-11, and 11-12. In some embodiments of a protein, the protein has a solvation score of −15 or less at a pH range selected from 2-3, 3-4, 4-5, 5-6, 6-7, 7-8, 8-9, 9-10, 10-11, and 11-12. In some embodiments of a protein, the protein has a solvation score of −20 or less at a pH range selected from 2-3, 3-4, 4-5, 5-6, 6-7, 7-8, 8-9, 9-10, 10-11, and 11-12. In some embodiments of a protein, the protein has a solvation score of −25 or less at a pH range selected from 2-3, 3-4, 4-5, 5-6, 6-7, 7-8, 8-9, 9-10, 10-11, and 11-12. In some embodiments of a protein, the protein has a solvation score of −30 or less at a pH range selected from 2-3, 3-4, 4-5, 5-6, 6-7, 7-8, 8-9, 9-10, 10-11, and 11-12. In some embodiments of a protein, the protein has a solvation score of −35 or less at a pH range selected from 2-3, 3-4, 4-5, 5-6, 6-7, 7-8, 8-9, 9-10, 10-11, and 11-12. In some embodiments of a protein, the protein has a solvation score of −40 or less at a pH range selected from 2-3, 3-4, 4-5, 5-6, 6-7, 7-8, 8-9, 9-10, 10-11, and 11-12.

Aggregation Assays and Aggregation Scoring

In some embodiments a protein of this disclosure shows resistance to aggregation, exhibiting, for example, less than 80% aggregation, 10% aggregation, or no detectable aggregation at elevated temperatures (e.g., 50° C., 60° C., 70° C., 80° C., 85° C., 90° C., or 95° C.).

One benefit of stable proteins as disclosed herein is that they can be able to be stored for an extended period of time before use, in some instances without the need for refrigeration or cooling. In some embodiments, proteins are processed into a dry form (e.g., by lyophilization). In some embodiments, proteins are stable upon lyophilization. In some embodiments, such lyophilized proteins maintain their stability upon reconstitution (e.g., liquid formulation).

The aggregation score is a primary sequence based metric for assessing the hydrophobicity and likelihood of aggregation of a given protein. Using the Kyte and Doolittle hydrophobity scale (Kyte J, Doolittle R F (May 1982) "A simple method for displaying the hydropathic character of a protein". J. Mol. Biol. 157 (1): 105-32), which gives hydrophobic residues positive values and hydrophilic residues negative values, the average hydrophobicity of a protein sequence is calculated using a moving average of five residues. The aggregation score is drawn from the resulting plot by determining the area under the curve for values greater than zero and normalizing by the total length of the protein. The underlying view is that aggregation is the result of two or more hydrophobic patches coming together to exclude water and reduce surface exposure, and the likelihood that a protein will aggregate is a function of how densely packed its hydrophobic (i.e., aggregation prone) residues are. Aggregation scores start at 0 and continue into positive values, and the smaller the aggregation score, the less hydrophobic and potentially less prone to aggregation the protein is predicted to be. In some embodiments of a protein, the protein has an aggregation score of 2 or less. In some embodiments of a protein, the protein has an aggregation score of 1.5 or less. In some embodiments of a protein, the protein has an aggregation score of 1 or less. In some embodiments of a protein, the protein has an aggregation score of 0.9 or less. In some embodiments of a protein, the protein has an aggregation score of 0.8 or less. In some embodiments of a protein, the protein has an aggregation score of 0.7 or less. In some embodiments of a protein, the protein has an aggregation score of 0.6 or less. In some embodiments of a protein, the protein has an aggregation score of 0.5 or less. In some embodiments of a protein, the protein has an aggregation score of 0.4 or less. In some embodiments of a protein, the protein has an aggregation score of 0.3 or less. In some embodiments of a protein, the protein has an aggregation score of 0.2 or less. In some embodiments of a protein, the protein has an aggregation score of 0.1 or less.

In some cases, soluble expression is desirable because it can increase the amount and/or yield of the protein and facilitate one or more of the isolation and purification of the protein. In some embodiments, the proteins of this disclosure are solubly expressed in the host organism. Solvation score and aggregation score can be used to predict soluble expression of recombinant proteins in a host organism. As shown in Example R, this disclosure provides evidence suggesting that proteins with solvation scores of ≤−20 and aggregation scores of ≤0.75 are more likely to be recombinantly expressed in a particular *E. coli* expression system. Moreover, the data also suggests that proteins with solvation scores of ≤−20 and aggregation scores of ≤0.5 are more likely to be solubly expressed in this system. Therefore, in some embodiments the protein of this disclosure has a solvation score of −20 or less. In some embodiments the nutritive protein has an aggregation score of 0.75 or less. In some embodiments the nutritive protein has an aggregation score of 0.5 or less. In some embodiments the protein has a solvation score of −20 or less and an aggregation score of 0.75 or less. In some embodiments the protein has a solvation score of −20 or less and an aggregation score of 0.5 or less.

Taste and Mouth Characteristics

Certain free amino acids and mixtures of free amino acids are known to have a bitter or otherwise unpleasant taste. In addition, hydrolysates of common proteins (e.g., whey and soy) often have a bitter or unpleasant taste. In some embodiments, proteins disclosed and described herein do not have a bitter or otherwise unpleasant taste. In some embodiments, proteins disclosed and described herein have a more acceptable taste as compared to at least one of free amino acids, mixtures of free amino acids, and/or protein hydrolysates. In some embodiments, proteins disclosed and described herein have a taste that is equal to or exceeds at least one of whey protein.

Proteins are known to have tastes covering the five established taste modalities: sweet, sour, bitter, salty, and umami. Fat can be considered a sixth taste. The taste of a particular protein (or its lack thereof) can be attributed to several factors, including the primary structure, the presence of charged side chains, and the electronic and conformational features of the protein. In some embodiments, proteins disclosed and described herein are designed to have a desired taste (e.g., sweet, salty, umami) and/or not to have an undesired taste (e.g., bitter, sour). In this context "design"

includes, for example, selecting edible species proteins embodying features that achieve the desired taste property, as well as creating muteins of edible species polypeptides that have desired taste properties. For example, proteins can be designed to interact with specific taste receptors, such as sweet receptors (T1R2-T1R3 heterodimer) or umami receptors (T1R1-T1R3 heterodimer, mGluR4, and/or mGluR1). Further, proteins can be designed not to interact, or to have diminished interaction, with other taste receptors, such as bitter receptors (T2R receptors).

Proteins disclosed and described herein can also elicit different physical sensations in the mouth when ingested, sometimes referred to as "mouth feel." The mouth feel of the proteins can be due to one or more factors including primary structure, the presence of charged side chains, and the electronic and conformational features of the protein. In some embodiments, proteins elicit a buttery or fat-like mouth feel when ingested.

Nutritive Compositions and Formulations

At least one protein disclosed herein can be combined with at least one second component to form a composition. In some embodiments the only source of amino acid in the composition is the at least one protein disclosed herein. In such embodiments the amino acid composition of the composition will be the same as the amino acid composition of the at least one protein disclosed herein. In some embodiments the composition comprises at least one protein disclosed herein and at least one second protein. In some embodiments the at least one second protein is a second protein disclosed herein, while in other embodiments the at least one second protein is not a protein disclosed herein. In some embodiments the composition comprises 1, 2, 3, 4, 5, 6, 7, 8, 9, 10, 11, 12, 13, 14, 15, 16, 17, 18, 19, 20 or more proteins disclosed herein. In some embodiments the composition comprises 0, 1, 2, 3, 4, 5, 6, 7, 8, 9, 10, 11, 12, 13, 14, 15, 16, 17, 18, 19, 20 or more proteins that are not proteins disclosed herein. In some embodiments the composition comprises 1, 2, 3, 4, 5, 6, 7, 8, 9, 10, 11, 12, 13, 14, 15, 16, 17, 18, 19, 20 or more proteins and the composition comprises 0, 1, 2, 3, 4, 5, 6, 7, 8, 9, 10, 11, 12, 13, 14, 15, 16, 17, 18, 19, 20 or more proteins that are not proteins disclosed herein.

Also provided are formulations containing the nutritive polypeptides described herein. In one aspect, provided is a formulation containing a unicellular organism secreted polypeptide nutritional domain. For example, the polypeptide nutritional domain contains an amino acid sequence having an N-terminal amino acid that does not correspond to the N-terminal amino acid of an amino acid sequence comprising a unicellular organism secreted polypeptide that contains the polypeptide nutritional domain. In some embodiments the amino acid sequence comprising the unicellular organism secreted polypeptide is an edible species polypeptide sequence, and the N-terminal amino acid is a common edible species amino acid. In addition or in the alternative, the polypeptide nutritional domain contains an amino acid sequence having a C-terminal amino acid that does not correspond to the C-terminal amino acid of an amino acid sequence comprising a unicellular organism secreted polypeptide that contains the polypeptide nutritional domain. In some embodiments the amino acid sequence comprising the unicellular organism secreted polypeptide is an edible species polypeptide sequence, and the C-terminal amino acid is a common edible species amino acid. Thus, in some embodiments the secreted polypeptide nutritional domain is at least one amino acid shorter than a homologous edible species polypeptide. The nutritional domain can be about 99%, 98%, 97%, 96%, 95%, 90%, 85%, 80%, 75%, 70%, 65%, 60%, 55%, 50%, 45%, 40%, 35%, 30%, 25%, 20%, 15%, 10%, 5% or less than 5% the length of a homologous edible species peptide. In other embodiments, the polypeptide nutritional domain consists of from about 1% to about 99% of the unicellular organism secreted polypeptide that contains the polypeptide nutritional domain. As described herein, the polypeptide nutritional domain is generally preferred to the larger polypeptide containing the polypeptide nutritional domain. A polypeptide nutritional domain may contain, on a mass basis, more nutrition than the larger including polypeptide. In some embodiments, a polypeptide nutritional domain may provide desirable features when compared to the larger including polypeptide, such as increased solubility and better shelf-life stability.

In some embodiments the composition as described in the preceding paragraph, further comprises at least one of at least one polypeptide, at least one peptide, and at least one free amino acid. In some embodiments the composition comprises at least one polypeptide and at least one peptide. In some embodiments the composition comprises at least one polypeptide and at least one free amino acid. In some embodiments the composition comprises at least one peptide and at least one free amino acid. In some embodiments the at least one polypeptide, at least one peptide, and/or at least one free amino acid comprises amino acids selected from 1) branched chain amino acids, 2) leucine, and 3) essential amino acids. In some embodiments the at least one polypeptide, at least one peptide, and/or at least one free amino acid consists of amino acids selected from 1) branched chain amino acids, 2) leucine, and 3) essential amino acids. In some embodiments, the composition comprises at least one modified amino acid or a non-standard amino acid. Modified amino acids include amino acids that have modifications to one or more of the carboxy terminus, amino terminus, and/or side chain. Non-standard amino acids can be selected from those that are formed by post-translational modification of proteins, for example, carboxylated glutamate, hydroxyproline, or hypusine. Other non-standard amino acids are not found in proteins. Examples include lanthionine, 2-aminoisobutyric acid, dehydroalanine, gamma-aminobutyric acid, ornithine and citrulline. In some embodiments, the composition comprises one or more D-amino acids. In some embodiments, the composition comprises one or more L-amino acids. In some embodiments, the composition comprises a mixture of one or more D-amino acids and one or more L-amino acids.

By adding at least one of a polypeptide, a peptide, and a free amino acid to a composition the proportion of at least one of branched chain amino acids, leucine, and essential amino acids, to total amino acid, present in the composition can be increased.

In some embodiments the composition comprises at least one carbohydrate. A "carbohydrate" refers to a sugar or polymer of sugars. The terms "saccharide," "polysaccharide," "carbohydrate," and "oligosaccharide" can be used interchangeably. Most carbohydrates are aldehydes or ketones with many hydroxyl groups, usually one on each carbon atom of the molecule. Carbohydrates generally have the molecular formula $C_nH_{2n}O_n$. A carbohydrate can be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments the composition comprises at least one lipid. As used herein a "lipid" includes fats, oils, triglycerides, cholesterol, phospholipids, fatty acids in any form including free fatty acids. Fats, oils and fatty acids can be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments the composition comprises at least one supplemental vitamin. The at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments the composition comprises at least one organism. Suitable examples are well known in the art and include probiotics (e.g., species of *Lactobacillus* or *Bifidobacterium*), *spirulina*, *chlorella*, and *porphyra*.

In some embodiments the composition comprises at least one dietary supplement. Suitable examples are well known in the art and include herbs, botanicals, and certain hormones. Non limiting examples include ginko, gensing, and melatonin.

In some embodiments the composition comprises an excipient. Non-limiting examples of suitable excipients include a tastant, a flavorant, a buffering agent, a preservative, a stabilizer, a binder, a compaction agent, a lubricant, a dispersion enhancer, a disintegration agent, a flavoring agent, a sweetener, a coloring agent.

In some embodiments the excipient is a buffering agent. Non-limiting examples of suitable buffering agents include sodium citrate, magnesium carbonate, magnesium bicarbonate, calcium carbonate, and calcium bicarbonate.

In some embodiments the excipient comprises a preservative. Non-limiting examples of suitable preservatives include antioxidants, such as alpha-tocopherol and ascorbate, and antimicrobials, such as parabens, chlorobutanol, and phenol.

In some embodiments the composition comprises a binder as an excipient. Non-limiting examples of suitable binders include starches, pregelatinized starches, gelatin, polyvinylpyrolidone, cellulose, methylcellulose, sodium carboxymethylcellulose, ethylcellulose, polyacrylamides, polyvinyloxoazolidone, polyvinylalcohols, C12-C18 fatty acid alcohol, polyethylene glycol, polyols, saccharides, oligosaccharides, and combinations thereof.

In some embodiments the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, micro-crystalline cellulose, alginates, sodium starch glycolate, gums such as agar, guar, locust bean, karaya, pecitin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments the excipient comprises a flavoring agent. Flavoring agents incorporated into the outer layer can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; eucalyptus; vanilla; citrus oil such as lemon oil, orange oil, grape and grapefruit oil; and fruit essences including apple, peach, pear, strawberry, raspberry, cherry, plum, pineapple, and apricot.

In some embodiments the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2,2-dioxide, particularly the potassium salt (acesulfame-K), and sodium and calcium salts thereof.

In some embodiments the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

The weight fraction of the excipient or combination of excipients in the formulation is usually about 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the amino acids in the composition.

The proteins and compositions disclosed herein can be formulated into a variety of forms and administered by a number of different means. The compositions can be administered orally, rectally, or parenterally, in formulations containing conventionally acceptable carriers, adjuvants, and vehicles as desired. The term "parenteral" as used herein includes subcutaneous, intravenous, intramuscular, or intrasternal injection and infusion techniques. In an exemplary embodiment, the protein or composition is administered orally.

Solid dosage forms for oral administration include capsules, tablets, caplets, pills, troches, lozenges, powders, and granules. A capsule typically comprises a core material comprising a protein or composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as taste-masking agents.

Tablets, pills, and the like can be compressed, multiply compressed, multiply layered, and/or coated. The coating can be single or multiple. In one embodiment, the coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments the coating material comprises a protein. In some embodiments the coating material comprises at least one of a fat and oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments the coating material comprises at least one edible wax. The edible wax can be derived from animals, insects, or plants. Non-limiting examples include beeswax, lanolin, bayberry wax, carnauba wax, and rice bran wax. Tablets and pills can additionally be prepared with enteric coatings.

Alternatively, powders or granules embodying the proteins and compositions disclosed herein can be incorporated into a food product. In some embodiments the food product is be a drink for oral administration. Non-limiting examples of a suitable drink include fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, creams, pastes, emulsions, suspensions and slurries, each of which may optionally also contain at least one of suitable solvents, preservatives, emulsifying agents, suspending agents, diluents, sweeteners, coloring agents, a tastant, a flavorant, and flavoring agents.

In some embodiments the food product is a solid foodstuff. Suitable examples of a solid foodstuff include without limitation a food bar, a snack bar, a cookie, a brownie, a muffin, a cracker, a biscuit, a cream or paste, an ice cream bar, a frozen yogurt bar, and the like.

In some embodiments, the proteins and compositions disclosed herein are incorporated into a therapeutic food. In some embodiments, the therapeutic food is a ready-to-use food that optionally contains some or all essential macronutrients and micronutrients. In some embodiments, the proteins and compositions disclosed herein are incorporated into a supplementary food that is designed to be blended into an existing meal. In some embodiments, the supplemental food contains some or all essential macronutrients and micronutrients. In some embodiments, the proteins and compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

The compositions disclosed herein can be utilized in methods to increase at least one of muscle mass, strength and physical function, thermogenesis, metabolic expenditure, satiety, mitochondrial biogenesis, weight or fat loss, and lean body composition for example.

A formulation can contain a nutritive polypeptide up to about 25 g per 100 kilocalories (25 g/100 kcal) in the formulation, meaning that all or essentially all of the energy present in the formulation is in the form of the nutritive polypeptide. More typically, about 99%, 98%, 97%, 96%, 95%, 90%, 85%, 80%, 75%, 70%, 65%, 60%, 55%, 50%, 45%, 40%, 35%, 30%, 25%, 20%, 15%, 10%, 5% or less than 5% of the energy present in the formulation is in the form of the nutritive polypeptide. In other formulations, the nutritive polypeptide is present in an amount sufficient to provide a nutritional benefit equivalent to or greater than at least about 0.1% of a reference daily intake value of polypeptide. Suitable reference daily intake values for protein are well known in the art. See, e.g., Dietary Reference Intakes for Energy, Carbohydrate, Fiber, Fat, Fatty Acids, Cholesterol, Protein and Amino Acids, Institute of Medicine of the National Academies, 2005, National Academics Press, Washington D.C. A reference daily intake value for protein is a range wherein 10-35% of daily calories are provided by protein and isolated amino acids. Another reference daily intake value based on age is provided as grams of protein per day: children ages 1-3: 13 g, children ages 4-8: 19 g, children ages 9-13: 34 g, girls ages 14-18: 46, boys ages 14-18: 52, women ages 19-70+: 46, and men ages 19-70+: 56. In other formulations, the nutritive polypeptide is present in an amount sufficient to provide a nutritional benefit to a human subject suffering from protein malnutrition or a disease, disorder or condition characterized by protein malnutrition. Protein malnutrition is commonly a prenatal or childhood condition. Protein malnutrition with adequate energy intake is termed kwashiorkor or hypoalbuminemic malnutrition, while inadequate energy intake in all forms, including inadequate protein intake, is termed marasmus. Adequately nourished individuals can develop sarcopenia from consumption of too little protein or consumption of proteins deficient in nutritive amino acids. Prenatal protein malnutrition can be prevented, treated or reduced by administration of the nutritive polypeptides described herein to pregnant mothers, and neonatal protein malnutrition can be prevented, treated or reduced by administration of the nutritive polypeptides described herein to the lactation mother. In adults, protein malnutrition is commonly a secondary occurrence to cancer, chronic renal disease, and in the elderly. Additionally, protein malnutrition can be chronic or acute. Examples of acute protein malnutrition occur during an acute illness or disease such as sepsis, or during recovery from a traumatic injury, such as surgery, thermal injury such as a burn, or similar events resulting in substantial tissue remodeling. Other acute illnesses treatable by the methods and compositions described herein include sarcopenia, cachexia, diabetes, insulin resistance, and obesity.

A formulation can contain a nutritive polypeptide in an amount sufficient to provide a feeling of satiety when consumed by a human subject, meaning the subject feels a reduced sense or absence of hunger, or desire to eat. Such a formulation generally has a higher satiety index than carbohydrate-rich foods on an equivalent calorie basis.

A formulation can contain a nutritive polypeptide in an amount based on the concentration of the nutritive polypeptide (e.g., on a weight-to-weight basis), such that the nutritive polypeptide accounts for up to 100% of the weight of the formulation, meaning that all or essentially all of the matter present in the formulation is in the form of the nutritive polypeptide. More typically, about 99%, 98%, 97%, 96%, 95%, 90%, 85%, 80%, 75%, 70%, 65%, 60%, 55%, 50%, 45%, 40%, 35%, 30%, 25%, 20%, 15%, 10%, 5% or less than 5% of the weight present in the formulation is in the form of the nutritive polypeptide. In some embodiments, the formulation contains 10 mg, 100 mg, 500 mg, 750 mg, 1 g, 2 g, 3 g, 4 g, 5 g, 6 g, 7 g, 8 g, 9, 10 g, 15 g, 20 g, 25 g, 30 g, 35 g, 40 g, 45 g, 50 g, 60 g, 70 g, 80 g, 90 g, 100 g or over 100 g of nutritive polypeptide.

Preferably, the formulations provided herein are substantially free of non-comestible products. Non-comestible products are often found in preparations of recombinant proteins of the prior art, produced from yeast, bacteria, algae, insect, mammalian or other expression systems. Exemplary non-comestible products include surfactant, a polyvinyl alcohol, a propylene glycol, a polyvinyl acetate, a polyvinylpyrrolidone, a non-comestible polyacid or polyol, a fatty alcohol, an alkylbenzyl sulfonate, an alkyl glucoside, or a methyl paraben.

In aspects, the provided formulations contain other materials, such as a tastant, a nutritional carbohydrate and/or a nutritional lipid. In addition, formulations may include bulking agents, texturizers, and fillers.

In preferred embodiments, the nutritive polypeptides provided herein are isolated and/or substantially purified. The nutritive polypeptides and the Compositions and formulations provided herein, are substantially free of non-protein components. Such non-protein components are generally present in protein preparations such as whey, casein, egg and soy preparations, which contain substantial amounts of carbohydrates and lipids that complex with the polypeptides and result in delayed and incomplete protein digestion in the gastrointestinal tract. Such non-protein components can also include DNA. Thus, the nutritive polypeptides, compositions and formulations are characterized by improved digestability and decreased allergenicity as compared to food-derived polypeptides and polypeptide mixtures. Furthermore, these formulations and compositions are characterized by more reproducible digestability from a time and/or a digestion product at a given unit time basis. In certain embodiments, a nutritive polypeptide is at least 10% reduced in lipids and/or carbohydrates, and optionally one or more other materials that decreases digestibility and/or increases allergenicity, relative to a reference polypeptide or reference polypeptide mixture, e.g., is reduced by 20%, 30%, 40%, 50%, 60%, 70%, 80%, 90%, 95%, 99% or greater than 99%. In certain embodiments, the nutritive formulations contain a nutritional carbohydrate and/or nutritional lipid, which may be selected for digestibility and/or reduced allegenicity.

Methods of Use

In some embodiments the proteins and compositions disclosed herein are administered to a patient or a user (sometimes collectively referred to as a "subject"). As used herein "administer" and "administration" encompasses embodiments in which one person directs another to consume a protein or composition in a certain manner and/or for a certain purpose, and also situations in which a user uses a protein or composition in a certain manner and/or for a certain purpose independently of or in variance to any instructions received from a second person. Non-limiting examples of embodiments in which one person directs another to consume a protein or composition in a certain manner and/or for a certain purpose include when a physician prescribes a course of conduct and/or treatment to a patient, when a trainer advises a user (such as an athlete) to follow a particular course of conduct and/or treatment, and when a manufacturer, distributor, or marketer recommends conditions of use to an end user, for example through advertisements or labeling on packaging or on other materials provided in association with the sale or marketing of a product.

In some embodiments the proteins or compositions are provided in a dosage form. In some embodiments the dosage form is designed for administration of at least one protein disclosed herein, wherein the total amount of protein administered is selected from 0.1 g to 1 g, 1 g to 5 g, from 2 g to 10 g, from 5 g to 15 g, from 10 g to 20 g, from 15 g to 25 g, from 20 g to 40 g, from 25-50 g, and from 30-60 g. In some embodiments the dosage form is designed for administration of at least one protein disclosed herein, wherein the total amount of protein administered is selected from about 0.1 g, 0.1 g-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the dosage form is designed for administration of at least one protein disclosed herein, wherein the total amount of essential amino acids administered is selected from 0.1 g to 1 g, from 1 g to 5 g, from 2 g to 10 g, from 5 g to 15 g, from 10 g to 20 g, and from 1-30 g. In some embodiments the dosage form is designed for administration of at least one protein disclosed herein, wherein the total amount of protein administered is selected from about 0.1 g, 0.1-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the protein or composition is consumed at a rate of from 0.1 g to 1 g a day, 1 g to 5 g a day, from 2 g to 10 g a day, from 5 g to 15 g a day, from 10 g to 20 g a day, from 15 g to 30 g a day, from 20 g to 40 g a day, from 25 g to 50 g a day, from 40 g to 80 g a day, from 50 g to 100 g a day, or more.

In some embodiments, of the total protein intake by the subject, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or about 100% of the total protein intake by the subject over a dietary period is made up of at least one protein according to this disclosure. In some embodiments, of the total protein intake by the subject, from 5% to 100% of the total protein intake by the subject, from 5% to 90% of the total protein intake by the subject, from 5% to 80% of the total protein intake by the subject, from 5% to 70% of the total protein intake by the subject, from 5% to 60% of the total protein intake by the subject, from 5% to 50% of the total protein intake by the subject, from 5% to 40% of the total protein intake by the subject, from 5% to 30% of the total protein intake by the subject, from 5% to 20% of the total protein intake by the subject, from 5% to 10% of the total protein intake by the subject, from 10% to 100% of the total protein intake by the subject, from 10% to 100% of the total protein intake by the subject, from 20% to 100% of the total protein intake by the subject, from 30% to 100% of the total protein intake by the subject, from 40% to 100% of the total protein intake by the subject, from 50% to 100% of the total protein intake by the subject, from 60% to 100% of the total protein intake by the subject, from 70% to 100% of the total protein intake by the subject, from 80% to 100% of the total protein intake by the subject, or from 90% to 100% of the total protein intake by the subject, over a dietary period, is made up of at least one protein according to this disclosure. In some embodiments the at least one protein of this disclosure accounts for at least 5%, at least 10%, at least 15%, at least 20%, at least 25%, at least 30%, at least 35%, at least 40%, at least 45%, or at least 50% of the subject's calorie intake over a dietary period.

In some embodiments the at least one protein according to this disclosure comprises at least 2 proteins of this disclosure, at least 3 proteins of this disclosure, at least 4 proteins of this disclosure, at least 5 proteins of this disclosure, at least 6 proteins of this disclosure, at least 7 proteins of this disclosure, at least 8 proteins of this disclosure, at least 9 proteins of this disclosure, at least 10 proteins of this disclosure, or more.

In some embodiments the dietary period is 1 meal, 2 meals, 3 meals, at least 1 day, at least 2 days, at least 3 days, at least 4 days, at least 5 days, at least 6 days, at least 1 week, at least 2 weeks, at least 3 weeks, at least 4 weeks, at least 1 month, at least 2 months, at least 3 months, at least 4 months, at least 5 months, at least 6 months, or at least 1 year. In some embodiments the dietary period is from 1 day to 1 week, from 1 week to 4 weeks, from 1 month, to 3 months, from 3 months to 6 months, or from 6 months to 1 year.

Clinical studies provide evidence that protein prevents muscle loss due to aging or disuse, such as from immobility or prolonged bed rest. In particular, studies have shown that protein supplementation increases muscle fractional synthetic rate (FSR) during prolonged bed rest, maintains leg mass and strength during prolonged bed rest, increases lean body mass, improves functional measures of gait and balance, and may serve as a viable intervention for individuals at risk of sarcopenia due to immobility or prolonged bed rest. See, e.g., Paddon-Jones D, et al. J Clin Endocrinol Metab 2004, 89:4351-4358; Ferrando, A et al. Clinical Nutrition 2009 1-6; Katsanos C et al. Am J Physiol Endocrinol Metab. 2006, 291: 381-387.

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, the amino acid leucine is an important factor in stimulating muscle protein synthesis. See, e.g., Borscheim E et al. Am J Physiol Endocrinol Metab 2002, 283: E648-E657; Borsheim E et al. Clin Nutr. 2008, 27: 189-95; Esmarck B et al J Physiol 2001, 535: 301-311; Moore D et al. Am J Clin Nutr 2009, 89: 161-8).

In another aspect this disclosure provides methods of maintaining or increasing at least one of muscle mass, muscle strength, and functional performance in a subject. In some embodiments the methods comprise providing to the subject a sufficient amount of a protein of this disclosure, a composition of this disclosure, or a composition made by a method of this disclosure. In some embodiments the subject is at least one of elderly, critically-medically ill, and suffering from protein-energy malnutrition. In some embodiments the sufficient amount of a protein of this disclosure, a composition of this disclosure, or a composition made by a method of this disclosure is consumed by the subject in coordination with performance of exercise. In some embodiments the protein of this disclosure, composition of this disclosure, or composition made by a method of this disclosure is consumed by the subject by an oral, enteral, or parenteral route. In some embodiments the protein of this disclosure, composition of this disclosure, or composition made by a method of this disclosure is consumed by the subject by an oral route. In some embodiments the protein of this disclosure, composition of this disclosure, or composition made by a method of this disclosure is consumed by the subject by an enteral route.

In another aspect this disclosure provides methods of maintaining or achieving a desirable body mass index in a subject. In some embodiments the methods comprise providing to the subject a sufficient amount of a protein of this disclosure, a composition of this disclosure, or a composition made by a method of this disclosure. In some embodiments the subject is at least one of elderly, critically-medically ill, and suffering from protein-energy malnutrition. In some embodiments the sufficient amount of a protein of this disclosure, a composition of this disclosure, or a composition made by a method of this disclosure is consumed by the subject in coordination with performance of exercise. In some embodiments the protein of this disclosure, composition of this disclosure, or composition made by a method of this disclosure is consumed by the subject by an oral, enteral, or parenteral route.

In another aspect this disclosure provides methods of providing protein to a subject with protein-energy malnutrition. In some embodiments the methods comprise providing to the subject a sufficient amount of a protein of this disclosure, a composition of this disclosure, or a composition made by a method of this disclosure. In some embodiments the protein of this disclosure, composition of this disclosure, or composition made by a method of this disclosure is consumed by the subject by an oral, enteral, or parenteral route.

The need for essential amino acid supplementation has been suggested in cancer patients and other patients suffering from muscle wasting and cachexia. Dietary studies in mice have shown survival and functional benefits to cachectic cancer-bearing mice through dietary intervention with essential amino acids. Beyond cancer, essential amino acid supplementation has also shown benefits, such as improved muscle function and muscle gain, in patients suffering from other diseases that have difficulty exercising and therefore suffer from muscular deterioration, such as chronic obstructive pulmonary disease, chronic heart failure, HIV, and other disease states.

Studies have shown that specific amino acids have advantages in managing cachexia. A relatively high content of BCAAs and Leu in diets are thought to have a positive effect in cachexia by promoting total protein synthesis by signaling an increase in translation, enhancing insulin release, and inhibiting protein degradation. Thus, consuming increased dietary BCAAs in general and/or Leu in particular will contribute positively to reduce or reverse the effects of cachexia. Because nitrogen balance is important in countering the underlying cause of cachexia it is thought that consuming increased dietary glutamine and/or arginine will contribute positively to reduce or reverse the effects of cachexia. See, e.g., Op den Kamp C, Langen R, Haegens A, Schols A. "Muscle atrophy in cachexia: can dietary protein tip the balance?" Current Opinion in Clinical Nutrition and Metabolic Care 2009, 12:611-616; Poon RT-P, Yu W-C, Fan S-T, et al. "Long-term oral branched chain amino acids in patients undergoing chemoembolization for hepatocellular carcinoma:a randomized trial." Aliment Pharmacol Ther 2004; 19:779-788; Tayek J A, Bistrian B R, Hehir D J, Martin R, Moldawer L L, Blackburn G L. "Improved protein kinetics and albumin synthesis by branched chain amino acid-enriched total parenteral nutrition in cancer cachexia." Cancer. 1986; 58:147-57; Xi P, Jiang Z, Zheng C, Lin Y, Wu G "Regulation of protein metabolism by glutamine: implications for nutrition and health." Front Biosci. 2011 Jan. 1; 16:578-97.

Accordingly, also provided herein are methods of treating cachexia in a subject. In some embodiments a sufficient amount of a protein of this disclosure, a composition of this disclosure, or a composition made by a method of this disclosure for a subject with cachexia is an amount such that the amount of protein of this disclosure ingested by the person meets or exceeds the metabolic needs (which are often elevated). A protein intake of 1.5 g/kg of body weight per day or 15-20% of total caloric intake appears to be an appropriate target for persons with cachexia. In some embodiments all of the protein consumed by the subject is a protein according to this disclosure. In some embodiments protein according to this disclosure is combined with other sources of protein and/or free amino acids to provide the total protein intake of the subject. In some embodiments the subject is at least one of elderly, critically-medically ill, and suffering from protein-energy malnutrition. In some embodiments the subject suffers from a disease that makes exercise difficult and therefore causes muscular deterioration, such as chronic obstructive pulmonary disease, chronic heart failure, HIV, cancer, and other disease states. In some embodiments, the protein according to disclosure, the composition according to disclosure, or the composition made by a method according to disclosure is consumed by the subject in coordination with performance of exercise. In some embodiments, the protein according to this disclosure, the composition according to disclosure, or the composition made by a method according to disclosure is consumed by the subject by an oral, enteral, or parenteral route.

Sarcopenia is the degenerative loss of skeletal muscle mass (typically 0.5-1% loss per year after the age of 25), quality, and strength associated with aging. Sarcopenia is a component of the frailty syndrome. The European Working Group on Sarcopenia in Older People (EWGSOP) has developed a practical clinical definition and consensus diagnostic criteria for age-related sarcopenia. For the diagnosis of sarcopenia, the working group has proposed using the presence of both low muscle mass and low muscle function (strength or performance). Sarcopenia is characterized first by a muscle atrophy (a decrease in the size of the muscle), along with a reduction in muscle tissue "quality," caused by such factors as replacement of muscle fibres with fat, an increase in fibrosis, changes in muscle metabolism, oxidative stress, and degeneration of the neuromuscular junction. Combined, these changes lead to progressive loss of muscle function and eventually to frailty. Frailty is a common geriatric syndrome that embodies an elevated risk of catastrophic declines in health and function among older adults. Contributors to frailty can include sarcopenia, osteoporosis, and muscle weakness. Muscle weakness, also known as muscle fatigue, (or "lack of strength") refers to the inability to exert force with one's skeletal muscles. Weakness often follows muscle atrophy and a decrease in activity, such as after a long bout of bedrest as a result of an illness. There is also a gradual onset of muscle weakness as a result of sarcopenia.

The proteins of this disclosure are useful for treating sarcopenia or frailty once it develops in a subject or for preventing the onset of sarcopenia or frailty in a subject who is a member of an at risk groups. In some embodiments all of the protein consumed by the subject is a protein according to this disclosure. In some embodiments protein according to this disclosure is combined with other sources of protein and/or free amino acids to provide the total protein intake of the subject. In some embodiments the subject is at least one of elderly, critically-medically ill, and suffering from protein-energy malnutrition. In some embodiments, the protein according to disclosure, the composition according to disclosure, or the composition made by a method according to disclosure is consumed by the subject in coordination with performance of exercise. In some embodiments, the protein according to this disclosure, the composition according to disclosure, or the composition made by a method according to disclosure is consumed by the subject by an oral, enteral, or parenteral route.

Obesity is a multifactorial disorder associated with a host of comorbidities including hypertension, type 2 diabetes, dyslipidemia, coronary heart disease, stroke, cancer (eg, endometrial, breast, and colon), osteoarthritis, sleep apnea, and respiratory problems. The incidence of obesity, defined as a body mass index >30 kg/m2, has increased dramatically in the United States; from 15% (1976-1980) to 33% (2003-2004), and it continues to grow. Although the mechanisms contributing to obesity are complex and involve the interplay of behavioral components with hormonal, genetic, and metabolic processes, obesity is largely viewed as a lifestyle-dependent condition with 2 primary causes: excessive energy intake and insufficient physical activity. With respect to energy intake, there is evidence that modestly increasing the proportion of protein in the diet, while controlling total energy intake, may improve body composition, facilitate fat loss, and improve body weight maintenance after weight loss. Positive outcomes associated with increased dietary protein are thought to be due primarily to lower energy intake associated with increased satiety, reduced energy efficiency and/or increased thermogenesis, positive effects on body composition (specifically lean muscle mass), and enhanced glycemic control.

Dietary proteins are more effective in increasing postprandial energy expenditure than isocaloric intakes of carbohydrates or fat (see, e.g., Dauncey M, Bingham S. "Dependence of 24 h energy expenditure in man on composition of the nutrient intake." Br J Nutr 1983, 50: 1-13; Karst H et al. "Diet-induced thermogenesis in man: thermic effects of single proteins, carbohydrates and fats depending on their energy amount." Ann Nutr Metab. 1984, 28: 245-52; Tappy L et al "Thermic effect of infused amino acids in healthy humans and in subjects with insulin resistance." Am J Clin Nutr 1993, 57 (6): 912-6). This property along with other properties (satiety induction; preservation of lean body mass) make protein an attractive component of diets directed at weight management. The increase in energy expenditure caused by such diets may in part be due to the fact that the energy cost of digesting and metabolizing protein is higher than for other calorie sources. Protein turnover, including protein synthesis, is an energy consuming process. In addition, high protein diets may also up-regulate uncoupling protein in liver and brown adipose, which is positively correlated with increases in energy expenditure. It has been theorized that different proteins may have unique effects on energy expenditure.

Studies suggest that ingestion of protein, particularly proteins with high EAA and/or BCAA content, leads to distinct effects on thermogenesis and energy expenditure (see, e.g., Mikkelsen P. et al. "Effect of fat-reduced diets on 24 h energy expenditure: comparisons between animal protein, vegetable protein and carbohydrate." Am J Clin Nutr 2000, 72:1135-41; Acheson K. et al. "Protein choices targeting thermogenesis and metabolism." Am J Clin Nutr 2011, 93:525-34; Alfenas R. et al. "Effects of protein quality on appetite and energy metabolism in normal weight subjects" Arg Bras Endocrinol Metabol 2010, 54 (1): 45-51; Lorenzen J. et al. "The effect of milk proteins on appetite regulation and diet-induced thermogenesis." J Clin Nutr 2012 66 (5): 622-7). Additionally, L-tyrosine has been identified as an amino acid that plays a role in thermogenesis (see, e.g., Belza A. et al. "The beta-adrenergic antagonist propranolol partly abolishes thermogenic response to bioactive food ingredients." Metabolism 2009, 58 (8):1137-44). Further studies suggest that Leucine and Arginine supplementation appear to alter energy metabolism by directing substrate to lean body mass rather than adipose tissue (Dulloo A. "The search for compounds that stimulate thermogenesis in obesity management: from pharmaceuticals to functional food ingredients." Obes Rev 2011 12: 866-83).

Collectively the literature suggests that different protein types leads to distinct effects on thermogenesis. Because proteins or peptides rich in EAAs, BCAA, and/or at least one of Tyr, Arg, and Leu are believed to have a stimulatory effect on thermogenesis, and because stimulation of thermogenesis is believed to lead to positive effects on weight management, this disclosure also provides products and methods useful to stimulation thermogenesis and/or to bring about positive effects on weight management in general.

More particularly, this disclosure provides methods of increasing thermogenesis in a subject. In some embodiments the methods comprise providing to the subject a sufficient amount of a protein of this disclosure, a composition of this disclosure, or a composition made by a method of this disclosure. In some embodiments the subject is obese. In some embodiments, the protein according to disclosure, the composition according to disclosure, or the composition made by a method according to disclosure is consumed by the subject in coordination with performance of exercise. In some embodiments, the protein according to disclosure, the composition according to disclosure; or the composition made by a method according to disclosure is consumed by the subject by an oral, enteral, or parenteral route.

At the basic level, the reason for the development of an overweight condition is due to an imbalance between energy intake and energy expenditure. Attempts to reduce food at any particular occasion (satiation) and across eating occasions (satiety) have been a major focus of recent research. Reduced caloric intake as a consequence of feeling satisfied during a meal and feeling full after a meal results from a complex interaction of internal and external signals. Various nutritional studies have demonstrated that variation in food properties such as energy density, content, texture and taste influence both satiation and satiety.

There are three macronutrients that deliver energy: fat, carbohydrates and proteins. A gram of protein or carbohydrate provides 4 calories while a gram of fat 9 calories. Protein generally increases satiety to a greater extent than carbohydrates or fat and therefore may facilitate a reduction in calorie intake. However, there is considerable evidence that indicates the type of protein matters in inducing satiety (see, e.g., W. L. Hall, et al. "Casein and whey exert different effects on plasma amino acid profiles, gastrointestinal hormone secretion and appetite." Br J Nutr. 2003 February, 89(2):239-48; R. Abou-Samra, et al. "Effect of different protein sources on satiation and short-term satiety when consumed as a starter." Nutr J. 2011 Dec. 23, 10:139; T. Akhavan, et al. "Effect of premeal consumption of whey protein and its hydrolysate on food intake and postmeal glycemia and insulin responses in young adults." Am J Clin Nutr. 2010 April, 91(4):966-75, Epub 2010 Feb. 17; M A Veldhorst "Dose-dependent satiating effect of whey relative to casein or soy" Physiol Behav. 2009 Mar. 23, 96(4-5):675-82). Evidence indicates that protein rich in Leucine is particularly effective at inducing satiety (see, e.g., Fromentin G et al "Peripheral and central mechanisms involved in the control of food intake by dietary amino acids and proteins." Nutr Res Rev 2012 25: 29-39).

In some embodiments a protein of this disclosure is consumed by a subject concurrently with at least one pharmaceutical or biologic drug product. In some embodiments the beneficial effects of the protein and the at least one pharmaceutical or biologic drug product have an additive effect while in some embodiments the beneficial effects of the protein and the at least one pharmaceutical or biologic drug product have a synergistic effect. Examples of pharmaceutical or biologic drug products that can be administered with the proteins of this disclosure are well known in the art. For example, when a protein of this disclosure is used to maintain or increase at least one of muscle mass, muscle strength, and functional performance in a subject, the protein can be consumed by a subject concurrently with a therapeutic dosage regime of at least one pharmaceutical or biologic drug product indicated to maintain or increase at least one of muscle mass, muscle strength, and functional performance in a subject, such as an anabolic steroid. When a protein of this disclosure is used to maintain or achieve a desirable body mass index in a subject, the protein can be consumed by a subject concurrently with a therapeutic dosage regime of at least one pharmaceutical or biologic drug product indicated to maintain or achieve a desirable body mass index in a subject, such as orlistat, lorcaserin, sibutramine, rimonabant, metformin, exenatide, or pramlintide. When a protein of this disclosure is used to induce at least one of a satiation response and a satiety response in a subject, the protein can be consumed by a subject concurrently with a therapeutic dosage regime of at least one pharmaceutical or biologic drug product indicated to induce at least one of a satiation response and a satiety response in a subject, such as rimonabant, exenatide, or pramlintide. When a protein of this disclosure is used to treat at least one of cachexia, sarcopenia and frailty in a subject, the protein can be consumed by a subject concurrently with a therapeutic dosage regime of at least one pharmaceutical or biologic drug product indicated to treat at least one of cachexia, sarcopenia and frailty, such as omega-3 fatty acids or anabolic steroids. Because of the role of dietary protein in inducing satiation and satiety, the proteins and compositions disclosed herein can be used to induce at least one of a satiation response and a satiety response in a subject. In some embodiments the methods comprise providing to the subject a sufficient amount of a protein of this disclosure, a composition of this disclosure, or a composition made by a method of this disclosure. In some embodiments the subject is obese. In some embodiments, the protein according to disclosure, the composition according to disclosure, or the composition made by a method according to disclosure is consumed by the subject in coordination with performance of exercise. In some embodiments, the protein according to disclosure, the composition according to disclosure, or the composition made by a method according to disclosure is consumed by the subject by an oral, enteral, or parenteral route.

In some embodiments incorporating a least one protein or composition of this disclosure into the diet of a subject has at least one effect selected from inducing postprandial satiety (including by suppressing hunger), inducing thermogenesis, reducing glycemic response, positively affecting energy expenditure positively affecting lean body mass, reducing the weight gain caused by overeating, and decreasing energy intake. In some embodiments incorporating a least one protein or composition of this disclosure into the diet of a subject has at least one effect selected from increasing loss of body fat, reducing lean tissue loss, improving lipid profile, and improving glucose tolerance and insulin sensitivity in the subject.

Examples of the techniques and protocols described herein can be found in Remington's Pharmaceutical Sciences, 16th edition, Osol, A. (ed), 1980.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences*, 18th Edition (Easton, Pa.: Mack Publishing Company, 1990); Carey and Sundberg *Advanced Organic Chemistry* $3^{rd}$ Ed. (Plenum Press) Vols A and B (1992).

Example 1

Identification and Selection of Amino Acid Sequences of Nutritive Polypeptides of Edible Species Using Mass Spectrometric Analyses Provided is a process for identifying one or a plurality of nutritive polypeptide amino acid sequences, such as from a polypeptide or nucleic acid library, or from a relevant database of protein sequences. Here, nutritive polypeptide amino acid sequences were identified by mass spectroscopy analysis of proteins extracted and purified from edible species.

Protein Isolation for Mass Spectroscopy.

Proteins were extracted from solid edible sources. Samples from the following species were included in the analysis: *Actinidia deliciosa, Agaricus bisporus* var. *bisporus, Arthrospira platensis, Bos taurus, Brassica oleracea, Cannabis, Chenopodium quinoa, Chlorella regularis, Chlorella variabilis, Cicer arietintim, Cucurbita maxima, Fusarium graminearuni, Gadus morhua, Gallus gallus, Glycine Max, Lactobacillus acidophilus, Laminariales, Linum usitatissimum, Meleagris gallopavo, Odocoileus virginianus, Oreochromis niloticus, Oryza sativa, Ovis aries, Palmaria palmata, Persea americana, Prunus mume, Saccharomyces cerevisiae, Salmo salar, Solanum lycopcsicum, Solanum tuberosum, Sus scrofa, Thunnus thynnus, Vaccinium corymbosum, Vitis vinifera,* and *Zea mays*. Each sample was first frozen at −80 C and then ground using a mortar and pestle before weighing 50 mg of material into a microcentrifuge tube. The 50 mg sample was then resuspended in 1 mL of extraction buffer (8.3 M urea, 2 M thiourea, 2% w/v CHAPS, 1% w/v DTT) and agitated for 30 minutes. Addition of 500 μL of 100-μm zirconium beads (Ops Diagnostics) was followed by continued agitation for an additional 30 minutes. Samples were run on a TissueLyser H (Qiagen) at 30 Hz for 3 minutes and then centrifuged for 10 minutes at 21,130 g in a benchtop microcentrifuge (Eppendorf). Supernatants were transferred to clean microcentrifuge tubes, aliquoted into 50 μL aliquots, and stored at −80° C. The amount of soluble protein extracted was measured by Coomassie Plus (Bradford) Protein Assay (Thermo Scientific). 20 ug of protein was run on 10% 10-lane BisTris SDS-PAGE gel (Invitrogen) and then excised for analysis by LC/MS/MS.

Proteins were also isolated from liquid cultures of the following edible organisms: *Aspergillus niger, Bacillus subtilis, Bacillus licheniformis,* and *Bacillus amyloliquefaciens. Aspergillus* and *bacillus* organisms were cultured as described herein. Clarified supernatants were isolated by centrifuging (10,000×g) cultures for 10 minutes, followed by filtering the supernatant using a 0.2 μM filter. The amount of soluble protein in the clarified supernatant was measured by Coomassie Plus (Bradford) Protein Assay (Thermo Scientific). Protein samples (20 µg) were run on a 10% Precast BisTris SDS-PAGE gel (Invitrogen) according to the manufacturer's protocol.

Mass Spectroscopy.

For LC/MS/MS analysis each gel was excised into five equally sized pieces. Trypsin digestion was performed using a robot (ProGest, DigiLab) with the following protocol: washed with 25 mM ammonium bicarbonate followed by acetonitrile, reduced with 10 mM dithiothreitol at 60° C. followed by alkylation with 50 mM iodoacetamide at RT, digested with trypsin (Promega) at 37° C. for 4 h, quenched with formic acid and the supernatant was analyzed directly without further processing. The gel digests for each sample were pooled and analyzed by nano LC/MS/MS with a Waters NanoAcquity HPLC system interfaced to a Thermo-Fisher Q Exactive. Peptides were loaded on a trapping column and eluted over a 75 µm analytical column at 350 nL/min; both columns were packed with Jupiter Proteo resin (Phenomenex). The mass spectrometer was operated in data-dependent mode, with MS and MS/MS performed in the Orbitrap at 70,000 FWHM and 17,500 FWHM resolution, respectively. The fifteen most abundant ions were selected for MS/MS. Resulting data were searched against a Uniprot and/or NCBI protein database from the corresponding organism using Mascot with the following parameters: Enzyme—Trypsin/P, Fixed modification—Carbamidomethyl (C) Variable modifications—Oxidation (M), Acetyl (Protein N-term), Pyro-Glu (N-term Q), Deamidation (NQ), Mass values Monoisotopic, Peptide Mass Tolerance—10 ppm, Fragment Mass Tolerance—0.015 Da, Max Missed Cleavages—2. Mascot DAT files were parsed into the Scaffold software for validation, filtering and to create a non-redundant list per sample. Data were filtered using a minimum protein value of 90%, a minimum peptide value of 50% (Prophet scores) and requiring at least two unique peptides per protein. Relative abundance of detected proteins was determined by spectral counts, which is the number of spectra acquired for each protein. Spectral counting is a label-free quantification method commonly used by the protein mass spec field (Liu, Hongbin et al. Analytical chemistry 76.14 (2004): 4193-4201). To calculate the relative abundance of each protein in the protein isolate the number of protein spectral counts is divided by the total protein spectral counts. SEQID 894-3415 were identified using this method.

Homolog Discovery.

For the nutritive polypeptide sequences identified, as described, similar sequences are identified from other species, SEQID-00093, which was identified by this method, was used to search for homologs using the computer program BLAST as described herein. Example nutritive polypeptide homologs from the edible database identified in this way are shown in table E1A. Example nutritive polypeptide homologous from the expressed sequence database identified in this way are shown in table E1B.

TABLE E1A

Edible Sequences identified as homologs to SEQID-00093.

| SEQID | EAA | Percent ID to SEQID-00093 |
|---|---|---|
| SEQID-00094 | 0.45 | 98.8 |
| SEQID-00092 | 0.42 | 89.9 |

TABLE E1A-continued

Edible Sequences identified as homologs to SEQID-00093.

| SEQID | EAA | Percent ID to SEQID-00093 |
|---|---|---|
| SEQID-00075 | 0.46 | 67.9 |
| SEQID-00072 | 0.46 | 67.3 |
| SEQID-03712 | 0.46 | 66.0 |
| SEQID-03763 | 0.44 | 50.3 |
| SEQID-03708 | 0.45 | 51.6 |
| SEQID-03798 | 0.46 | 51.6 |
| SEQID-03860 | 0.45 | 50.9 |
| SEQID-03651 | 0.46 | 50.9 |

TABLE E1B

Expressed Sequences identified as homologs to SEQID-00093

| SEQID | EAA | Percent ID to SEQID-00093 |
|---|---|---|
| SEQID-00074 | 0.42 | 91.2 |
| SEQID-00092 | 0.42 | 89.9 |
| SEQID-00075 | 0.46 | 66.9 |
| SEQID-00078 | 0.46 | 65 |
| SEQID-00106 | 0.46 | 50.3 |
| SEQID-00104 | 0.45 | 50.3 |
| SEQID-00864 | 0.45 | 50.3 |
| SEQID-00870 | 0.45 | 43.8 |
| SEQID-00867 | 0.47 | 44.5 |
| SEQID-00105 | 0.44 | 41.1 |
| SEQID-00103 | 0.45 | 40.5 |
| SEQID-00866 | 0.40 | 39.8 |

Example 2

Identification and Selection of Amino Acid Sequences of Nutritive Polypeptides of Edible Species Using cDNA Libraries Here, Nutritive Polypeptide Amino acid sequences were identified by analysis of proteins produced from nucleic acid sequences extracted and purified from edible species.

Construction of cDNA Library.

A library of cDNA from twelve edible species was constructed. The twelve edible species were divided into five categories for RNA extraction. Animal tissues including ground beef, pork, lamb, chicken, turkey, and a portion of tilapia was combined with 50 mg from each edible species. Fruit tissues from grape and tomato including both the skin and the fruit were grounded and combined with 2.5 g from each species. Seeds of rice and soybean were combined with 1 g from each species and grounded into powder. 12 ml of *Saccharomyces cerevisiae* were grown overnight and spun down to obtain 110 mg of wet cell weight of yeast. 1 g of mushroom mycelium was grounded and processed using fungi RNA extraction protocols. All five categories of samples were snap frozen with liquid nitrogen, thawed and lysed using category-specific RNA extract protocols. The RNA from different food categories was extracted and combined as one pooled sample. The combined pool of RNA was reverse transcribed into cDNA using oligo-dT as primers resulting in cDNA of length between 500 bp to 4 kb. Adaptors were ligated to each end of the cDNA and used as PCR primers for amplification of the cDNA library and also included Sfi I restriction digestion sites for cloning the library into an expression vector. The cDNA library was denatured and re-annealed and the single-stranded DNA was selected using gel electrophoresis. This process removed extra cDNA from highly abundant RNA species to obtain a normalized cDNA library. The normalized cDNA library was precipitated using ethanol precipitation before PCR amplification and cloning into the expression vectors.

TABLE E2A

Primer and adapter sequences flanking the cDNA.

| Adapter | SEQID | Sequence (underlined: Sfi I site) |
|---|---|---|
| 5' adapter | 3910 | CAGTGGTATCAACGCAGAGTGGCCAT TACGGCCAAGTTACGGG |
| 3' adapter | 3911 | CAGTGGTATCAACGCAGAGTGGCCGA GGCGGCCTTTTTTTTTTTTTTT |

Cloning of cDNA Library into E. coli for Protein Expression.

The cDNA library was cloned into the pET15b backbone vector, which was amplified with primers with overhangs that contain the corresponding SfiI restriction sites (forward primer overhang: TACGTGTATGGCCGCCTCGGCC; reverse primer overhang: TACGTGTATGGCCGTAATGGCC). pET15b contains a pBR322 origin of replication, lac-controlled T7 promoter, and a bla gene conferring resistance to carbenicillin. Both the cDNA library and PCR amplified backbone were cut with SfiI, PCR purified, and ligated. The ligation reaction was transformed into 10-Beta High Efficiency Competent Cells (New England Biolabs), and transformed cells were plated onto four LB agar plates containing 100 mg/L carbenicillin. Plates were incubated at 37° C. overnight. After colonies had grown, 2 mL of liquid LB medium was added to each plate. Cells were scraped into the liquid and mixed together, and the suspension was prepared for plasmid extraction to form the multiplex cDNA plasmid library.

E. coli cDNA Multiplex Expression Methods.

Four strains were used to express the cDNA libraries: 17 Express from New England Biolabs; and Rosetta 2(DE3), Rosetta-gami B(DE3), and Rosetta-gami 2(DE3) from EMD Millipore. T7 Express is an enhanced BL21 derivative which contains the T7 RNA polymerase in the lac operon, while lacking the Lon and OmpT proteases. The genotype of T7 Express is: fhuA2 lacZ::T7 gene1 [lon] ompT gal sulA11 R(mcr-73::miniTn10-Tet$^S$)2 [dcm] R(zgb-210::Tn10-Tet$^S$) endA1 Δ(mcrC-mrr)114::IS10. Rosetta 2(DE3) is a BL21 derivative that supplies tRNAs for 7 rare codons (AGA, AGG, AUA, CUA, GGA, CCC, CGG). The strain is a lysogen of λDE3, and carries the T7 RNA polymerase gene under the lacUV5 promoter. The genotype of Rosetta 2(DE3) is: F$^-$ ompT hsdS$_B$(r$_B^-$m$_B^-$) gal dcm (DE3) pRARE2 (Cam$^R$). Rosetta-gami B(DE3) has the same properties as Rosetta 2(DE3) but includes characteristics that enhance the formation of protein disulfide bonds in the cytoplasm. The genotype of Rosetta-gami B(DE3) is F$^-$ ompT hsdS$_B$ (r$_B^-$ m$_B^-$) gal dcm lacY1 ahpC (DE3) gor522:: Tn10 trxBpRARE (Cam$^R$, Kan$^R$, Tet$^R$). Rosetta-gami 2(DE3), similarly to Rosetta-gami B(DE3), alleviates codon bias, enhances disulfide bond formation, and have the T7 RNA polymerase gene under the lacUV5 promoter in the chromosome. The genotype of Rosetta-gami 2(DE3) is Δ(ara-leu)7697 ΔlacX74 ΔphoA PvuII phoR araD139 ahpC galE galK rpsL(DE3) F'[lac$^+$ lacII$^q$ pro] gor522::Tn10 trxB pRARE2 (Cam$^R$, Str$^R$, Tet$^R$)

Roughly 200 ng of prepared cDNA libraries were transformed into the four background strains: T7 Express, Rosetta 2(DE3), Rosetta-gami B(DE3), and Rosetta-gami 2(DE3) competent cells. After transforming, 100 μL of each strain was plated onto four LB (10 g/l NaCl, 10 g/l tryptone, and 5 g/l yeast extract) 1.5% agar plates containing 100 mg/L carbenicillin and incubated at 37° C. for 16 hrs. After incubation, 2 mL of LB media with 100 mg/L carbenicillin was added to the surface of each plate containing several thousand transformants, and the cells were suspended in the surface medium by scraping with a cell spreader and mixing. Suspended cells from the four replicate plates from each background were combined to form the pre-inoculum cultures for the expression experiments.

The OD$_{600}$ of the pre-inoculum cultures made from re-suspended cells were measured using a plate reader to be between 35 and 40 (T7, Rosetta 2(DE3) or 15 and 20 (Rosetta-gami B(DE3) and 2(DE3)). For the four background strains, 125 mL baffled shake flasks containing 10 mL of LB medium with 100 mg/L carbenicillin were inoculated to OD$_{600}$ 0.2 to form the inoculum cultures, and incubated at 37° C. shaking at 250 rpm for roughly 6 hours. OD$_{600}$ was measured and the inoculum cultures were used to inoculate expression cultures in 2 L baffled shake flasks containing 250 mL of BioSilta Enbase medium with 100 mg/L carbenicillin, 600 mU/L of glucoamylase and 0.01% Antifoam 204 to an OD$_{600}$ of 0.1. Cultures were shaken at 30° C. and 250 rpm for 18 hours, and were induced with 1 mM IPTG and supplemented with additional EnBase media components and another 600 mU/L of glucoamylase. Heterologous expression was carried out for 24 hours at 30° C. and 250 rpm, at which point the cultures were terminated. The terminal cell density was measured and the cells were harvested by centrifugation (5000×g, 10 min, RT). Cells were stored at −80° C. before being lysed with B-PER (Pierce) according to the manufacturer's protocol. After cell lysis, the whole cell lysate is sampled for analysis. In the Rosetta (DE3) strain, the whole cell lysate is centrifuged (3000×g, 10 min RT) and the supernatant is collect as the soluble fraction of the lysate. Cell lysates were run on SDS-PAGE gels, separated into ten fractions, and then analyzed using MS-MS.

Cloning of cDNA Library into Bacillus for Protein Secretion.

The cDNA library was cloned into the pHT43 vector for protein secretion assay in Bacillus subtilis. The unmodified pHT43 vector from MoBiTec contains the Pgrac promoter, the SamyQ signal peptide, Amp and Cm resistance genes, a lacI region, a repA region, and the ColE1 origin of replication. The SamyQ signal peptide was removed. The pHT43 backbone vector with no signal peptide as well as a modified version with the aprE promoter substituted for the grac promoter and with the lacI region removed were amplified with primers with overhangs that contain the corresponding SfiI restriction sites (forward primer overhang: TACGTGTATGGCCGCCTCGGCC; reverse primer overhang: TACGTGTATGGCCGTAATGGCC). Both the cDNA library and the two PCR amplified backbones were cut with SfiI and PCR purified. The cDNA library inserts were ligated into each background. The ligation reactions were transformed into 10-Beta High Efficiency Competent Cells (New England Biolabs), and cells from each ligation were plated onto four LB agar plates containing 100 mg/L carbenicillin. Plates were incubated at 37° C. overnight. After colonies had grown, 2 mL of liquid LB medium was added to each plate. For each ligation, cells were scraped into the liquid and mixed together; and the suspensions were prepped for plasmid extraction to form the multiplex cDNA plasmid libraries (henceforth referred to as the multiplex Grac-cDNA and AprE-cDNA libraries).

The expression strains used in this expression experiment are based off of the WB800N strain (MoBiTec). The WB800N strain has the following genotype: nprE aprE epr bpr mpr::ble nprB::bsr vpr wprA::hyg cm::neo; NeoR. Strain cDNA-1 contains a mutation that synergizes with the paprE promoter and has these alterations in addition to the WB800N genotype: pXylA-comK::Erm, degU32(Hy), sigF::Str. Strain cDNA-2 has these alterations to WB800N: pXylA-comK::Erm.

Roughly 1 μg of the multiplex Grac-cDNA library was transformed into both Strain cDNA-1 and Strain cDNA-2, and 1 μg of the multiplex AprE-cDNA library was transformed into Strain cDNA-1. After transforming, 100 μL of each strain was plated onto four LB (10 g/l NaCl, 10 g/l tryptone, and 5 g/l yeast extract) 1.5% agar plates containing 5 mg/L chloramphenicol and incubated at 37° C. for 16 hrs. After incubation, 2 mL of LB media with 5 mg/L chloramphenicol was added to the surface of each plate containing several thousand transformants, and the cells were suspended in the surface medium by scraping with a cell spreader and mixing. Suspended cells from the four replicate plates from each transformation were combined to form the preinoculum cultures for the expression experiments.

The $OD_{600}$ of the preinoculum cultures made from resuspended cells were measured using a plate reader to be roughly 20-25. For the three strains (strain cDNA-1+multiplex Grac-cDNA, strain cDNA-1+multiplex AprE-cDNA, strain cDNA-2+Grac-cDNA), 500 mL baffled shake flasks containing 50 mL of 2×Mal medium (20 g/L NaCl, 20 g/L Tryptone, 10 g/L yeast extract, 75 g/L D-Maltose) with 5 mg/L chloramphenicol were inoculated to $OD_{600}$≈0.2 to form the inoculum cultures, and incubated at 30° C. shaking at 250 rpm for roughly 6 hours. $OD_{600}$ was measured and the inoculum cultures were used to inoculate expression cultures in 2 L baffled shake flasks containing 2×Mal medium with 5 mg/L chloramphenicol, 1× Teknova Trace Metals, and 0.01% Antifoam 204 to an $OD_{600}$ of 0.1. The strain cDNA-1+multiplex AprE cDNA culture was shaken for 30° C. and 250 rpm for 18 hours, at which point the culture was harvested. The terminal cell density was measured and the cells were harvested by centrifugation (5000×g, 30 min, RT). The strain cDNA-1+multiplex Grac-cDNA and strain cDNA-2+multiplex Grac-cDNA cultures were shaken at 37° C. and 250 rpm for 4 hours, and were induced with 1 mM IPTG. Heterologous expression was carried out for 4 hours at 37° C. and 250 rpm, at which point the cultures were harvested. Again, the terminal cell density was measured and the cells were harvested by centrifugation (5000×g, 30 min, RT). The supernatant was collected and run on SDS-PAGE gels, separated into ten fractions, and then analyzed using LC-MS/MS to identify secreted proteins.

Mass Spectrometry Analysis.

Whole cell lysate and soluble lysate samples were analyzed for protein expression using LC-MS/MS. To analyze samples, 10 μg of sample was loaded onto a 10% SDS-PAGE gel (Invitrogen) and separated approximately 5 cm. The gel was excised into ten segments and the gel slices were processed by washing with 25 mM ammonium bicarbonate, followed by acetonitrile. Gel slices were then reduced with 10 mM dithiothreitol at 60° C., followed by alkylation with 50 mM iodoacetamide at room temperature. Finally, the samples were digested with trypsin (Promega) at 37° C. for 4 h and the digestions were quenched with the addition of formic acid. The supernatant samples were then analyzed by nano LC/MS/MS with a Waters NanoAcquity HPLC system interfaced to a ThermoFisher Q Exactive. Peptides were loaded on a trapping column and eluted over a 75 μm analytical column at 350 nL/min; both columns were packed with Jupiter Proteo resin (Phenomenex). A 1 h gradient was employed. The mass spectrometer was operated in data-dependent mode, with MS and MS/MS performed in the Orbitrap at 70,000 FWHM resolution and 17,500 FWHM resolution, respectively. The fifteen most abundant ions were selected for MS/MS. Data were searched against a database using Mascot to identify peptides. The database was constructed by combining the complete protcome sequences from all twelve species including *Bos taurus, Gallus gallus, Vitis vinifera, Ovis aries, Sus scrofa, Oryza sativa, Glycine max, Oreochromis niloticus, Solanum lycopesicum, Agaricus bisporus* var. *bisporus, Saccharomyces cerevisiae,* and *Meleagris gallopavo*. Mascot DAT files were parsed into the Scaffold software for validation, filtering and to create a nonredundant list per sample. Data were filtered at 1% protein and peptide false discovery rate (FDR) and requiring at least two unique peptides per protein.

Expressed Proteins Identified.

Mass spectrometry analysis identified a total of 125 proteins across expression strains. Spectrum counts, which are related to the protein abundance, are reported to confirm protein expression or secretion. Fifty three proteins were identified in whole cell lysate of the Rosetta (DE3) strain, 46 in the soluble fraction of the Rosetta (DE3) strain, 36 in Rosetta-Gami B (DE3), 10 in Rosetta-Gami 2 (DE3), and 15 in the secreted supernatant of *Bacillus subtilis*.

The nutritive polypeptides detected in the secreted supernatant of *Bacillus subtilis* are SEQID-00718, SEQID-00762, SEQID-00763, SEQID-00764, SEQID-00765, SEQID-00766, SEQID-00767, SEQID-00768, SEQID-00769, SEQID-00770, SEQID-00771, SEQID-00772, SEQID-00773, SEQID-00774, SEQID-00775.

The nutritive polypeptides detected in the whole cell lysate of the *E. coli* Rosetta (DE3) strain are SEQID-00716, SEQID-00718, SEQID-00720, SEQID-00723, SEQID-00724, SEQID-00725, SEQID-00729, SEQID-00732, SEQID-00737, SEQID-00751, SEQID-00776, SEQID-00790, SEQID-00797, SEQID-00798, SEQID-00799, SEQID-00800, SEQID-00801, SEQID-00802, SEQID-00803, SEQID-00804, SEQID-00805, SEQID-00806, SEQID-00807, SEQID-00808, SEQID-00809, SEQID-00810, SEQID-00811, SEQID-00812, SEQID-00813, SEQID-00814, SEQID-00815, SEQID-00816, SEQID-00817, SEQID-00818, SEQID-00819, SEQID-00820, SEQID-00821, SEQID-00822, SEQID-00823, SEQID-00824, SEQID-00825, SEQID-00826, SEQID-00827, SEQID-00828, SEQID-00829, SEQID-00830, SEQID-00831, SEQID-00832, SEQID-00833, SEQID-00834, SEQID-00835, SEQID-00836, SEQID-00837.

The nutritive polypeptides detected in the soluble lysate of the *E. coli* Rosetta (DE3) strain are SEQID-00716, SEQID-00717, SEQID-00718, SEQID-00719, SEQID-00720, SEQID-00721, SEQID-00722, SEQID-00724, SEQID-00725, SEQID-00726, SEQID-00727, SEQID-00728, SEQID-00729, SEQID-00730, SEQID-00731, SEQID-00732, SEQID-00733, SEQID-00734, SEQID-00735, SEQID-00736, SEQID-00737, SEQID-00738, SEQID-00739, SEQID-00740, SEQID-00741, SEQID-00742, SEQID-00743, SEQID-00744, SEQID-00745, SEQID-00746, SEQID-00747, SEQID-00748, SEQID-00749, SEQID-00750, SEQID-00751, SEQID-00752, SEQID-00753, SEQID-00754, SEQID-00755, SEQID-

00756, SEQID-00757, SEQID-00758, SEQID-00759, SEQID-00760, SEQID-00761.

The nutritive polypeptides detected in the *E. coli* Rosetta-Gami B (DE3) strain are SEQID-00003, SEQID-00004, SEQID-00005, SEQID-00716, SEQID-00718, SEQID-00719, SEQID-00720, SEQID-00729, SEQID-00730, SEQID-00731, SEQID-00732, SEQID-00734, SEQID-00736, SEQID-00740, SEQID-00743, SEQID-00752, SEQID-00760, SEQID-00763, SEQID-00764, SEQID-00776, SEQID-00777, SEQID-00778, SEQID-00779, SEQID-00780, SEQID-00781, SEQID-00782, SEQID-00783, SEQID-00784, SEQID-00785, SEQID-00786, SEQID-00787, SEQID-00788, SEQID-00789, SEQID-00790, SEQID-00791, SEQID-00792.

The nutritive polypeptides detected in the *E. coli* Rosetta-Gami2 (DE3) strain are SEQID-00716, SEQID-00737, SEQID-00747, SEQID-00763, SEQID-00789, SEQID-00790, SEQID-00793, SEQID-00794, SEQID-00795, SEQID-00796.

Example 3

Identification and Selection of Amino Acid Sequences of Nutritive Polypeptides of Edible Species Using Annotated Protein Sequence Databases Construction of Protein Databases. The UniProtKB/Swiss-Prot (a collaboration between the European Bioinformatics Institute and the Swiss Institute of Bioinformatics) is a manually curated and reviewed protein database, and was used as the starting point for constructing a protein database. To construct a protein database of edible species, a search was performed on the UniProt database for proteins from edible species as disclosed in, e.g., PCT/US2013/032232, filed Mar. 15, 2013, PCT/US2013/032180, filed Mar. 15, 2013, PCT/US2013/032225, filed Mar. 15, 2013, PCT/US2013/032218, filed Mar. 15, 2013, PCT/US2013/032212, filed Mar. 15, 2013, and PCT/US2013/032206, filed Mar. 15, 2013. To identify proteins that are secreted from microorganisms, the UniProt database was searched for species from microorganisms as disclosed herein and proteins that are annotated with keywords or annotations that includes secreted, extracellular, cell wall, and outer membrane. To identify proteins that are abundant in the human diet, the reference proteomes of edible species were assembled from genome databases. As provided herein, mass spectrometry was performed on proteins extracted from each edible species. The peptides identified by mass spectrometry were mapped to the reference proteomes and the spectrum counts of the peptides associated with the reference protein sequences were converted to a measure for the abundance of the corresponding protein in food. All proteins that were detected above a cutoff spectrum count with high confidence were assembled into a database. These databases are used for identifying proteins that are derived from edible species, which are secreted, and/or are abundant in the human diet.

Processes for selection of amino acid sequences. A process for picking a protein or group of proteins can include identifying a set of constraints that define the class of protein one is interested in finding, the database of proteins from which to search, and performing the actual search.

The protein class criteria can be defined by nutritional literature (i.e., what has been previously identified as efficacious), desired physiochemical traits (e.g., expressible, soluble, nonallergenic, nontoxic, digestible, etc), and other characteristics. A relevant database of proteins that can be used for searching purposes can be derived from the sequences disclosed herein.

One example of proteins that can be searched is a highly soluble class of proteins for muscle anabolism/immune health/diabetes treatment. These proteins are generally solubly expressible, highly soluble upon purification/isolation, non-allergenic, non-toxic, fast digesting, and meet some basic nutritional criteria (e.g., [EAA]>0.3, [BCAA]>0.15, [Leucine or Glutamine or Arginine]>0.08, eaa complete).

A search is conducted for expressible, soluble proteins using a binary classification model based on two parameters related to the hydrophilicity and hydrophobicity of the protein sequence: solvation score and aggregation score (see examples below for various descriptions of these two metrics and measures of efficacy of the model). Alternatively, a search can be conducted for highly charged proteins with high (or low) net charge per amino acid, which is indicative of a net excess of negative or positive charges per amino acid (see example below for additional description).

The nutritional criteria are satisfied by computing the mass fractions of all relevant amino acids based on primary sequence. For cases in which it is desired to match a known, clinically efficacious amino acid blend a weighted Euclidean distance method can be used (see example below).

As provided herein, allergenicity/toxicity/nonallergenicity/antinutrticity criteria are searched for using sequence based homology assessments in which each candidate sequence is compared to libraries of known allergens, toxins, nonallergens, or antinutritive (e.g., protease inhibitory) proteins (see examples herein). In general, cutoffs of <50% global or <35% local (over any given 80aa window) homology (percent ID) can be used for the allergenicity screens, and <35% global for the toxicity and antinutricity screens. In all cases, smaller implies less allergenic/toxic/antinutritive. The nonallergenicity screen is less typically used as a cutoff, but >62% as a cutoff can be used (greater implies is more nonallergenic). These screens reduce the list to a smaller subset of proteins enriched in the criteria of interest. This list is then ranked using a variety of aggregate objective functions and selections are made from this rank ordered list.

Example 4

Selection of Amino Acid Sequences to Demonstrate Amino Acid Pharmacology of Nutritive Polypeptides Identification of Proteins Enriched in Leucine and Essential Amino Acids for the Treatment of Sarcopenia.

As described herein, sarcopenia is the degenerative loss of skeletal muscle mass (typically 0.5-1% loss per year after the age of 25), quality, and strength associated with aging. Sarcopenia is characterized first by a muscle atrophy (a decrease in the size of the muscle), along with a reduction in muscle tissue "quality," caused by such factors as replacement of muscle fibres with fat, an increase in fibrosis, changes in muscle metabolism, oxidative stress, and degeneration of the neuromuscular junction. Combined, these changes lead to progressive loss of muscle function and eventually to frailty. It has been shown that essential amino acid supplementation in elderly, sarcopenia individuals can have an anabolic and/or sparing effect on muscle mass. Furthermore, this supplementation can also translate to improvements in patient strength and muscle quality. See, e.g., Paddon-Jones D, et al. J Clin Endocrinol Metab 2004, 89:4351-4358; Ferrando, A et al. Clinical Nutrition 2009

1-6; Katsanos C et al. Am J Physiol Endocrinol Metab. 2006, 291: 381-387. It has also been shown that the essential amino acid leucine is a particularly important factor in stimulating muscle protein synthesis. See, e.g., Borscheirri E et al. Am J Physiol Endocrinol Metab 2002, 283: E648-E657; Borsheim E et al. Clin Nutr. 2008, 27: 189-95; Esmarck Bet at J Physiol 2001, 535: 301-311; Moore D et al. Am J Clin Nutr 2009, 89: 161-8). One can identify beneficial nutritive polypeptides for individuals that suffer from sarcopenia by selecting proteins that are enriched by mass in leucine and the other essential amino acids.

Using a database of all protein sequences derived from edible species as described herein, candidate sequences that are enriched in leucine (≥15% by mass) and essential amino acids (≥40% by mass) were identified and rank ordered by their total leucine plus essential amino acid mass relative to total amino acid mass. In order to increase the probability that these proteins are solubly expressed, as well as highly soluble at pH 7 with reduced aggregation propensity, solvation score and aggregation score upperbounds of −20 kcal/mol/AA and 0.5 were applied. In order to reduce the likelihood that these proteins would elicit an allergenic response, upper bounds of 50% and 35% were set for the global allergen homology and allergenicity scores, respectively. In order to reduce the likelihood that these proteins would have toxic effects upon ingestion, an upper bound of 35% was set for the toxicity score. In order to reduce the likelihood that these proteins would act as inhibitors of digestive proteases, an upper bound of 35% was set for the anti-nutricity score.

An exemplary list of the top 10 nutritive polypeptide sequences that are enriched in leucine (≥15% by mass) and essential amino acids (≥40% by mass), and meet the afore mentioned cutoffs in solvation score, aggregation score, global allergen homology, allergenicity score, toxicity score, and anti-nutricity score is shown in Table E4A.

TABLE E4A

| SEQID | EAA | L |
| --- | --- | --- |
| SEQID-03552 | 0.56 | 0.21 |
| SEQID-03581 | 0.60 | 0.15 |
| SEQID-03532 | 0.58 | 0.16 |
| SEQID-03475 | 0.56 | 0.17 |
| SEQID-03499 | 0.58 | 0.15 |
| SEQID-03494 | 0.54 | 0.18 |
| SEQID-03460 | 0.54 | 0.17 |
| SEQID-03485 | 0.54 | 0.16 |
| SEQID-03513 | 0.54 | 0.15 |
| SEQID-03491 | 0.52 | 0.17 |

An exemplary list of the top 10 nutritive polypeptide sequences from the expressed protein database that are enriched in leucine (≤15% by mass) and essential amino acids (≤40% by mass) is shown in Table E4B.

TABLE E4B

| SEQID | EAA | L |
| --- | --- | --- |
| SEQID-00162 | 0.64 | 0.34 |
| SEQID-00132 | 0.60 | 0.32 |
| SEQID-00166 | 0.65 | 0.26 |
| SEQID-00169 | 0.60 | 0.25 |
| SEQID-00137 | 0.64 | 0.20 |
| SEQID-00134 | 0.58 | 0.24 |
| SEQID-00175 | 0.63 | 0.19 |
| SEQID-00194 | 0.54 | 0.26 |

TABLE E4B-continued

| SEQID | EAA | L |
| --- | --- | --- |
| SEQID-00193 | 0.53 | 0.26 |
| SEQID-00195 | 0.52 | 0.26 |

Example 5

Selection of Amino Acid Sequences of Nutritive Polypeptides Enriched in Essential Amino Acids and Enriched or Reduced in Various Individual Amino Acids of Interest Using a database of all protein sequences derived from edible species as described herein, candidate sequences enriched in essential amino acids with elevated or reduced amounts of each amino acid were identified. In order to increase the probability that these proteins would be solubly expressed, as well as highly soluble at pH 7 with reduced aggregation propensity, solvation score and aggregation score upper bounds of −20 kcal/mol/AA and 0.5 were applied. In order to reduce the likelihood that these proteins would elicit an allergenic response, upper bounds of 50% and 35% were set for the global allergen homology and allergenicity scores, respectively. In order to reduce the likelihood that these proteins would have toxic effects upon ingestion, an upper bound of 35% was set for the toxicity score. In order to reduce the likelihood that these proteins would act as inhibitors of digestive proteases, an upper bound of 35% was set for the anti-nutricity score. When searching for proteins enriched or reduced in a given amino acid, the cutoffs described above were applied, and proteins were rank ordered by their calculated amino acid mass fraction of the desired amino acid and then by their essential amino acid content.

An exemplary list of the top 10 nutritive polypeptide sequences enriched in alanine that met the above cutoffs in solvation score, aggregation score, global allergen homology, allergenicity score, toxicity score, and anti-nutricity score is shown in Table E5A. The top 10 nutritive polypeptide sequences reduced in alanine are shown in Table E5B.

TABLE E5A

| SEQID | EAA | A |
| --- | --- | --- |
| SEQID-03678 | 0.46 | 0.18 |
| SEQID-03682 | 0.44 | 0.18 |
| SEQID-03646 | 0.46 | 0.18 |
| SEQID-03653 | 0.39 | 0.16 |
| SEQID-03717 | 0.38 | 0.16 |
| SEQID-03686 | 0.41 | 0.15 |
| SEQID-03807 | 0.46 | 0.15 |
| SEQID-03864 | 0.44 | 0.15 |
| SEQID-03663 | 0.35 | 0.15 |
| SEQID-03777 | 0.46 | 0.14 |

TABLE E5B

| SEQID | EAA | A |
| --- | --- | --- |
| SEQID-03874 | 0.62 | 0.00 |
| SEQID-03552 | 0.56 | 0.00 |
| SEQID-03880 | 0.52 | 0.00 |
| SEQID-03673 | 0.52 | 0.00 |
| SEQID-03667 | 0.50 | 0.00 |
| SEQID-03657 | 0.50 | 0.00 |
| SEQID-03842 | 0.49 | 0.00 |

TABLE E5B-continued

| SEQID | EAA | A |
|---|---|---|
| SEQID-03623 | 0.49 | 0.00 |
| SEQID-03817 | 0.48 | 0.00 |
| SEQID-03875 | 0.48 | 0.00 |

An exemplary list of the top 10 nutritive polypeptide sequences enriched in arginine that met the above cutoffs in solvation score, aggregation score, global allergen homology, allergenicity score, toxicity score, and anti-nutricity score is shown in table E5C. The top 10 nutritive polypeptide sequences reduced in arginine are shown in Table E5D.

TABLE E5C

| SEQID | EAA | R |
|---|---|---|
| SEQID-03473 | 0.06 | 0.72 |
| SEQID-03855 | 0.09 | 0.65 |
| SEQID-03727 | 0.10 | 0.63 |
| SEQID-03767 | 0.17 | 0.62 |
| SEQID-03704 | 0.17 | 0.60 |
| SEQID-03459 | 0.10 | 0.60 |
| SEQID-03731 | 0.16 | 0.48 |
| SEQID-03698 | 0.47 | 0.40 |
| SEQID-03687 | 0.37 | 0.38 |
| SEQID-03732 | 0.19 | 0.38 |

TABLE E5D

| SEQID | EAA | R |
|---|---|---|
| SEQID-03744 | 0.60 | 0.00 |
| SEQID-03770 | 0.56 | 0.00 |
| SEQID-03880 | 0.52 | 0.00 |
| SEQID-03736 | 0.49 | 0.00 |
| SEQID-03706 | 0.49 | 0.00 |
| SEQID-03881 | 0.49 | 0.00 |
| SEQID-03668 | 0.49 | 0.00 |
| SEQID-03733 | 0.46 | 0.00 |
| SEQID-03764 | 0.46 | 0.00 |
| SEQID-03832 | 0.44 | 0.00 |

An exemplary list of the top 10 nutritive polypeptide sequences enriched in asparagine that met the above cutoffs in solvation score, aggregation score, global allergen homology, allergenicity score, toxicity score, and anti-nutricity score is shown in table E5E. The top 10 nutritive polypeptide sequences reduced in asparagine are shown in table E5F.

TABLE E5E

| SEQID | EAA | N |
|---|---|---|
| SEQID-03723 | 0.39 | 0.15 |
| SEQID-03721 | 0.39 | 0.15 |
| SEQID-03803 | 0.42 | 0.15 |
| SEQID-03801 | 0.38 | 0.15 |
| SEQID-03714 | 0.40 | 0.14 |
| SEQID-03742 | 0.41 | 0.14 |
| SEQID-03724 | 0.38 | 0.14 |
| SEQID-03884 | 0.42 | 0.14 |
| SEQID-03778 | 0.39 | 0.13 |
| SEQID-03746 | 0.41 | 0.13 |

TABLE E5F

| SEQID | EAA | N |
|---|---|---|
| SEQID-03874 | 0.62 | 0.00 |
| SEQID-03793 | 0.59 | 0.00 |
| SEQID-03789 | 0.57 | 0.00 |

TABLE E5F-continued

| SEQID | EAA | N |
|---|---|---|
| SEQID-03869 | 0.57 | 0.00 |
| SEQID-03809 | 0.57 | 0.00 |
| SEQID-03662 | 0.56 | 0.00 |
| SEQID-03850 | 0.55 | 0.00 |
| SEQID-03783 | 0.55 | 0.00 |
| SEQID-03753 | 0.54 | 0.00 |
| SEQID-03677 | 0.53 | 0.00 |

An exemplary list of the top 10 nutritive polypeptide sequences enriched in aspartic acid that met the above cutoffs in solvation score, aggregation score, global allergen homology, allergenicity score, toxicity score, and anti-nutricity score is shown in table E5G. The top 10 nutritive polypeptide sequences reduced in aspartic acid are shown in table E5H.

TABLE E5G

| SEQID | EAA | D |
|---|---|---|
| SEQID-03630 | 0.33 | 0.28 |
| SEQID-03425 | 0.34 | 0.26 |
| SEQID-03564 | 0.33 | 0.25 |
| SEQID-03543 | 0.34 | 0.25 |
| SEQID-03607 | 0.32 | 0.24 |
| SEQID-03621 | 0.35 | 0.23 |
| SEQID-03604 | 0.37 | 0.21 |
| SEQID-03827 | 0.42 | 0.20 |
| SEQID-03540 | 0.37 | 0.20 |
| SEQID-03624 | 0.39 | 0.19 |

TABLE E5H

| SEQID | EAA | D |
|---|---|---|
| SEQID-03795 | 0.62 | 0.00 |
| SEQID-03468 | 0.62 | 0.00 |
| SEQID-03672 | 0.62 | 0.00 |
| SEQID-03656 | 0.61 | 0.00 |
| SEQID-03517 | 0.60 | 0.00 |
| SEQID-03493 | 0.60 | 0.00 |
| SEQID-03816 | 0.60 | 0.00 |
| SEQID-03796 | 0.59 | 0.00 |
| SEQID-03868 | 0.59 | 0.00 |
| SEQID-03740 | 0.59 | 0.00 |

An exemplary list of the top 10 nutritive polypeptide sequences enriched in cysteine that met the above cutoffs in solvation score, aggregation score, global allergen homology, allergenicity score, toxicity score, and anti-nutricity score is shown in table E5I. The top 10 nutritive polypeptide sequences reduced in cysteine are shown in table E5J.

TABLE E5I

| SEQID | EAA | C |
|---|---|---|
| SEQID-03495 | 0.24 | 0.30 |
| SEQID-03514 | 0.24 | 0.30 |
| SEQID-03571 | 0.24 | 0.28 |
| SEQID-03430 | 0.36 | 0.27 |
| SEQID-03419 | 0.37 | 0.16 |
| SEQID-03478 | 0.29 | 0.16 |
| SEQID-03523 | 0.33 | 0.16 |
| SEQID-03504 | 0.35 | 0.16 |
| SEQID-03477 | 0.28 | 0.16 |
| SEQID-03459 | 0.10 | 0.16 |

TABLE E5J

| SEQID | EAA | C |
|---|---|---|
| SEQID-03636 | 0.65 | 0.00 |
| SEQID-03492 | 0.63 | 0.00 |
| SEQID-03484 | 0.62 | 0.00 |
| SEQID-03442 | 0.61 | 0.00 |
| SEQID-03417 | 0.61 | 0.00 |
| SEQID-03563 | 0.61 | 0.00 |
| SEQID-03512 | 0.61 | 0.00 |
| SEQID-03517 | 0.60 | 0.00 |
| SEQID-03606 | 0.60 | 0.00 |
| SEQID-03493 | 0.60 | 0.00 |

An exemplary list of the top 10 nutritive polypeptide sequences enriched in glutamine that met the above cutoffs in solvation score, aggregation score, global allergen homology, allergenicity score, toxicity score, and anti-nutricity score is shown in table E5K. The top 10 nutritive polypeptide sequences reduced in glutamine are shown in table E5L.

TABLE E5K

| SEQID | EAA | Q |
|---|---|---|
| SEQID-03676 | 0.29 | 0.19 |
| SEQID-03720 | 0.29 | 0.19 |
| SEQID-03683 | 0.33 | 0.19 |
| SEQID-03782 | 0.46 | 0.18 |
| SEQID-03681 | 0.46 | 0.18 |
| SEQID-03852 | 0.46 | 0.18 |
| SEQID-03671 | 0.43 | 0.17 |
| SEQID-00515 | 0.25 | 0.17 |
| SEQID-03866 | 0.40 | 0.17 |
| SEQID-03824 | 0.36 | 0.16 |

TABLE E5L

| SEQID | EAA | Q |
|---|---|---|
| SEQID-03636 | 0.65 | 0.00 |
| SEQID-03795 | 0.62 | 0.00 |
| SEQID-03468 | 0.62 | 0.00 |
| SEQID-03484 | 0.62 | 0.00 |
| SEQID-03570 | 0.59 | 0.00 |
| SEQID-03422 | 0.58 | 0.00 |
| SEQID-03432 | 0.58 | 0.00 |
| SEQID-03590 | 0.58 | 0.00 |
| SEQID-03515 | 0.58 | 0.00 |
| SEQID-03499 | 0.58 | 0.00 |

An exemplary list of the top 10 nutritive polypeptide sequences enriched in histidine that met the above cutoffs in solvation score, aggregation score, global allergen homology, allergenicity score, toxicity score, and anti-nutricity score is shown in table E5M. The top 10 nutritive polypeptide sequences reduced in histidine are shown in table E5N.

TABLE E5M

| SEQID | EAA | H |
|---|---|---|
| SEQID-03744 | 0.60 | 0.25 |
| SEQID-03551 | 0.48 | 0.24 |
| SEQID-03745 | 0.56 | 0.19 |
| SEQID-03793 | 0.59 | 0.19 |
| SEQID-03468 | 0.62 | 0.15 |
| SEQID-03743 | 0.38 | 0.13 |
| SEQID-03711 | 0.56 | 0.12 |
| SEQID-03847 | 0.58 | 0.12 |
| SEQID-03637 | 0.43 | 0.12 |
| SEQID-03739 | 0.52 | 0.12 |

TABLE E5N

| SEQID | EAA | H |
|---|---|---|
| SEQID-03795 | 0.62 | 0.00 |
| SEQID-03874 | 0.62 | 0.00 |
| SEQID-03656 | 0.61 | 0.00 |
| SEQID-03517 | 0.60 | 0.00 |
| SEQID-03493 | 0.60 | 0.00 |
| SEQID-03816 | 0.60 | 0.00 |
| SEQID-03796 | 0.59 | 0.00 |
| SEQID-03740 | 0.59 | 0.00 |
| SEQID-03814 | 0.58 | 0.00 |
| SEQID-03837 | 0.57 | 0.00 |

An exemplary list of the top 10 nutritive polypeptide sequences enriched in isoleucine that met the above cutoffs in solvation score, aggregation score, global allergen homology, allergenicity score, toxicity score, and anti-nutricity score, is shown in table E5O. The top 10 nutritive polypeptide sequences reduced in isoleucine are shown in table E5P.

TABLE E5O

| SEQID | EAA | I |
|---|---|---|
| SEQID-03722 | 0.40 | 0.15 |
| SEQID-03805 | 0.38 | 0.15 |
| SEQID-03435 | 0.40 | 0.15 |
| SEQID-03838 | 0.42 | 0.15 |
| SEQID-03655 | 0.54 | 0.15 |
| SEQID-03828 | 0.49 | 0.15 |
| SEQID-03593 | 0.39 | 0.15 |
| SEQID-03818 | 0.51 | 0.15 |
| SEQID-03841 | 0.49 | 0.15 |
| SEQID-03843 | 0.48 | 0.14 |

TABLE E5P

| SEQID | EAA | I |
|---|---|---|
| SEQID-03581 | 0.60 | 0.00 |
| SEQID-03685 | 0.57 | 0.00 |
| SEQID-03705 | 0.56 | 0.00 |
| SEQID-03660 | 0.55 | 0.00 |
| SEQID-03779 | 0.53 | 0.00 |
| SEQID-03781 | 0.52 | 0.00 |
| SEQID-03647 | 0.51 | 0.00 |
| SEQID-03785 | 0.50 | 0.00 |
| SEQID-03865 | 0.50 | 0.00 |
| SEQID-03802 | 0.49 | 0.00 |

An exemplary list of the top 10 nutritive polypeptide sequences enriched in leucine that met the above cutoffs in solvation score, aggregation score, global allergen homology, allergenicity score, toxicity score, and anti-nutricity score is shown in table E5Q. The top 10 nutritive polypeptide sequences reduced in leucine are shown in table E5R.

TABLE E5Q

| SEQID | EAA | L |
|---|---|---|
| SEQID-03552 | 0.56 | 0.21 |
| SEQID-03428 | 0.49 | 0.18 |
| SEQID-03623 | 0.49 | 0.18 |
| SEQID-03702 | 0.47 | 0.18 |
| SEQID-03701 | 0.49 | 0.18 |
| SEQID-03703 | 0.49 | 0.18 |
| SEQID-03599 | 0.51 | 0.18 |
| SEQID-03494 | 0.54 | 0.18 |
| SEQID-03632 | 0.45 | 0.18 |
| SEQID-03423 | 0.44 | 0.18 |

TABLE E5R

| SEQID | EAA | L |
|---|---|---|
| SEQID-03661 | 0.53 | 0.00 |
| SEQID-03849 | 0.52 | 0.00 |
| SEQID-03644 | 0.42 | 0.00 |
| SEQID-03878 | 0.39 | 0.00 |
| SEQID-03652 | 0.38 | 0.00 |
| SEQID-03419 | 0.37 | 0.00 |
| SEQID-03654 | 0.36 | 0.00 |
| SEQID-03804 | 0.36 | 0.00 |
| SEQID-03504 | 0.35 | 0.00 |
| SEQID-03477 | 0.28 | 0.00 |

An exemplary list of the top 10 nutritive polypeptide sequences enriched in lysine that met the above cutoffs in solvation score, aggregation score, global allergen homology, allergenicity score, toxicity score, and anti-nutricity score is shown in table E5S. The top 10 nutritive polypeptide sequences reduced in lysine are shown in table E5T.

TABLE E5S

| SEQID | EAA | K |
|---|---|---|
| SEQID-03648 | 0.52 | 0.36 |
| SEQID-03797 | 0.56 | 0.34 |
| SEQID-03830 | 0.52 | 0.31 |
| SEQID-03829 | 0.54 | 0.30 |
| SEQID-03581 | 0.60 | 0.30 |
| SEQID-03520 | 0.36 | 0.30 |
| SEQID-03457 | 0.37 | 0.30 |
| SEQID-03471 | 0.36 | 0.29 |
| SEQID-03859 | 0.53 | 0.29 |
| SEQID-03456 | 0.34 | 0.29 |

TABLE E5T

| SEQID | EAA | K |
|---|---|---|
| SEQID-03583 | 0.42 | 0.00 |
| SEQID-03684 | 0.40 | 0.00 |
| SEQID-03813 | 0.36 | 0.00 |
| SEQID-03771 | 0.28 | 0.00 |
| SEQID-03873 | 0.26 | 0.00 |
| SEQID-03585 | 0.25 | 0.00 |
| SEQID-03704 | 0.17 | 0.00 |
| SEQID-03767 | 0.17 | 0.00 |
| SEQID-03731 | 0.16 | 0.00 |
| SEQID-03459 | 0.10 | 0.00 |

An exemplary list of the top 10 nutritive polypeptide sequences enriched in methionine that met the above cutoffs in solvation score, aggregation score, global allergen homology, allergenicity score, toxicity score, and anti-nutricity score is shown in table E5U. The top 10 nutritive polypeptide sequences reduced in arginine are shown in table E5V.

TABLE E5U

| SEQID | EAA | M |
|---|---|---|
| SEQID-00552 | 0.45 | 0.16 |
| SEQID-03870 | 0.52 | 0.15 |
| SEQID-03680 | 0.49 | 0.15 |
| SEQID-03888 | 0.39 | 0.13 |
| SEQID-03738 | 0.37 | 0.13 |
| SEQID-03698 | 0.47 | 0.13 |
| SEQID-03584 | 0.53 | 0.12 |
| SEQID-03487 | 0.53 | 0.11 |
| SEQID-03858 | 0.49 | 0.11 |
| SEQID-03787 | 0.46 | 0.11 |

TABLE E5V

| SEQID | EAA | M |
|---|---|---|
| SEQID-03701 | 0.49 | 0.00 |
| SEQID-03861 | 0.49 | 0.00 |
| SEQID-03703 | 0.49 | 0.00 |
| SEQID-03702 | 0.47 | 0.00 |
| SEQID-03773 | 0.46 | 0.00 |
| SEQID-03707 | 0.45 | 0.00 |
| SEQID-03726 | 0.41 | 0.00 |
| SEQID-03725 | 0.39 | 0.00 |
| SEQID-03734 | 0.39 | 0.00 |
| SEQID-03700 | 0.37 | 0.00 |

An exemplary list of the top 10 nutritive polypeptide sequences enriched in phenylalanine that met the above cutoffs in solvation score, aggregation score, global allergen homology, allergenicity score, toxicity score, and anti-nutricity score is shown in table E5W. The top 10 nutritive polypeptide sequences reduced in phenylalanine are shown in table E5X.

TABLE E5W

| SEQID | EAA | F |
|---|---|---|
| SEQID-03761 | 0.48 | 0.14 |
| SEQID-03831 | 0.56 | 0.14 |
| SEQID-03836 | 0.55 | 0.13 |
| SEQID-03437 | 0.41 | 0.13 |
| SEQID-03749 | 0.41 | 0.13 |
| SEQID-03558 | 0.44 | 0.13 |
| SEQID-03791 | 0.49 | 0.13 |
| SEQID-03729 | 0.50 | 0.12 |
| SEQID-03846 | 0.40 | 0.12 |
| SEQID-03862 | 0.50 | 0.12 |

TABLE E5X

| SEQID | EAA | F |
|---|---|---|
| SEQID-03581 | 0.60 | 0.00 |
| SEQID-03441 | 0.57 | 0.00 |
| SEQID-03685 | 0.57 | 0.00 |
| SEQID-03573 | 0.55 | 0.00 |
| SEQID-03661 | 0.53 | 0.00 |
| SEQID-03859 | 0.53 | 0.00 |
| SEQID-03688 | 0.53 | 0.00 |
| SEQID-03675 | 0.53 | 0.00 |
| SEQID-03609 | 0.53 | 0.00 |
| SEQID-03584 | 0.53 | 0.00 |

An exemplary list of the top 10 nutritive polypeptide sequences enriched in proline that met the above cutoffs in solvation score, aggregation score, global allergen homology, allergenicity score, toxicity score, and anti-nutricity score is shown in table E5Y. The top 10 nutritive polypeptide sequences reduced in proline are shown in table E5Z.

TABLE E5Y

| SEQID | EAA | P |
|---|---|---|
| SEQID-03800 | 0.33 | 0.16 |
| SEQID-03756 | 0.32 | 0.14 |
| SEQID-03839 | 0.35 | 0.14 |
| SEQID-03810 | 0.33 | 0.13 |
| SEQID-03888 | 0.39 | 0.13 |
| SEQID-03845 | 0.41 | 0.13 |
| SEQID-03834 | 0.39 | 0.13 |
| SEQID-03658 | 0.35 | 0.13 |

TABLE E5Y-continued

| SEQID | EAA | P |
| --- | --- | --- |
| SEQID-03856 | 0.44 | 0.12 |
| SEQID-03799 | 0.37 | 0.12 |

TABLE E5Z

| SEQID | EAA | P |
| --- | --- | --- |
| SEQID-03636 | 0.65 | 0.00 |
| SEQID-03468 | 0.62 | 0.00 |
| SEQID-03790 | 0.57 | 0.00 |
| SEQID-03486 | 0.57 | 0.00 |
| SEQID-03665 | 0.56 | 0.00 |
| SEQID-03833 | 0.56 | 0.00 |
| SEQID-03588 | 0.56 | 0.00 |
| SEQID-03808 | 0.56 | 0.00 |
| SEQID-03719 | 0.56 | 0.00 |
| SEQID-03815 | 0.55 | 0.00 |

An exemplary list of the top 10 nutritive polypeptide sequences enriched in serine that met the above cutoffs in solvation score, aggregation score, global allergen homology, allergenicity score, toxicity score, and anti-nutricity score is shown in table E5AA. The top 10 nutritive polypeptide sequences reduced in serine are shown in table E5AB.

TABLE E5AA

| SEQID | EAA | S |
| --- | --- | --- |
| SEQID-03747 | 0.45 | 0.16 |
| SEQID-03863 | 0.27 | 0.15 |
| SEQID-03737 | 0.32 | 0.15 |
| SEQID-03759 | 0.40 | 0.15 |
| SEQID-03882 | 0.39 | 0.15 |
| SEQID-03748 | 0.41 | 0.14 |
| SEQID-03792 | 0.41 | 0.14 |
| SEQID-03844 | 0.37 | 0.14 |
| SEQID-03751 | 0.47 | 0.14 |
| SEQID-03822 | 0.45 | 0.14 |

TABLE E5AB

| SEQID | EAA | S |
| --- | --- | --- |
| SEQID-03441 | 0.57 | 0.00 |
| SEQID-03867 | 0.55 | 0.00 |
| SEQID-03645 | 0.43 | 0.00 |
| SEQID-03455 | 0.35 | 0.00 |
| SEQID-03775 | 0.30 | 0.00 |
| SEQID-03771 | 0.28 | 0.00 |
| SEQID-03772 | 0.28 | 0.00 |
| SEQID-03716 | 0.26 | 0.00 |
| SEQID-03873 | 0.26 | 0.00 |
| SEQID-03508 | 0.41 | 0.01 |

An exemplary list of the top 10 nutritive polypeptide sequences enriched in threonine that met the above cutoffs in solvation score, aggregation score; global allergen homology, allergenicity score, toxicity score, and anti-nutricity score is shown in table E5AC. The top 10 nutritive polypeptide sequences reduced in threonine are shown in table E5AD.

TABLE E5AC

| SEQID | EAA | T |
| --- | --- | --- |
| SEQID-03718 | 0.42 | 0.16 |
| SEQID-03777 | 0.46 | 0.14 |
| SEQID-03713 | 0.42 | 0.12 |
| SEQID-03871 | 0.44 | 0.12 |
| SEQID-03867 | 0.55 | 0.12 |
| SEQID-03819 | 0.48 | 0.12 |
| SEQID-03820 | 0.41 | 0.11 |
| SEQID-03653 | 0.39 | 0.11 |
| SEQID-03717 | 0.38 | 0.11 |
| SEQID-03877 | 0.45 | 0.11 |

TABLE E5AD

| SEQID | EAA | T |
| --- | --- | --- |
| SEQID-03744 | 0.60 | 0.00 |
| SEQID-03745 | 0.56 | 0.00 |
| SEQID-03661 | 0.53 | 0.00 |
| SEQID-03830 | 0.52 | 0.00 |
| SEQID-03849 | 0.52 | 0.00 |
| SEQID-03887 | 0.51 | 0.00 |
| SEQID-03886 | 0.50 | 0.00 |
| SEQID-03670 | 0.48 | 0.00 |
| SEQID-03551 | 0.48 | 0.00 |
| SEQID-03780 | 0.47 | 0.00 |

An exemplary list of the top 10 nutritive polypeptide sequences enriched in tryptophan that met the above cutoffs in solvation score, aggregation score, global allergen homology, allergenicity score, toxicity score, and anti-nutricity score is shown in table E5AE. The top 10 nutritive polypeptide sequences reduced in tryptophan are shown in table E5AF.

TABLE E5AE

| SEQID | EAA | W |
| --- | --- | --- |
| SEQID-03583 | 0.42 | 0.15 |
| SEQID-03635 | 0.40 | 0.13 |
| SEQID-03555 | 0.50 | 0.11 |
| SEQID-03679 | 0.48 | 0.09 |
| SEQID-03440 | 0.44 | 0.09 |
| SEQID-03439 | 0.45 | 0.09 |
| SEQID-03468 | 0.62 | 0.08 |
| SEQID-01546 | 0.51 | 0.08 |
| SEQID-03576 | 0.42 | 0.08 |
| SEQID-03821 | 0.44 | 0.08 |

TABLE E5AF

| SEQID | EAA | W |
| --- | --- | --- |
| SEQID-03672 | 0.62 | 0.00 |
| SEQID-03512 | 0.61 | 0.00 |
| SEQID-03606 | 0.60 | 0.00 |
| SEQID-03744 | 0.60 | 0.00 |
| SEQID-03581 | 0.60 | 0.00 |
| SEQID-03868 | 0.59 | 0.00 |
| SEQID-03762 | 0.59 | 0.00 |
| SEQID-03857 | 0.59 | 0.00 |
| SEQID-03793 | 0.59 | 0.00 |
| SEQID-03769 | 0.59 | 0.00 |

An exemplary list of the top 10 nutritive polypeptide sequences enriched in tyrosine that met the above cutoffs in solvation score, aggregation score, global allergen homology, allergenicity score, toxicity score, and anti-nutricity score is shown in table E5AG. The top 10 nutritive polypeptide sequences reduced in tyrosine are shown in table E5AH.

TABLE E5AG

| SEQID | EAA | Y |
|---|---|---|
| SEQID-03848 | 0.32 | 0.16 |
| SEQID-03831 | 0.56 | 0.15 |
| SEQID-03876 | 0.26 | 0.15 |
| SEQID-00325 | 0.42 | 0.14 |
| SEQID-03794 | 0.43 | 0.14 |
| SEQID-03826 | 0.38 | 0.14 |
| SEQID-03659 | 0.46 | 0.14 |
| SEQID-03786 | 0.35 | 0.14 |
| SEQID-03784 | 0.38 | 0.14 |
| SEQID-03823 | 0.39 | 0.14 |

TABLE E5AH

| SEQID | EAA | Y |
|---|---|---|
| SEQID-03468 | 0.62 | 0.00 |
| SEQID-03442 | 0.61 | 0.00 |
| SEQID-03417 | 0.61 | 0.00 |
| SEQID-03563 | 0.61 | 0.00 |
| SEQID-03606 | 0.60 | 0.00 |
| SEQID-03469 | 0.60 | 0.00 |
| SEQID-03443 | 0.60 | 0.00 |
| SEQID-03581 | 0.60 | 0.00 |
| SEQID-03796 | 0.59 | 0.00 |
| SEQID-03762 | 0.59 | 0.00 |

An exemplary list of the top 10 nutritive polypeptide sequences enriched in valine that met the above cutoffs in solvation score, aggregation score, global allergen homology, allergenicity score, toxicity score, and anti-nutricity score is shown in table E5AI. The top 10 nutritive polypeptide sequences reduced in valine are shown in table E5AJ.

TABLE E5AI

| SEQID | EAA | V |
|---|---|---|
| SEQID-03881 | 0.49 | 0.17 |
| SEQID-03790 | 0.57 | 0.17 |
| SEQID-03808 | 0.56 | 0.17 |
| SEQID-03606 | 0.60 | 0.17 |
| SEQID-03688 | 0.53 | 0.16 |
| SEQID-03806 | 0.55 | 0.16 |
| SEQID-03643 | 0.51 | 0.15 |
| SEQID-03788 | 0.58 | 0.14 |
| SEQID-03762 | 0.59 | 0.14 |
| SEQID-03674 | 0.51 | 0.14 |

TABLE E5AJ

| SEQID | EAA | V |
|---|---|---|
| SEQID-03879 | 0.56 | 0.00 |
| SEQID-03552 | 0.56 | 0.00 |
| SEQID-03835 | 0.54 | 0.00 |
| SEQID-03851 | 0.53 | 0.00 |
| SEQID-03757 | 0.53 | 0.00 |
| SEQID-03648 | 0.52 | 0.00 |
| SEQID-03766 | 0.50 | 0.00 |
| SEQID-03710 | 0.46 | 0.00 |
| SEQID-03764 | 0.46 | 0.00 |
| SEQID-00552 | 0.45 | 0.00 |

Selection of Expressed Proteins Enriched in Essential Amino Acids and Enriched or Reduced in Various Individual Amino Acids.

Using the database of all expressed protein sequences described herein, candidate sequences enriched in essential amino acids with elevated or reduced amounts of each amino acid were identified. When searching for proteins enriched or reduced in a given amino acid, proteins were rank ordered by their calculated amino acid, mass fraction of the desired amino acid and then by their essential amino acid content.

An exemplary list of the top 10 nutritive polypeptide sequences enriched in alanine is shown in table E5AK. The top 10 nutritive polypeptide sequences reduced in alanine are shown in table E5AL.

TABLE E5AK

| SEQID | EAA | A |
|---|---|---|
| SEQID-00499 | 0.34 | 0.18 |
| SEQID-00512 | 0.44 | 0.17 |
| SEQID-00651 | 0.39 | 0.17 |
| SEQID-00519 | 0.38 | 0.16 |
| SEQID-02704 | 0.42 | 0.16 |
| SEQID-02703 | 0.42 | 0.13 |
| SEQID-00530 | 0.37 | 0.13 |
| SEQID-00544 | 0.45 | 0.12 |
| SEQID-00549 | 0.40 | 0.12 |
| SEQID-02675 | 0.50 | 0.11 |

TABLE E5AL

| SEQID | EAA | A |
|---|---|---|
| SEQID-00140 | 0.70 | 0.00 |
| SEQID-00057 | 0.41 | 0.00 |
| SEQID-00652 | 0.28 | 0.00 |
| SEQID-00199 | 0.52 | 0.00 |
| SEQID-00198 | 0.53 | 0.00 |
| SEQID-00197 | 0.52 | 0.00 |
| SEQID-00196 | 0.53 | 0.00 |
| SEQID-00722 | 0.53 | 0.01 |
| SEQID-00204 | 0.51 | 0.01 |
| SEQID-00203 | 0.51 | 0.01 |

An exemplary list of the top 10 nutritive polypeptide sequences enriched in arginine is shown in table E5AM. The top 10 nutritive polypeptide sequences reduced in arginine are shown in table E5AN.

TABLE E5AM

| SEQID | EAA | R |
|---|---|---|
| SEQID-00540 | 0.41 | 0.23 |
| SEQID-00567 | 0.42 | 0.22 |
| SEQID-00636 | 0.47 | 0.22 |
| SEQID-00556 | 0.33 | 0.22 |
| SEQID-00637 | 0.42 | 0.22 |
| SEQID-00575 | 0.33 | 0.22 |
| SEQID-00492 | 0.42 | 0.21 |
| SEQID-00631 | 0.38 | 0.21 |
| SEQID-00551 | 0.41 | 0.21 |
| SEQID-00328 | 0.45 | 0.20 |

TABLE E5AN

| SEQID | EAA | R |
|---|---|---|
| SEQID-00140 | 0.70 | 0.00 |
| SEQID-00146 | 0.67 | 0.00 |
| SEQID-00150 | 0.67 | 0.00 |
| SEQID-00143 | 0.65 | 0.00 |
| SEQID-00525 | 0.64 | 0.00 |

TABLE E5AN-continued

| SEQID | EAA | R |
|---|---|---|
| SEQID-00162 | 0.64 | 0.00 |
| SEQID-00175 | 0.63 | 0.00 |
| SEQID-00169 | 0.60 | 0.00 |
| SEQID-00548 | 0.59 | 0.00 |
| SEQID-00536 | 0.58 | 0.00 |

An exemplary list of the top 10 nutritive polypeptide sequences enriched in asparagine is shown in table E5AO. The top 10 nutritive polypeptide sequences reduced in asparagine are shown in table E5AP.

TABLE E5AO

| SEQID | EAA | N |
|---|---|---|
| SEQID-00195 | 0.52 | 0.14 |
| SEQID-00194 | 0.54 | 0.14 |
| SEQID-00193 | 0.53 | 0.12 |
| SEQID-03872 | 0.47 | 0.12 |
| SEQID-01388 | 0.36 | 0.12 |
| SEQID-00552 | 0.45 | 0.12 |
| SEQID-00169 | 0.60 | 0.11 |
| SEQID-00196 | 0.53 | 0.10 |
| SEQID-00197 | 0.52 | 0.10 |
| SEQID-03693 | 0.34 | 0.10 |

TABLE E5AP

| SEQID | EAA | N |
|---|---|---|
| SEQID-00536 | 0.58 | 0.00 |
| SEQID-00284 | 0.54 | 0.00 |
| SEQID-00212 | 0.51 | 0.00 |
| SEQID-00101 | 0.51 | 0.00 |
| SEQID-00219 | 0.50 | 0.00 |
| SEQID-00634 | 0.50 | 0.00 |
| SEQID-00624 | 0.49 | 0.00 |
| SEQID-00639 | 0.46 | 0.00 |
| SEQID-00597 | 0.45 | 0.00 |
| SEQID-00527 | 0.40 | 0.00 |

An exemplary list of the top 10 nutritive polypeptide sequences enriched in aspartic acid is shown in table E5AQ. The top 10 nutritive polypeptide sequences reduced in aspartic acid are shown in table E5AR.

TABLE E5AQ

| SEQID | EAA | D |
|---|---|---|
| SEQID-00562 | 0.40 | 0.19 |
| SEQID-03853 | 0.34 | 0.17 |
| SEQID-00116 | 0.32 | 0.16 |
| SEQID-00102 | 0.45 | 0.16 |
| SEQID-00115 | 0.32 | 0.16 |
| SEQID-00484 | 0.38 | 0.16 |
| SEQID-00100 | 0.46 | 0.15 |
| SEQID-00220 | 0.52 | 0.15 |
| SEQID-00098 | 0.50 | 0.15 |
| SEQID-00078 | 0.46 | 0.14 |

TABLE E5AR

| SEQID | EAA | D |
|---|---|---|
| SEQID-00166 | 0.65 | 0.00 |
| SEQID-00051 | 0.59 | 0.00 |
| SEQID-00052 | 0.59 | 0.00 |
| SEQID-00053 | 0.57 | 0.00 |

TABLE E5AR-continued

| SEQID | EAA | D |
|---|---|---|
| SEQID-00054 | 0.55 | 0.00 |
| SEQID-00055 | 0.55 | 0.00 |
| SEQID-00523 | 0.51 | 0.00 |
| SEQID-00635 | 0.46 | 0.00 |
| SEQID-00230 | 0.45 | 0.00 |
| SEQID-00637 | 0.42 | 0.00 |

An exemplary list of the top 10 nutritive polypeptide sequences enriched in cysteine is shown in table E5AS. The top 10 nutritive polypeptide sequences reduced in cysteine are shown in table E5AT.

TABLE E5AS

| SEQID | EAA | C |
|---|---|---|
| SEQID-00737 | 0.28 | 0.18 |
| SEQID-00652 | 0.28 | 0.16 |
| SEQID-00007 | 0.28 | 0.13 |
| SEQID-00007 | 0.28 | 0.13 |
| SEQID-00558 | 0.36 | 0.13 |
| SEQID-00013 | 0.28 | 0.12 |
| SEQID-00014 | 0.30 | 0.12 |
| SEQID-00989 | 0.34 | 0.12 |
| SEQID-00566 | 0.38 | 0.11 |
| SEQID-00596 | 0.44 | 0.11 |

TABLE E5AT

| SEQID | EAA | C |
|---|---|---|
| SEQID-00166 | 0.65 | 0.00 |
| SEQID-00137 | 0.64 | 0.00 |
| SEQID-00525 | 0.64 | 0.00 |
| SEQID-00162 | 0.64 | 0.00 |
| SEQID-03297 | 0.62 | 0.00 |
| SEQID-00169 | 0.60 | 0.00 |
| SEQID-00132 | 0.60 | 0.00 |
| SEQID-00298 | 0.59 | 0.00 |
| SEQID-00536 | 0.58 | 0.00 |
| SEQID-00297 | 0.58 | 0.00 |

An exemplary list of the top 10 nutritive polypeptide sequences enriched in glutamine is shown in table E5AU. The top 10 nutritive polypeptide sequences reduced in glutamine are shown in table E5AV.

TABLE E5AU

| SEQID | EAA | Q |
|---|---|---|
| SEQID-00743 | 0.29 | 0.22 |
| SEQID-00513 | 0.33 | 0.17 |
| SEQID-03695 | 0.38 | 0.17 |
| SEQID-00522 | 0.40 | 0.17 |
| SEQID-00515 | 0.25 | 0.17 |
| SEQID-03692 | 0.44 | 0.14 |
| SEQID-03666 | 0.35 | 0.13 |
| SEQID-00613 | 0.36 | 0.13 |
| SEQID-00585 | 0.44 | 0.13 |
| SEQID-00223 | 0.50 | 0.13 |

TABLE E5AV

| SEQID | EAA | Q |
|---|---|---|
| SEQID-00143 | 0.65 | 0.00 |
| SEQID-00137 | 0.64 | 0.00 |
| SEQID-00525 | 0.64 | 0.00 |

TABLE E5AV-continued

| SEQID | EAA | Q |
|---|---|---|
| SEQID-00134 | 0.58 | 0.00 |
| SEQID-00194 | 0.54 | 0.00 |
| SEQID-00193 | 0.53 | 0.00 |
| SEQID-00195 | 0.52 | 0.00 |
| SEQID-00650 | 0.50 | 0.00 |
| SEQID-00563 | 0.50 | 0.00 |
| SEQID-00598 | 0.49 | 0.00 |

An exemplary list of the top 10 nutritive polypeptide sequences enriched in histidine is shown in table E5AW. The top 10 nutritive polypeptide sequences reduced in histidine are shown in table E5AX.

TABLE E5AW

| SEQID | EAA | H |
|---|---|---|
| SEQID-00536 | 0.58 | 0.23 |
| SEQID-00560 | 0.55 | 0.18 |
| SEQID-01162 | 0.48 | 0.12 |
| SEQID-00585 | 0.44 | 0.10 |
| SEQID-00298 | 0.59 | 0.10 |
| SEQID-00615 | 0.40 | 0.10 |
| SEQID-00525 | 0.64 | 0.10 |
| SEQID-00297 | 0.58 | 0.10 |
| SEQID-00764 | 0.56 | 0.09 |
| SEQID-00128 | 0.53 | 0.08 |

TABLE E5AX

| SEQID | EAA | H |
|---|---|---|
| SEQID-00043 | 0.57 | 0.00 |
| SEQID-00531 | 0.55 | 0.00 |
| SEQID-00592 | 0.53 | 0.00 |
| SEQID-00224 | 0.53 | 0.00 |
| SEQID-00024 | 0.52 | 0.00 |
| SEQID-00625 | 0.52 | 0.00 |
| SEQID-00233 | 0.52 | 0.00 |
| SEQID-00587 | 0.51 | 0.00 |
| SEQID-00213 | 0.51 | 0.00 |
| SEQID-00214 | 0.51 | 0.00 |

An exemplary list of the top 10 nutritive polypeptide sequences enriched in isoleucine is shown in table E5AY. The top 10 nutritive polypeptide sequences reduced in isoleucine are shown in table E5AZ.

TABLE E5AY

| SEQID | EAA | I |
|---|---|---|
| SEQID-00561 | 0.68 | 0.18 |
| SEQID-00134 | 0.58 | 0.14 |
| SEQID-00175 | 0.63 | 0.14 |
| SEQID-00162 | 0.64 | 0.14 |
| SEQID-00234 | 0.51 | 0.13 |
| SEQID-00233 | 0.52 | 0.13 |
| SEQID-00169 | 0.60 | 0.13 |
| SEQID-00025 | 0.48 | 0.13 |
| SEQID-00043 | 0.57 | 0.12 |
| SEQID-00584 | 0.50 | 0.12 |

TABLE E5AZ

| SEQID | EAA | I |
|---|---|---|
| SEQID-00762 | 0.56 | 0.00 |
| SEQID-00764 | 0.56 | 0.00 |

TABLE E5AZ-continued

| SEQID | EAA | I |
|---|---|---|
| SEQID-00571 | 0.54 | 0.00 |
| SEQID-00212 | 0.51 | 0.00 |
| SEQID-00237 | 0.48 | 0.00 |
| SEQID-00236 | 0.45 | 0.00 |
| SEQID-00551 | 0.41 | 0.00 |
| SEQID-00515 | 0.25 | 0.01 |
| SEQID-00128 | 0.53 | 0.01 |
| SEQID-00651 | 0.39 | 0.01 |

An exemplary list of the top 10 nutritive polypeptide sequences enriched in leucine is shown in table E5BA. The top 10 nutritive polypeptide sequences reduced in leucine are shown in table E5BB.

TABLE E5BA

| SEQID | EAA | L |
|---|---|---|
| SEQID-00162 | 0.64 | 0.34 |
| SEQID-00132 | 0.60 | 0.32 |
| SEQID-00195 | 0.52 | 0.26 |
| SEQID-00194 | 0.54 | 0.26 |
| SEQID-00193 | 0.53 | 0.26 |
| SEQID-00166 | 0.65 | 0.26 |
| SEQID-00169 | 0.60 | 0.25 |
| SEQID-00134 | 0.58 | 0.24 |
| SEQID-00212 | 0.51 | 0.23 |
| SEQID-00139 | 0.49 | 0.23 |

TABLE E5BB

| SEQID | EAA | L |
|---|---|---|
| SEQID-00553 | 0.39 | 0.00 |
| SEQID-00743 | 0.29 | 0.00 |
| SEQID-00522 | 0.40 | 0.01 |
| SEQID-00554 | 0.38 | 0.01 |
| SEQID-00585 | 0.44 | 0.01 |
| SEQID-00560 | 0.55 | 0.01 |
| SEQID-00529 | 0.38 | 0.01 |
| SEQID-00552 | 0.45 | 0.01 |
| SEQID-00547 | 0.49 | 0.01 |
| SEQID-00575 | 0.33 | 0.01 |

An exemplary list of the top 10 nutritive polypeptide sequences enriched in lysine is shown in table E5BC. The top 10 nutritive polypeptide sequences reduced in lysine are shown in table E5BD.

TABLE E5BC

| SEQID | EAA | K |
|---|---|---|
| SEQID-00560 | 0.55 | 0.26 |
| SEQID-00573 | 0.54 | 0.23 |
| SEQID-00619 | 0.51 | 0.23 |
| SEQID-00553 | 0.39 | 0.23 |
| SEQID-00572 | 0.54 | 0.23 |
| SEQID-00623 | 0.54 | 0.23 |
| SEQID-03691 | 0.52 | 0.23 |
| SEQID-00503 | 0.49 | 0.22 |
| SEQID-00564 | 0.51 | 0.22 |
| SEQID-00517 | 0.49 | 0.22 |

TABLE E5BD

| SEQID | EAA | K |
|---|---|---|
| SEQID-00166 | 0.65 | 0.00 |
| SEQID-00175 | 0.63 | 0.00 |
| SEQID-00169 | 0.60 | 0.00 |

TABLE E5BD-continued

| SEQID | EAA | K |
|---|---|---|
| SEQID-00134 | 0.58 | 0.00 |
| SEQID-00535 | 0.30 | 0.00 |
| SEQID-00513 | 0.33 | 0.01 |
| SEQID-02675 | 0.50 | 0.01 |
| SEQID-00490 | 0.58 | 0.01 |
| SEQID-00512 | 0.44 | 0.01 |
| SEQID-00500 | 0.40 | 0.01 |

An exemplary list of the top 10 nutritive polypeptide sequences enriched in methionine is shown in table E5BE. The top 10 nutritive polypeptide sequences reduced in arginine are shown in table E5BF.

TABLE E5BE

| SEQID | EAA | M |
|---|---|---|
| SEQID-00552 | 0.45 | 0.16 |
| SEQID-00513 | 0.33 | 0.13 |
| SEQID-00529 | 0.38 | 0.09 |
| SEQID-00526 | 0.41 | 0.09 |
| SEQID-00868 | 0.48 | 0.09 |
| SEQID-00595 | 0.44 | 0.09 |
| SEQID-00584 | 0.50 | 0.09 |
| SEQID-00486 | 0.56 | 0.09 |
| SEQID-00092 | 0.42 | 0.08 |
| SEQID-00074 | 0.42 | 0.08 |

TABLE E5BF

| SEQID | EAA | M |
|---|---|---|
| SEQID-00132 | 0.60 | 0.00 |
| SEQID-00051 | 0.59 | 0.00 |
| SEQID-00052 | 0.59 | 0.00 |
| SEQID-00043 | 0.57 | 0.00 |
| SEQID-00053 | 0.57 | 0.00 |
| SEQID-00055 | 0.55 | 0.00 |
| SEQID-00054 | 0.55 | 0.00 |
| SEQID-00224 | 0.53 | 0.00 |
| SEQID-00024 | 0.52 | 0.00 |
| SEQID-00220 | 0.52 | 0.00 |

An exemplary list of the top 10 nutritive polypeptide sequences enriched in phenylalanine is shown in table E5BG. The top 10 nutritive polypeptide sequences reduced in phenylalanine are shown in table E5BH.

TABLE E5BG

| SEQID | EAA | F |
|---|---|---|
| SEQID-00150 | 0.67 | 0.13 |
| SEQID-00595 | 0.44 | 0.13 |
| SEQID-00561 | 0.68 | 0.13 |
| SEQID-00118 | 0.51 | 0.12 |
| SEQID-00597 | 0.45 | 0.12 |
| SEQID-00507 | 0.51 | 0.12 |
| SEQID-00594 | 0.44 | 0.12 |
| SEQID-00501 | 0.50 | 0.12 |
| SEQID-00175 | 0.63 | 0.11 |
| SEQID-00485 | 0.46 | 0.11 |

TABLE E5BH

| SEQID | EAA | F |
|---|---|---|
| SEQID-00162 | 0.64 | 0.00 |
| SEQID-00560 | 0.55 | 0.00 |
| SEQID-00224 | 0.53 | 0.00 |
| SEQID-00220 | 0.52 | 0.00 |
| SEQID-00195 | 0.52 | 0.00 |
| SEQID-00241 | 0.52 | 0.00 |
| SEQID-00215 | 0.51 | 0.00 |
| SEQID-00213 | 0.51 | 0.00 |
| SEQID-00214 | 0.51 | 0.00 |
| SEQID-00212 | 0.51 | 0.00 |

An exemplary list of the top 10 nutritive polypeptide sequences enriched in proline is shown in table E5BI. The top 10 nutritive polypeptide sequences reduced in proline are shown in table E5BJ.

TABLE E5BI

| SEQID | EAA | P |
|---|---|---|
| SEQID-00743 | 0.29 | 0.28 |
| SEQID-00553 | 0.39 | 0.24 |
| SEQID-03641 | 0.24 | 0.20 |
| SEQID-03444 | 0.23 | 0.16 |
| SEQID-00169 | 0.60 | 0.14 |
| SEQID-00005 | 0.48 | 0.14 |
| SEQID-00805 | 0.50 | 0.13 |
| SEQID-00737 | 0.28 | 0.13 |
| SEQID-03451 | 0.40 | 0.11 |
| SEQID-03447 | 0.30 | 0.10 |

TABLE E5BJ

| SEQID | EAA | P |
|---|---|---|
| SEQID-00150 | 0.67 | 0.00 |
| SEQID-00137 | 0.64 | 0.00 |
| SEQID-00287 | 0.59 | 0.00 |
| SEQID-00548 | 0.59 | 0.00 |
| SEQID-00142 | 0.56 | 0.00 |
| SEQID-00560 | 0.55 | 0.00 |
| SEQID-00224 | 0.53 | 0.00 |
| SEQID-00220 | 0.52 | 0.00 |
| SEQID-00241 | 0.52 | 0.00 |
| SEQID-00216 | 0.52 | 0.00 |

An exemplary list of the top 10 nutritive polypeptide sequences enriched in serine is shown in table E5BK. The top 10 nutritive polypeptide sequences reduced in serine are shown in table E5BL.

TABLE E5BK

| SEQID | EAA | S |
|---|---|---|
| SEQID-03447 | 0.30 | 0.27 |
| SEQID-00483 | 0.42 | 0.16 |
| SEQID-00535 | 0.30 | 0.16 |
| SEQID-00630 | 0.35 | 0.14 |
| SEQID-00134 | 0.58 | 0.14 |
| SEQID-00557 | 0.47 | 0.13 |
| SEQID-03760 | 0.39 | 0.12 |
| SEQID-03642 | 0.37 | 0.12 |
| SEQID-00652 | 0.28 | 0.12 |
| SEQID-00577 | 0.47 | 0.12 |

TABLE E5BL

| SEQID | EAA | S |
|---|---|---|
| SEQID-00175 | 0.63 | 0.00 |
| SEQID-00051 | 0.59 | 0.00 |
| SEQID-00052 | 0.59 | 0.00 |

TABLE E5BL-continued

| SEQID | EAA | S |
|---|---|---|
| SEQID-00536 | 0.58 | 0.00 |
| SEQID-00043 | 0.57 | 0.00 |
| SEQID-00053 | 0.57 | 0.00 |
| SEQID-00643 | 0.57 | 0.00 |
| SEQID-00055 | 0.55 | 0.00 |
| SEQID-00054 | 0.55 | 0.00 |
| SEQID-00112 | 0.50 | 0.00 |

An exemplary list of the top 10 nutritive polypeptide sequences enriched in threonine is shown in table E5BM. The top 10 nutritive polypeptide sequences reduced in threonine are shown in table E5BN.

TABLE E5BM

| SEQID | EAA | T |
|---|---|---|
| SEQID-00404 | 0.49 | 0.14 |
| SEQID-00547 | 0.49 | 0.13 |
| SEQID-00522 | 0.40 | 0.13 |
| SEQID-00569 | 0.56 | 0.13 |
| SEQID-00528 | 0.53 | 0.11 |
| SEQID-00504 | 0.47 | 0.11 |
| SEQID-03768 | 0.42 | 0.11 |
| SEQID-00523 | 0.51 | 0.11 |
| SEQID-03649 | 0.49 | 0.11 |
| SEQID-00116 | 0.32 | 0.11 |

TABLE E5BN

| SEQID | EAA | T |
|---|---|---|
| SEQID-00560 | 0.55 | 0.00 |
| SEQID-00057 | 0.41 | 0.00 |
| SEQID-00542 | 0.41 | 0.00 |
| SEQID-00059 | 0.41 | 0.00 |
| SEQID-00015 | 0.30 | 0.00 |
| SEQID-00014 | 0.30 | 0.00 |
| SEQID-00013 | 0.28 | 0.00 |
| SEQID-00007 | 0.28 | 0.00 |
| SEQID-00007 | 0.28 | 0.00 |
| SEQID-00621 | 0.39 | 0.01 |

An exemplary list of the top 10 nutritive polypeptide sequences enriched in tryptophan is shown in table E5BM. The top 10 nutritive polypeptide sequences reduced in tryptophan are shown in table E5BN.

TABLE E5BM

| SEQID | EAA | W |
|---|---|---|
| SEQID-01546 | 0.51 | 0.08 |
| SEQID-00642 | 0.45 | 0.08 |
| SEQID-03690 | 0.43 | 0.08 |
| SEQID-03776 | 0.43 | 0.08 |
| SEQID-03297 | 0.62 | 0.07 |
| SEQID-03244 | 0.46 | 0.07 |
| SEQID-00512 | 0.44 | 0.07 |
| SEQID-00814 | 0.42 | 0.07 |
| SEQID-00110 | 0.49 | 0.06 |
| SEQID-03137 | 0.50 | 0.06 |

TABLE E5BN

| SEQID | EAA | W |
|---|---|---|
| SEQID-00166 | 0.65 | 0.00 |
| SEQID-00137 | 0.64 | 0.00 |

TABLE E5BN-continued

| SEQID | EAA | W |
|---|---|---|
| SEQID-00525 | 0.64 | 0.00 |
| SEQID-00162 | 0.64 | 0.00 |
| SEQID-00169 | 0.60 | 0.00 |
| SEQID-00051 | 0.59 | 0.00 |
| SEQID-00052 | 0.59 | 0.00 |
| SEQID-00134 | 0.58 | 0.00 |
| SEQID-00536 | 0.58 | 0.00 |
| SEQID-00043 | 0.57 | 0.00 |

An exemplary list of the top 10 nutritive polypeptide sequences enriched in tyrosine is shown in table E5BO. The top 10 nutritive polypeptide sequences reduced in tyrosine are shown in table E5BP.

TABLE E5BO

| SEQID | EAA | Y |
|---|---|---|
| SEQID-00013 | 0.28 | 0.16 |
| SEQID-00007 | 0.28 | 0.15 |
| SEQID-00007 | 0.28 | 0.15 |
| SEQID-00015 | 0.30 | 0.14 |
| SEQID-00325 | 0.42 | 0.14 |
| SEQID-00014 | 0.30 | 0.13 |
| SEQID-00513 | 0.33 | 0.12 |
| SEQID-03689 | 0.41 | 0.11 |
| SEQID-00521 | 0.41 | 0.11 |
| SEQID-00640 | 0.47 | 0.11 |

TABLE E5BP

| SEQID | EAA | Y |
|---|---|---|
| SEQID-00140 | 0.70 | 0.00 |
| SEQID-00146 | 0.67 | 0.00 |
| SEQID-00051 | 0.59 | 0.00 |
| SEQID-00052 | 0.59 | 0.00 |
| SEQID-00548 | 0.59 | 0.00 |
| SEQID-00134 | 0.58 | 0.00 |
| SEQID-00043 | 0.57 | 0.00 |
| SEQID-00053 | 0.57 | 0.00 |
| SEQID-00054 | 0.55 | 0.00 |
| SEQID-00055 | 0.55 | 0.00 |

An exemplary list of the top 10 nutritive polypeptide sequences enriched in valine is shown in table E5BQ. The top 10 nutritive polypeptide sequences reduced in valine are shown in table E5BR.

TABLE E5BQ

| SEQID | EAA | V |
|---|---|---|
| SEQID-00550 | 0.49 | 0.18 |
| SEQID-00592 | 0.53 | 0.16 |
| SEQID-00532 | 0.44 | 0.15 |
| SEQID-00620 | 0.50 | 0.15 |
| SEQID-00644 | 0.42 | 0.14 |
| SEQID-00514 | 0.46 | 0.13 |
| SEQID-00518 | 0.52 | 0.13 |
| SEQID-00598 | 0.49 | 0.13 |
| SEQID-00581 | 0.51 | 0.13 |
| SEQID-00145 | 0.51 | 0.13 |

TABLE E5BR

| SEQID | EAA | V |
|---|---|---|
| SEQID-00239 | 0.48 | 0.00 |
| SEQID-00552 | 0.45 | 0.00 |
| SEQID-00240 | 0.45 | 0.00 |

TABLE E5BR-continued

| SEQID | EAA | V |
|---|---|---|
| SEQID-00615 | 0.40 | 0.00 |
| SEQID-00652 | 0.28 | 0.00 |
| SEQID-00515 | 0.25 | 0.01 |
| SEQID-00522 | 0.40 | 0.01 |
| SEQID-00560 | 0.55 | 0.01 |
| SEQID-00645 | 0.56 | 0.01 |
| SEQID-00647 | 0.42 | 0.01 |

Example 6

Selection of Amino Acid Sequences of Nutritive Polypeptides Enriched in Essential Amino Acids to Provide Protein Nutrition and for the Treatment of Protein Malnutrition It has been shown that humans cannot endogenously synthesize nine of the twenty naturally occurring amino acids: histidine, leucine, isoleucine, valine, phenylalanine, methionine, threonine, lysine, and tryptophan (Young, V. R. and Tharakan, J. F. Nutritional essentiality of amino acids and amino acid requirements in healthy adults. In *Metabolic and Therapeutic Aspects of Amino Acids in Clinical Nutrition. Second Edition.* Cynober, L. A. Ed.; CRC Press: New York, 2004; pp 439-470). As such, there is a need to ingest sufficient quantities of these nine essential amino acids to avoid protein malnutrition and the deleterious health effects that result from this state. Nutritive polypeptides are identified that are useful for the fulfillment of these essential amino acid requirements either in healthy or malnourished individuals by selecting those that are enriched in essential amino acids by mass and contain a non-zero amount of each essential amino acid (i.e., the nutritive polypeptide sequence is essential amino acid complete).

Using a database of all protein sequences derived from edible species as described herein, candidate sequences that are essential amino acid complete and enriched in essential amino acids were identified. In order to increase the probability of these proteins being solubly expressed and highly soluble at pH 7 with reduced aggregation propensity, solvation score and aggregation score upper bounds of −20 kcal/mol/AA and 0.5 were applied. In order to reduce the likelihood that these proteins would elicit an allergenic response, upper bounds of 50% and 35% were set for the global allergen homology and allergenicity scores, respectively. In order to reduce the likelihood that these proteins would have toxic effects upon ingestion, an upper bound of 35% was set for the toxicity score. In order to reduce the likelihood that these proteins would act as inhibitors of digestive proteases, an upper bound of 35% was set for the anti-nutricity score.

An exemplary list of the top 10 nutritive polypeptide sequences that are essential amino acid complete, enriched in essential amino acids, and meet the aforementioned cutoffs in solvation score, aggregation score, global allergen homology, allergenicity score, toxicity score, and anti-nutricity score is shown in table E6A.

TABLE E6A

| SEQID | EAAc | EAA |
|---|---|---|
| SEQID-03636 | 1 | 0.65 |
| SEQID-03492 | 1 | 0.63 |

TABLE E6A-continued

| SEQID | EAAc | EAA |
|---|---|---|
| SEQID-03468 | 1 | 0.62 |
| SEQID-03544 | 1 | 0.62 |
| SEQID-03484 | 1 | 0.62 |
| SEQID-03442 | 1 | 0.61 |
| SEQID-03417 | 1 | 0.61 |
| SEQID-03563 | 1 | 0.61 |
| SEQID-03469 | 1 | 0.60 |
| SEQID-03443 | 1 | 0.60 |

An exemplary list of the top 10 nutritive polypeptide sequences from the expressed protein database that are essential amino acid complete and enriched in essential amino acids is shown in table E6B.

TABLE E6B

| SEQID | EAAc | EAA |
|---|---|---|
| SEQID-00140 | 1 | 0.70 |
| SEQID-00561 | 1 | 0.68 |
| SEQID-00146 | 1 | 0.67 |
| SEQID-00150 | 1 | 0.67 |
| SEQID-00143 | 1 | 0.65 |
| SEQID-03297 | 1 | 0.62 |
| SEQID-00487 | 1 | 0.61 |
| SEQID-00287 | 1 | 0.59 |
| SEQID-00298 | 1 | 0.59 |
| SEQID-00548 | 1 | 0.59 |

Example 7

Selection of Amino Acid Sequences of Nutritive Polypeptides Enriched in Branched Chain Amino Acids for Muscle Health, and Selection of Amino Acid Sequences of Nutritive Polypeptides Reduced in Branched Chain Amino Acids for Treatment of Diabetes, Cardiovascular Disease, Chronic Kidney Disease and Stroke Identification of Proteins Enriched in Branched Chain Amino Acids for the Treatment of Hepatic and/or Renal Disease.

Using a database of all protein sequences derived from edible species as described herein, candidate sequences that are enriched or reduced in branched chain amino acids were identified. In order to increase the probability that these proteins are solubly expressed, as well as highly soluble at pH 7 with reduced aggregation propensity, solvation score and aggregation score upper bounds of −20 kcal/mol/AA and 0.5 were applied. In order to reduce the likelihood that these proteins would elicit an allergenic response, upper bounds of 50% and 35% were set for the global allergen homology and allergenicity scores, respectively. In order to reduce the likelihood that these proteins would have toxic effects upon ingestion, an upper bound of 35% was set for the toxicity score. In order to reduce the likelihood that these proteins would act as inhibitors of digestive proteases, an upper bound of 35% was set for the anti-nutricity score.

An exemplary list of the top 10 nutritive polypeptide sequences that are enriched in branched chain amino acids, and meet the afore mentioned cutoffs in solvation score, aggregation score, global allergen homology, allergenicity score, toxicity score, and anti-nutricity score is shown in table E7A.

TABLE E7A

| SEQID | EAA | BCAA |
|---|---|---|
| SEQID-03532 | 0.58 | 0.31 |
| SEQID-03616 | 0.53 | 0.31 |
| SEQID-03629 | 0.56 | 0.31 |
| SEQID-03619 | 0.52 | 0.29 |
| SEQID-03542 | 0.49 | 0.29 |
| SEQID-03519 | 0.49 | 0.29 |
| SEQID-03603 | 0.53 | 0.29 |
| SEQID-03536 | 0.52 | 0.29 |
| SEQID-03597 | 0.48 | 0.29 |
| SEQID-03623 | 0.49 | 0.29 |

An exemplary list of the top 10 nutritive polypeptide sequences from the expressed protein database that are enriched in branched chain amino acids is shown in table E7B.

TABLE E7B

| SEQID | EAA | BCAA |
|---|---|---|
| SEQID-00162 | 0.64 | 0.53 |
| SEQID-00166 | 0.65 | 0.46 |
| SEQID-00134 | 0.58 | 0.46 |
| SEQID-00169 | 0.60 | 0.43 |
| SEQID-00043 | 0.57 | 0.41 |
| SEQID-00132 | 0.60 | 0.41 |
| SEQID-00137 | 0.64 | 0.39 |
| SEQID-00175 | 0.63 | 0.38 |
| SEQID-00550 | 0.49 | 0.38 |
| SEQID-00234 | 0.51 | 0.37 |

An exemplary list of the top 10 nutritive polypeptide sequences that are reduced in branched chain amino acids, and meet the afore mentioned cutoffs in solvation score, aggregation score, global allergen homology, allergenicity score, toxicity score, and anti-nutricity score is shown in table E7C.

TABLE E7C

| SEQID | EAA | BCAA |
|---|---|---|
| SEQID-03471 | 0.36 | 0.01 |
| SEQID-03473 | 0.06 | 0.01 |
| SEQID-03571 | 0.24 | 0.01 |
| SEQID-03495 | 0.24 | 0.01 |
| SEQID-03514 | 0.24 | 0.01 |
| SEQID-00552 | 0.45 | 0.03 |
| SEQID-03611 | 0.37 | 0.03 |
| SEQID-03457 | 0.37 | 0.03 |
| SEQID-03456 | 0.34 | 0.03 |
| SEQID-03520 | 0.36 | 0.03 |

An exemplary list of the top 10 nutritive polypeptide sequences from the expressed protein database that are reduced in branched chain amino acids is shown in table E7D.

TABLE E7D

| SEQID | EAA | BCAA |
|---|---|---|
| SEQID-00552 | 0.45 | 0.03 |
| SEQID-00522 | 0.40 | 0.03 |
| SEQID-00515 | 0.25 | 0.05 |
| SEQID-00553 | 0.39 | 0.05 |
| SEQID-00585 | 0.44 | 0.06 |
| SEQID-00637 | 0.42 | 0.07 |
| SEQID-00652 | 0.28 | 0.08 |
| SEQID-00615 | 0.40 | 0.08 |
| SEQID-00743 | 0.29 | 0.08 |
| SEQID-00547 | 0.49 | 0.09 |

Example 8

Selection of Amino Acid Sequences of Nutritive Polypeptides Having Low or No Phenylalanine and Enriched in Tyrosine and all Other Essential Amino Acids for Treatment or Prevention of Phenylketonuria Individuals who suffer from phenylketonuria (PKU) are unable to process the amino acid phenylalanine and catalyze its conversion to tyrosine often due to a malfunctioning hepatic enzyme phenylalnine hydroxylase (MacLeod E. L. and Ney D. M. Nutritional Management of Phenylketonuria. *Annales Nestle*. (2010) 68:58-69). In these individuals, when protein containing the amino acid phenylalanine is ingested, phenylalanine accumulates in the blood. Untreated PKU has serious untoward health effects, including impaired school performance, impaired executive functioning, and long term intellectual disability (Matalon, R., Michals-Matalon, K., Bhatia, G., Grechanina, E., Novikov, P., McDonald, J. D., Grady, J., Tyring, S. K., Guttler, F. Large neutral amino acids in the treatment of phenylketonuria. *J. Inherit. Metab. Dis.* (2006) 29: 732-738). One way phenylalanine blood levels can be kept low to avoid neurological effects is to avoid the ingestion of phenylalanine containing proteins and/or only consume protein sources that are low in phenylalanine. As basic protein nutritional requirements of all other amino acids must also be met, sufficient intake of the other essential amino acids (histidine, leucine, isoleucine, valine, methionine, threonine, lysine, and tryptophan) and tyrosine, which becomes conditionally essential in these individuals, is required. One can identify beneficial nutritive polypeptides for individuals that suffer from phenylketonuria by selecting proteins that contain low or no phenylalanine and are enriched by mass in tyrosine and the other essential amino acids.

Using a database of all protein sequences derived from edible species as described herein, candidate sequences that contain low or no phenylalanine by mass, are essential amino acid and tyrosine complete (aside from phenylalanine), and enriched in tyrosine and essential amino acids were identified and rank ordered first by their phenylalanine mass fraction and then by their total tyrosine plus essential amino acid mass fraction. In order to increase the probability that these proteins are solubly expressed, as well as highly soluble at pH 7 with reduced aggregation propensity, solvation score and aggregation score upper bounds of −20 kcal/mol/AA and 0.5 were applied. In order to reduce the likelihood that these proteins would elicit an allergenic response, upper bounds of 50% and 35% were set for the global allergen homology and allergenicity scores, respectively. In order to reduce the likelihood that these proteins would have toxic effects upon ingestion, an upper bound of 35% was set for the toxicity score. In order to reduce the likelihood that these proteins would act as inhibitors of digestive proteases, an upper bound of 35% was set for the anti-nutricity score.

An exemplary list of the top 10 nutritive polypeptide sequences that contain low or no phenylalanine by mass, are essential amino acid and tyrosine complete (aside from phenylalanine), enriched in tyrosine and essential amino acids, and meet the afore mentioned cutoffs in solvation score, aggregation score, global allergen homology, allergenicity score, toxicity score, and anti-nutricity score is shown in table E8A.

TABLE E8A

| SEQID | EAA | F | Y |
|---|---|---|---|
| SEQID-03584 | 0.53 | 0.00 | 0.09 |
| SEQID-03479 | 0.52 | 0.00 | 0.04 |
| SEQID-03573 | 0.55 | 0.00 | 0.01 |
| SEQID-00634 | 0.50 | 0.00 | 0.05 |
| SEQID-03466 | 0.49 | 0.00 | 0.05 |
| SEQID-03609 | 0.53 | 0.00 | 0.01 |
| SEQID-03498 | 0.45 | 0.00 | 0.06 |
| SEQID-03465 | 0.40 | 0.00 | 0.08 |
| SEQID-03587 | 0.46 | 0.00 | 0.01 |
| SEQID-03463 | 0.41 | 0.00 | 0.05 |

An exemplary list of the top 10 nutritive polypeptide sequences from the expressed protein database that contain low or no phenylalanine by mass, are essential amino acid and tyrosine complete (aside from phenylalanine), and enriched in tyrosine and essential amino acids is shown in table E8B.

TABLE E8B

| SEQID | EAA | F | Y |
|---|---|---|---|
| SEQID-00634 | 0.50 | 0.00 | 0.05 |
| SEQID-00514 | 0.46 | 0.01 | 0.01 |
| SEQID-00329 | 0.47 | 0.01 | 0.03 |
| SEQID-00628 | 0.51 | 0.01 | 0.02 |
| SEQID-00636 | 0.47 | 0.01 | 0.04 |
| SEQID-03634 | 0.45 | 0.01 | 0.04 |
| SEQID-00335 | 0.38 | 0.01 | 0.07 |
| SEQID-00639 | 0.46 | 0.01 | 0.06 |
| SEQID-03448 | 0.40 | 0.01 | 0.03 |
| SEQID-03889 | 0.42 | 0.02 | 0.01 |

Example 9

Selection of Amino Acid Sequences of Nutritive Polypeptides Containing Fragments or Regions of Naturally-Occurring Protein Sequences: Nutritive Polypeptide Fragments Enriched in Leucine and all Essential Amino Acids In some cases, full length proteins identified from the databases described herein are not particularly advantageous in view of one or more selection requirements defined by one or more important parameters, or otherwise do not provide enough of one or more specific amino acid(s) by mass relative to the total mass of the nutritive polypeptide. In these cases, one or more fragments (also termed "regions" herein) of nutritive polypeptides identified in the database are able meet the desired search criteria. Databases containing possible fragments of nutritive polypeptides are generated and searched by taking each full length sequences in the database and examining all possible subsequences at least 25 amino acids in length contained therein. For example, it was desired to find a nutritive polypeptide sequence that had leucine mass fractions greater than about 0.2 and highly charged to increase the likelihood of soluble expression. The protein edible species database described herein was searched using a solvation score cutoff of less than −30, and in order to reduce the likelihood that these proteins would elicit an allergenic response, upper bounds of 50% were set for the global allergen homology and allergenicity scores. In order to reduce the likelihood that these proteins would have toxic effects upon ingestion, an upper bound of 35% was set for the toxicity score. In order to reduce the likelihood that these proteins would act as inhibitors of digestive proteases, an upper bound of 35% was set for the anti-nutricity score.

An exemplary list of the top 10 nutritive polypeptide fragments that are enriched in leucine ($\geq$20% by mass) and meet the afore mentioned cutoffs in solvation score, global allergen homology, allergenicity score, toxicity score, and anti-nutricity score is shown in table E9A.

TABLE E9A

| DBID | EAA | L |
|---|---|---|
| P58797 | 0.47 | 0.26 |
| A7A1V1 | 0.49 | 0.24 |
| P04467 | 0.56 | 0.23 |
| Q9AWA5 | 0.45 | 0.22 |
| Q2NL14 | 0.52 | 0.22 |
| Q60CZ8 | 0.42 | 0.22 |
| Q10MN8 | 0.32 | 0.22 |
| P50275 | 0.47 | 0.22 |
| Q2YDE5 | 0.45 | 0.22 |
| Q0P5B4 | 0.51 | 0.22 |

An exemplary list of the top 10 nutritive polypeptide fragments from the expressed protein database that are enriched in leucine ($\geq$20% by mass) is shown in Table E9B.

TABLE E9B

| SEQID | EAA | L |
|---|---|---|
| SEQID-00132 | 0.60 | 0.32 |
| SEQID-00195 | 0.52 | 0.26 |
| SEQID-00194 | 0.54 | 0.26 |
| SEQID-00193 | 0.53 | 0.26 |
| SEQID-00166 | 0.65 | 0.26 |
| SEQID-00134 | 0.58 | 0.24 |
| SEQID-00212 | 0.51 | 0.23 |
| SEQID-00139 | 0.49 | 0.23 |
| SEQID-00213 | 0.51 | 0.21 |
| SEQID-00148 | 0.47 | 0.21 |

Example 10

Purification of Nutritive Polypeptides

Various methods of purification have been used to isolate nutritive polypeptides from or away other materials such as raw foods, cells, salts, small molecules, host cell proteins, and lipids. These methods include diafiltration, precipitation, flocculation, aqueous two phase extraction, and chromatography.

Purification by Anti-FLAG Affinity Chromatography.

Anti-FLAG purification provides a method to purify nutritive polypeptides from low-titer expression systems or from similarly charged host cell proteins. Nutritive polypeptides were engineered to contain either a single FLAG tag (DYKDDDDK) or a triple tandem FLAG tag (DYKDDDDKDYKDDDDKDYKDDDDK) appended to the C-terminus of the protein. Anti-FLAG affinity purification offers a single-step purification process that offers non-denaturing process conditions and elution purities of >95% (Einhauer et al., 2001 Journal of Biochemical and Biophysical Methods).

Nutritive polypeptides were purified using Anti-FLAG M2 Affinity Agarose Gel (Sigma Aldrich, St. Louis, Mo.). The M2 affinity resin is designed specifically for use with C-terminal FLAG epitopes. For purification of N-terminally appended FLAG epitopes, the M1 Affinity Agarose Gel was used. The M2 Affinity Agarose Gel (resin) has an advertised static binding capacity (SBC) of approximately 0.5 mg nutritive polypeptide per mL of resin.

Purification of nutritive polypeptides from *Aspergillus niger* secretion media and *Bacillus subtilis* secretion media were performed using 20-40 mL of anti-FLAG resin. Prior to purification, secretion media was adjusted to 150 mM NaCl and pH 7.4. Resin was equilibrated by rinsing the media with an excess of 1× tris-buffered saline (TBS) pH 7.4±0.1 and collecting it through a 0.2 um polyethersulfone (PES) vacuum filter. Equilibrated resin was then mixed with secretion media in batch mode and allowed to mix at room temperature for one hour. Unbound material was removed from the resin by passing the entire mixture through a 0.2 um PES vacuum filter. The resin was physically collected on the surface of the filter and was subsequently washed with 20 resin volumes of TBS pH 7.4±0.1 to further remove unbound material through the 0.2 um PES vacuum filter. Washed resin was transferred to drip columns (10 mL each) and the bound polypeptides were eluted With two column volumes (CV) of 0.1M glycine pH 3.0. The eluted polypeptides were flowed directly from the drip columns into conical tubes that contained 1M Tris pH 8.0; this strategy was used to neutralize the pH of the eluted polypeptide solution as quickly as possible. Resin was regenerated using an additional 3 CV of 0.1M glycine pH 3.0. For short term storage, resin was stored in 1×TBS pH 7.4 at 4° C.; for long term storage, resin was stored in 0.5×TBS pH 7.4, 50% glycerol at −20° C.

Exemplary anti-FLAG purification of SEQID-00105 from *B. subtilis* yielded 4.0 mg of protein in a 4.3 ml elution. The sample was loaded onto a polyacrylamide gel at three different dilutions for increased sensitivity and SEQID-00105 was found to be 95% pure. Exemplary anti-FLAG purification of SEQID-00298 from *A. niger* was performed according to the same procedure. The elution fraction was neutralized, as described, and analyzed by SDS-PAGE and Bradford assay as described herein. The main band in the elution was found to be 95% pure. The main band in the elution is compared to the MW ladder on the same gel, and matched the expected molecular weight of SEQID-00298. Forty mL of anti-FLAG resin captured 4.0 mg of material, resulting in an estimated resin capacity of 0.10 mg/mL.

Purification by 5 ml Immobilized Metal Affinity Chromatography (IMAC).

*E. coli* was grown in shake flask fermentation with targeted expression of individual nutritive polypeptides with HIS8 tags, as described herein. Cells were harvested from each shake-flask by bucket centrifugation. The supernatant was discarded, and the cells were suspended in 30 mM imidazole, 50 mM sodium phosphate, 0.5 M NaCl, pH 7.5 at a wet cell weight (WCW) concentration of 20% w/v. The suspended cells were then lysed with two passes through a M110-P microfluidizer (Microfluidics, Westwood, Mass.) at 20,000 psi through an 87 um interaction chamber. The lysed cells were centrifuged at 15,000 relative centrifugal force (RCF) for 120 minutes, and then decanted. Cellular debris was discarded, and the supernatants were 0.2 um filtered. These filtered protein solutions were then purified by immobilized metal affinity chromatography (IMAC) on an ÅKTA Explorer 100 FPLC (GE Healthcare, Piscataway, N.J.). Nutritive polypeptides were purified over 5 mL (1.6 cm diameter×2.5 cm height) IMAC Sepharose 6 Fast Flow columns (GE Healthcare, Piscataway, N.J.).

IMAC resin (GE Healthcare, IMAC Sepharose 6 Fast Flow) was charged with nickel using 0.2 NiSO4 and washed with 500 mM NaCl, 200 mM imidazole, pH 7.5 followed by equilibration in 30 mM imidazole, 50 mM sodium phosphate, 0.5 M NaCl, pH 7.5. 50 mL of each protein load solution was applied onto a 5 mL IMAC column, and washed with additional equilibration solution to remove unbound impurities. The protein of interest was then eluted with 15 mL of IMAC Elution Solution, 0.25 M imidazole, 0.5 M NaCl, pH 7.5. All column blocks were performed at a linear flow rate of 150 cm/hr. Each IMAC elution fraction was buffer exchanged by dialysis into a neutral pH formulation solution. The purified proteins were analyzed for concentration and purity by capillary electrophoresis and/or SDS-PAGE. Concentration was also tested by Bradford and A280 measurement, as described herein. Table E9A demonstrates a list of nutritive polypeptides that were purified by IMAC at 5 mL scale.

TABLE E9A

Nutritive polypeptides that were purified by IMAC at 5 mL

| SEQID | Mass (mg) | Purity |
|---|---|---|
| 00533 | 3 | 22% |
| 00522 | 25.5 | 36% |
| 00085 | 34 | 51% |
| 00103 | 4.5 | 56% |
| 00359 | 40.5 | 56% |
| 00346 | 30.7 | 56% |
| 00510 | 112 | 61% |
| 00622 | 70 | 70% |
| 00522 | 47 | 72% |
| 00546 | 235.6 | 75% |
| 00353 | 5.6 | 76% |
| 00601 | 83.8 | 77% |
| 00418 | 14 | 80% |
| 00502 | 93.2 | 84% |
| 00100 | 68 | 87% |
| 00606 | 77.8 | 87% |
| 00104 | 93 | 89% |
| 00076 | 92 | 91% |
| 00341 | 176.6 | 91% |
| 00598 | 60.3 | 91% |
| 00647 | 73.7 | 93% |
| 00105 | 3.8 | 93% |
| 00343 | 35.3 | 95% |
| 00103 | 112 | 95% |
| 00511 | 179 | 95% |
| 00354 | 85.8 | 96% |
| 00587 | 93 | 96% |
| 00610 | 90.5 | 97% |
| 00485 | 269 | 98% |
| 00356 | 76.9 | 98% |
| 00352 | 134.9 | 99% |
| 00345 | 196.2 | 100% |
| 00338 | 123.2 | 100% |
| 00298 | 0.6 | 100% |
| 00357 | 104.8 | 100% |
| 00605 | 202 | 100% |
| 00559 | 241.8 | 100% |
| 00338 | 268 | 100% |

Purification by 1 L Immobilized Metal Affinity Chromatography (IMAC).

*E. coli* was grown in 20 L fermentation with targeted expression of individual nutritive polypeptides with HIS8 tags, as described herein. Cells were harvested from the fermenter and centrifuged using a Sharples AS-16P centrifuge to collect wet cell, mass. Cells were subsequently resuspended in 30 mM imidazole, 50 mM sodium phosphate, 0.5 M NaCl, pH 7.5 at a wet cell weight (WCW)

concentration of 20% w/v. The cell suspension was then lysed using four passes through a Niro Soavi Homogenizer (Niro Soavi, Parma, Italy) at an operational pressure of 12,500-15,000 psi and a flow rate of 1 L/min. The lysate was clarified using a Beckman J2-HC bucket centrifuge (Beckman-Coulter, Brea, Calif.) at 13,700×g for 1 hour. Cellular debris was discarded, and the supernatant was filtered through a Sartopore II XLG 0.8/0.2 um filter (Sartorius Stedim, Bohemia, N.Y.) at 30 L/m2/hr. Filtered lysate was purified by IMAC using IMAC Sepharose 6 Fast Flow resin packed in a 0.9 L column (9 cm diameter×13.8 cm height).

IMAC resin was equilibrated, as described herein, at a linear flow rate of 300 cm/hr. Once equilibrated, the entirety of the filtered lysate was passed over the column at a linear flow rate of 150 cm/hr. Load volumes ranged from six to ten column volumes. After the load, unbound material was washed off of the column, and the target protein was eluted. Elution pools were shipped at room temperature, 4° C. or frozen. This decision was dependent on the stability of the nutritive polypeptide in Elution Solution. Table E9B summarizes a number of nutritive polypeptides that have been purified by IMAC at the 1 L column scale.

TABLE E9B

Nutritive polypeptides that have been purified by IMAC at 1 L scale

| SEQID | IMAC Elution Mass | IMAC Elution Purity |
|---|---|---|
| 00240 | 9.00 grams | 98% |
| 00338 | 43.5 grams | 100% |
| 00341 | 54.3 grams | 100% |
| 00352 | 19.8 grams | 100% |
| 00559 | 19.5 grams | 89% |
| 00587 | 8.6 grams | 69% |

Nutritive polypeptides were filtered through a Sartopore II XLG 0.8/0.2 m filter and loaded directly into an ultrafiltration/diafiltration (UF/DF) unit operation. Membrane area and nominal molecular weight cutoff were chosen as appropriate for each nutritive polypeptide. Nutritive polypeptides were ultrafiltered at a cross flow of 12 L/m2/min and a TMP target of 25 psi. Nutritive polypeptides were concentrated approximately ten-fold on Hydrosart ultrafiltration cassettes (Sartorius Stedim, Bohemia, N.Y.), and diafiltered seven diavolumes into a formulation buffer that is specific to the nutritive polypeptide. Ultrafiltration permeate was discarded. The diafiltered, concentrated retentate was collected, filtered through a 0.22 um membrane filter and frozen at −80° C.

In some cases, frozen protein concentrates were lyophilized using a Labconco lyophilizer (Labconco, Kansas City, Mo.). Residual water content of the cake is analyzed using the Karl Fisher method.

Purification by 10 L Immobilized Metal Affinity Chromatography (IMAC).

E. coli was grown in 250 L fermentation with targeted expression of individual nutritive polypeptides with HIS8 tags, as described herein. Cells were harvested from the 250 L fermenter and centrifuged using a Sharples AS-16P centrifuge to collect wet cell mass. Cells were subsequently resuspended in 30 mM imidazole, 50 mM sodium phosphate, 0.5 M NaCl, pH 7.5 at a WCW concentration of 20% w/v. The cells suspension was then lysed using four passes through a Niro Soavi Homogenizer (Niro Soavi, Parma, Italy) at an operational pressure of 12,500-15,000 psi and a flow rate of 1 L/min. Clarified lysate was generated using four passes through a Sharples AS-16P centrifuge at 15,000 rpm operated at 0.5 L/min. Cellular debris was discarded, and the supernatant was filtered through a series of filters. Clarified lysate was passed sequentially through a SartoPure GF+ 0.65 um, a SartoGuard PES 1.2/0.2 um and a Sartopore II XLG 0.8/0.2 um filter (Sartorius Stedim, Bohemia, N.Y.). Filtered lysate was purified by IMAC using IMAC Sepharose 6 Fast Flow resin packed in an 8.5 column (20 cm diameter×27.1 cm height).

IMAC resin was equilibrated as described at a linear flow rate of 150 cm/hr. Once equilibrated, the filtered lysate was passed over the column at a linear flow rate of 150 cm/hr. Load volumes ranged from 3.8 to 5.0 CV. After the load, unbound material was washed off of the column with additional equilibration. Nutritive polypeptides manufactured at the 10 L IMAC scale were subject to an additional set of washes with 2 CV of 10 mM sodium phosphate dibasic, 300 mM NaCl; 3 CV of 0.5% w/v sodium deoxycholate, 50 mM sodium phosphate dibasic, 300 mM NaCl; and 5CV of 10 mM sodium phosphate dibasic, 300 mM NaCl. Following the washes, the target polypeptide was eluted as described. Elution pools were stored at room temperature.

Figure 1:
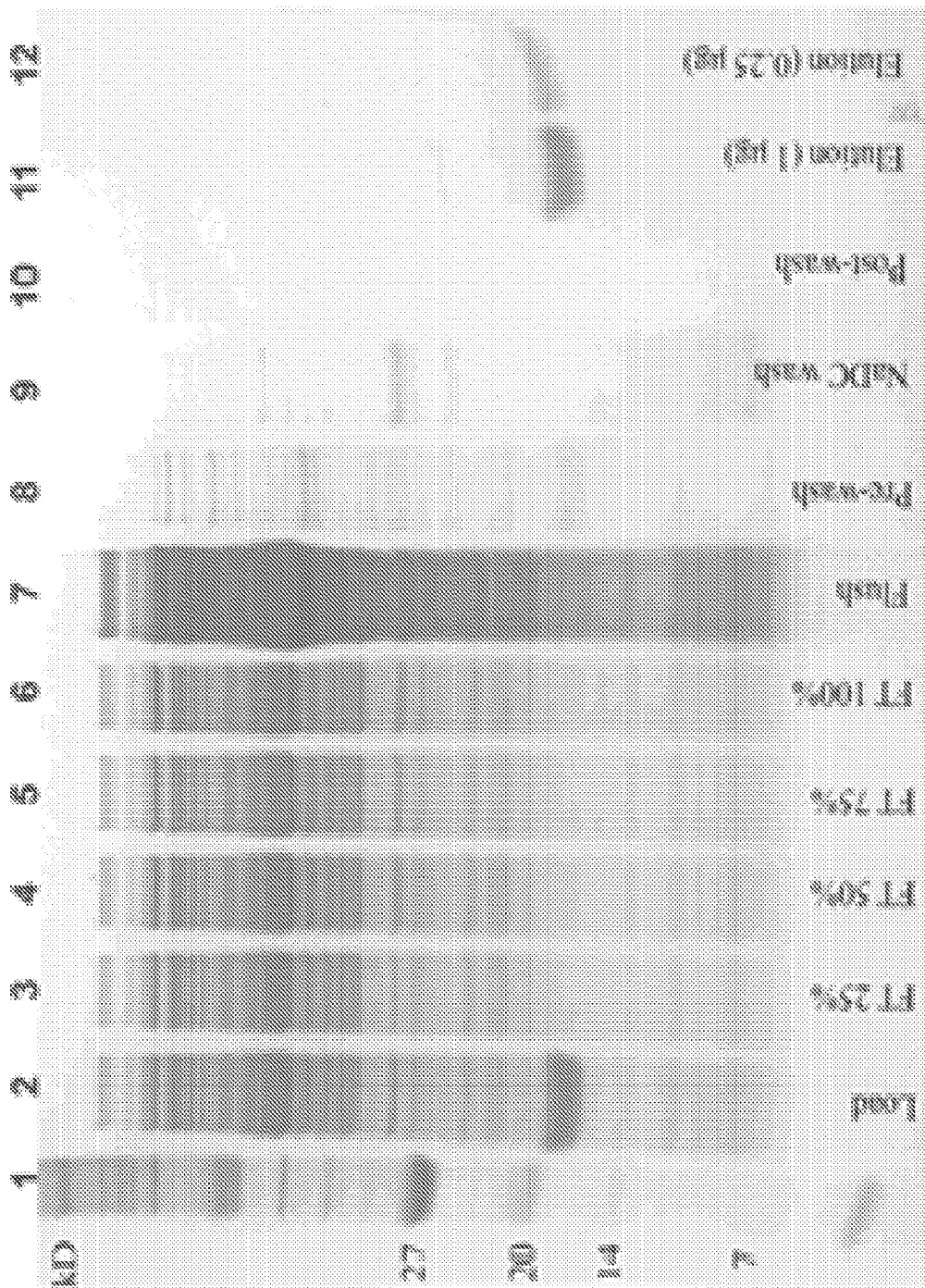
FIG. 1 is an image demonstrating SDS-PAGE analysis of the purification of SEQID-00105 by IMAC.

Multiple nutritive polypeptides were purified by IMAC chromatography at the 10 L column scale. Table E9C summarizes the purification of SEQID-00105 and SEQID-00338. FIG. 1 provides an exemplary SDS-PAGE analysis of the purification SEQID-00105.

TABLE E9C

Nutritive polypeptides were purified by IMAC chromatography at the 10 L column scale

| SEQID | Mass | Purity |
|---|---|---|
| 00105 | 179 g | 98% |
| 00105 | 265 g | 98% |
| 00105 | 131 g | 91% |
| 00105 | 147 g | 92% |
| 00105 | 164 g | 94% |
| 00105 | 148 g | 95% |
| 00105 | 229 g | 100% |
| 00105 | 228 g | 100% |
| 00338 | 137 g | 92% |
| 00338 | 196 g | 100% |
| 00338 | 169 g | 100% |

After IMAC purification at the 10 L column scale, nutritive polypeptides were filtered through a Sartopore II XLG 0.8/0.2 um filter and loaded directly into an ultrafiltration/diafiltration (UF/DF) unit operation. Membrane area and nominal molecular weight cutoff were chosen as appropriate for each nutritive polypeptide. Nutritive polypeptides were ultrafiltered at a cross flow of 12 L/m2/min and a TMP target of 25 psi. Nutritive polypeptides were concentrated approximately ten-fold on Hydrosart ultrafiltration cassettes (Sartorius Stedim, Bohemia, N.Y.), and diafiltered sequentially into four diavolumes of 10% phosphate buffered saline (PBS), pH 8.7; followed by two diavolumes of 25 mM tetrasodium ethylenediaminetetraacetic acid (Na4EDTA); followed by seven diavolumes of 10% PBS, pH 8.7. Intermediate diafiltration into Na4EDTA was performed in order to chelate any leached nickel(II) from the IMAC resin. Ultrafiltration permeate was discarded; the diafiltered, concentrated retentate was filtered through a 0.2 um membrane filter, and frozen at −80° C.

The ultrafiltration pool was filtered with a sterilizing-grade filter with the goal of bioburden reduction. The nutritive polypeptide was filtered into glass trays that were rinsed with ethanol. Filled glass trays were subsequently frozen at −80° C. The frozen material was then lyophilized to a dry cake using a Labconco lyophilization unit (Labconco, Kansas City, Mo.). The mass of the protein in the tray was monitored with time, until it plateaued, which was considered to be complete drying. The dried protein cake was sealed by the lid of the tray, and over-packaged by vacuum sealing in a plastic bag. The entire package was stored at −80° C.

Ion Exchange Chromatography.

Selecting an appropriate method of purifying a nutritive polypeptide has implications for are speed of process development, cost of manufacture, final purity, and robustness of the purification. Nutritive polypeptides have been isolated by various chromatographic methods. The mode of chromatography selected for use depends on the physicochemical properties of the target nutritive polypeptide. Charged nutritive polypeptides bind to ion exchange chromatography resin through electrostatic interactions.

In the present application, we have defined two methods of screening a library of polypeptides to rank-order them for their ability to bind to ion exchange resins. One method is an in silico prediction based on calculation of protein net charge across a range of pH using the primary sequence of the polypeptides, as described herein. The second method is a multiplexed purification screen in vitro, as described herein. The two methods have successfully been used independently of each other, and they have been used together on the same set of 168 nutritive polypeptides with supportive data, as described herein.

The in silico method of predictive ranking for ion exchange purification is based on calculating net charge of a nutritive polypeptide at a range of pH based on the primary sequence. The primary sequence of a nutritive polypeptide is used to predict the mode of chromatography that is most likely to successfully isolate that nutritive polypeptide from host cell proteins and other impurities. Highly charged nutritive polypeptides are likely to bind tightly to ion exchange chromatography resin. The tightest binding is achieved for nutritive polypeptides which have one predominant charge, either positive or negative. It is possible for a nutritive polypeptide with a mixture of positive and negative charges to have tight binding to ion exchange resin, but it is also possible that those charges may work against each other. Similarly, a nutritive polypeptide with alternating positive and negative patches on its surface may not bind as tightly as one with a dominant portion of its surface that is one single charge. Similarly, a nutritive polypeptide that has a strongly positive or negative terminus, tail, tag, or linker sequence may effectively display that highly charged group allowing for extremely tight binding.

A prevalence of one or more certain amino acids, e.g., histidine, arginine, and lysine in a polypeptide imparts in that polypeptide, or a portion thereof, a positive charge when the pH of the protein solvent is below the pKa of the one or more amino acids. Polypeptide charge includes total protein charge, net charge, or the charge of a portion of the polypeptide. In embodiments wherein a polypeptide or portion thereof is positively charged, a cation exchange resin is used.

A prevalence of one or more certain amino acids, e.g., glutamic acid and aspartic acid in a polypeptide imparts in that polypeptide, or a portion thereof, a negative charge when the pH of the protein solvent is above the pKa of the one or more amino acids. Polypeptide charge includes total protein charge, net charge, or the charge of a portion of the polypeptide. In embodiments wherein a polypeptide or portion thereof is negatively charged, an anion exchange resin is used.

The net charge of a polypeptide changes as a function of the pH of the protein solvent. The number of positive charges and negative charges can be calculated at any pH based on the primary sequence of the polypeptide. The sum of the positive charges and negative charges at any one pH results in the calculated net charge. The isoelectric point (pI) of the polypeptide is the pH at which its calculated net charge is 0. To make comparisons, the net charge of a sequence is normalized by the number of amino acids in the sequence and the parameter "net charge per amino acid" results as the novel comparator between sequences, which is used to predict chromatographic performance.

Nutritive polypeptide sequences have been evaluated by calculating the net charge per amino acid of each polypeptide at every pH (1-14). Additionally, the pI of each polypeptide was calculated. Nutritive polypeptides were ranked by pI and by net charge per amino acid. Polypeptides with a low pI and very negative net charge per amino acid across a wide range of pH are predicted to bind to anion exchange chromatography resin with high affinity. Polypeptides with a high pI and very positive net charge per amino acid across a wide range of pH are predicted to bind to cation exchange chromatography resin with high affinity. In some embodiments herein, only a portion of the polypeptide is charged (as in a terminus, tail, tag, or linker), it is recognized that the pI and net polypeptide charge may be variable, and other factors or empirical measurements may be useful to predict the binding affinity of such a polypeptide to chromatography resins.

Figure 2:
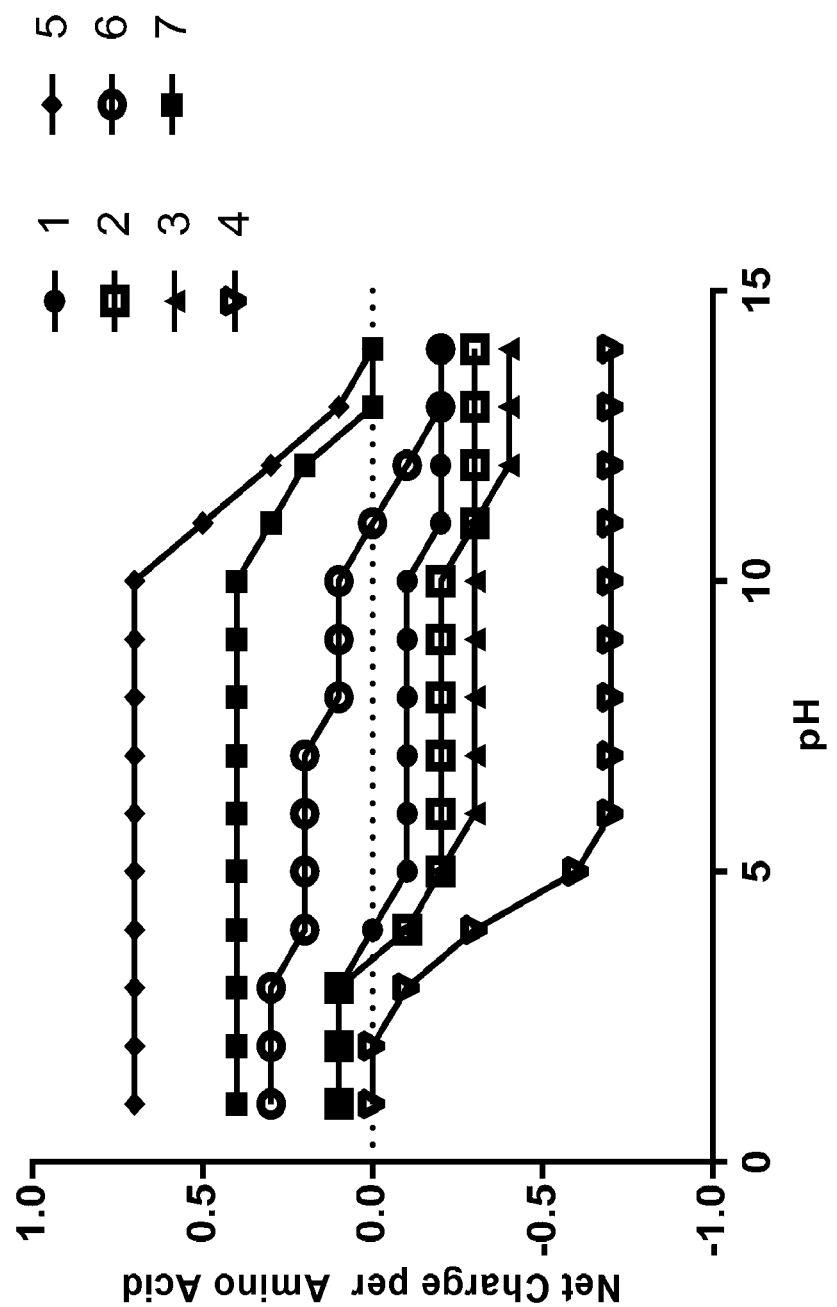
FIG. 2 is a chart demonstrating net charge per amino acid as a function of pH for nutritive polypeptides predicted to bind to either anion or cation exchange resin. (1) SEQID-00105, (2) SEQID-00008, (3) SEQID-00009, (4) SEQID-00475, (5) SEQID-00472, (6) SEQID-00640, (7) SEQID-00019.

FIG. 2 demonstrates example nutritive polypeptides, which, based on primary sequence, are predicted to bind to either anion or cation exchange resin. Nutritive polypeptides with a pI of <4.0, and a net charge per amino acid that is negative across a broad range of pH are predicted to bind anion exchange resin with high affinity ((1) SEQID-00105, (2) SEQID-00008, (3) SEQID-00009, (4) SEQID-00475). Nutritive polypeptides with a pI of >10.0, and a net charge per amino acid that is positive across a broad range of pH are predicted to bind cation exchange resin with high affinity ((5) SEQID-00472, (6) SEQID-00640, (7) SEQID-00019).

The primary sequence analyses presented herein indicate that SEQID-00105 and SEQID-00009 are likely to bind to anion exchange chromatography resin with high affinity, and that SEQID-00640 is likely to bind to cation exchange chromatography resin with high affinity. These predictions were tested and demonstrated to be true, as demonstrated in the following four examples of polypeptide purification after microbial cell culture. In the first example, SEQID-00009 was purified directly from lysed *E. coli* cells to 99% purity using anion exchange chromatography. In the second example, SEQID-00105 was isolated from *bacillus subtilis* supernatant by anion exchange chromatography. In the third example, SEQID-00105 expressed intracellularly in *E. coli* was refined to 100% purity using anion exchange chromatography after it had been initially purified by IMAC chromatography. In the fourth example, SEQID-00640 was isolated from *bacillus subtilis* supernatant by cation exchange chromatography.

SEQID-00009 was expressed intracellularly in *E. coli*, as described herein. The cells were suspended in solution and ruptured. Three solutions were tested (0.1 M Na2CO3 pH 11.4, 0.1 M tris MCl pH 4.1, and 0.1 M potassium phosphate pH 7.0). These lysed solutions were clarified by centrifugation and mixed with anion exchange resin for binding. Two resins were tested (Fractogel® EMD TMAE Hicap (M) from EMD and POROS® D 50 µm from Life Technologies). These six binding conditions were performed in batch mode and the resins were washed with the appropriate lysis buffer to remove any unbound protein. The maximally-bound damp resin was then transferred to smaller drip columns. Each drip column was then eluted with up to six sequential washes of increasing NaCl concentration (each NaCl wash solution was buffered with the appropriate lysis buffer). SEQID-00009 was eluted in these fractions, collected, and analyzed by chip electrophoresis, as described herein. SEQID-00009 was identified as an eluting band at the expected molecular weight. In every case, SEQID-00009 eluted from the drip column at a purity higher than the load purity. This observation indicates that SEQID-00009 did bind to the anion exchange resins, as predicted, and that purification was achieved. The maximum purity achieved was 99%. In every case, SEQID-00009 was among the last proteins to elute from the resin indicating that the binding affinity of SEQID-00009 to two resins at a range of pH is generally higher than the binding affinity of any host cell protein from E. coli.

Microbial cell culture of Bacillus subtilis was performed as described herein expressing and secreting SEQID-00105 into the fermentation media. The cells were removed by centrifugation, and the supernatant was further clarified by membrane filtration. The clarified supernatant was concentrated by ultrafiltration to decrease load time on the anion exchange column and the solution was exchanged into a low salt solution buffered at pH 6.0. This solution was passed over a chromatography column (1 cm diameter, 20 cm height) containing POROS® XQ Strong Anion Exchange Resin from Life Technologies. The unbound proteins were rinsed from the resin with 20 mM Bistris, pH 6.3. The bound proteins were then eluted using a 30 column volume gradient to 400 mM NaCl, 20 mM Bistris, pH 6.3. The column effluent was collected in sequential fractions and analyzed by chip electrophoresis, as described herein. SEQID-00105 was identified as an eluting band at the expected molecular weight. The maximum purity achieved in one fraction was 100%.

SEQID-00105 was expressed intracellularly in E. coli, as described herein. The cells were ruptured, and the SEQID-00105 was purified by IMAC chromatography, according to the procedure described herein. The IMAC elution pool was further refined to 100% purity using anion exchange chromatography. The IMAC elution pool was concentrated and then diluted into 50 mM tris pH 8.0. This solution was then passed through a column (1.6 cm diameter, 20 cm height) packed with anion exchange resin: Fractogel® EMD TMAE Hicap (M) from EMD. The bound protein was rinsed with equilibration solution, and then eluted with 350 mM NaCl 50 mM tris pH 8.0. This procedure was repeated multiple times, and all samples were analyzed by chip electrophoresis, as described herein. The elution samples ranged from 79% to 99% pure.

Microbial cell culture of Bacillus subtilis was performed as described herein expressing and secreting SEQID-00640 into the fermentation media. The cells were removed by centrifugation, and the supernatant was further clarified by membrane filtration. The clarified supernatant was diluted 1:2 with deionized water and titrated to pH 5 with 1 M acetic acid. The resulting solution was membrane filtered prior to loading onto a cation exchange column (1.2 cm diameter 10 cm height) packed with POROS® XS Strong Cation Exchange Resin from Life Technologies. The bound resin was flushed with a 50 mM Acetate, 50 mM NaCl, pH 5.0 solution. The protein was then eluted with a 20 CV gradient to 1.05 M NaCl pH 5.0. Elution fractions were collected and analyzed by SDS-PAGE, Coomassie Blue Stain. The peak sample demonstrated 100% purity and no impurities eluted later in the gradient, indicating that the SEQID-00640 polypeptide bound to the cation exchange resin with more affinity than any host cell proteins.

Purification by Precipitation.

Protein precipitation is a well-known method for purification of polypeptides (Scopes R. 1987. Protein Purification: Principles and Practice. New York: Springer). Many polypeptides precipitate as salt concentrations increase, a phenomenon known as salting out. Salt types have been ranked and organized on the Hofmeister series for their different abilities to salt out proteins (F. Hofmeister Arch. Exp. Pathol. Pharmacol. 24, (1888) 247-260.). Proteins also have different propensity to precipitate due to high salt concentration based on their physicochemical properties, however, a universal metric to rank proteins for this characteristic has not been established. The use of such a ranking metric to select nutritive polypeptides for their ability to be purified has implications for the speed of process development, cost of manufacture, final purity, and robustness of the purification.

In most industrial applications of purification by polypeptides precipitation, the polypeptide of interest is selectively precipitated, and the impurities are then rinsed away from the solid precipitate. In certain embodiments, polypeptides do not precipitate with high levels of salt, and purification is achieved by precipitating the impurities. In the present application, we have defined two methods of screening a library of polypeptides to rank-order them for their ability to remain soluble through harsh precipitation conditions. One method is an in silico prediction based on calculation of protein total charge across a range of pH using the primary sequence of the polypeptides, as described herein. The second method is a multiplexed purification screen in vitro, as described herein. The two methods have successfully been used independently of each other, and they have been used together on the same set of 168 nutritive polypeptides with supportive data, as described herein.

The solubility of a polypeptide correlates directly with the abundance of surface charges (Jim Kling, Highly Concentrated Protein Formulations: Finding Solutions for the Next Generation of Parenteral Biologics, BioProcess International, 2014.). It has been established that surface charges can impart physical characteristics to a polypeptide (Lawrence, M. S., Phillips, K. J., & Liu, D. R. (2007). Supercharging proteins can impart unusual resilience. Journal of the American Chemical Society, 129(33), 10110-2. doi: 10.1021/ja071641y).

The in silico method of predictive solubility ranking is based on calculating total number of charges of a nutritive polypeptide at a range of pH based on the primary sequence.

A prevalence of one or more certain amino acids, e.g., histidine, arginine, and lysine in a polypeptide imparts in that polypeptide, or a portion thereof, a positive charge when the pH of the protein solvent is below the pKa of the one or more amino acids. A prevalence of one or more certain amino acids, e.g., glutamic acid and aspartic acid in a polypeptide imparts in that polypeptide, or a portion thereof, a negative charge when the pH of the protein solvent is above the pKa of the one or more amino acids.

The total number of charges of a polypeptide changes as a function of the pH of the protein solvent. The number of positive charges and negative charges can be calculated at any pH based on the primary sequence of the polypeptide, as described herein. The sum of the positive charges and negative charges at any one pH results in the calculated net charge. The isoelectric point (pI) of the polypeptide is the pH at which its calculated net charge is 0. To make comparisons across nutritive polypeptides, the total number of positive charges is added to the total number of negative charges (the absolute value), and that total charge is normalized by the number of amino acids in the sequence, and the parameter "total charge per amino acid" results as the novel comparator between sequences, which is used to predict the polypeptide's resistance to precipitation. The more resistant a polypeptide is, the higher the likelihood that it can be purified to a high degree by precipitating out the impurities. Unlike predicting chromatographic performance, solubility is not affected by the polarity of the charges. While it is often true that a polypeptide experiences its lowest solubility at the pI of the sequence, some polypeptides have a high total charge and are still extremely soluble at their pI, as shown herein.

Nutritive polypeptide sequences have been evaluated by calculating the total charge per amino acid of each polypeptide at a range of pH (1-14). Nutritive polypeptides were ranked by total charge per amino acid. Polypeptides with a low pI and very negative net charge per amino acid across a wide range of pH and polypeptides with a high pI and very positive net charge per amino acid across a wide range of pH are all expected to score equally well by this ranking. Polypeptides with a large number of both charges score the best.

Figure 3:
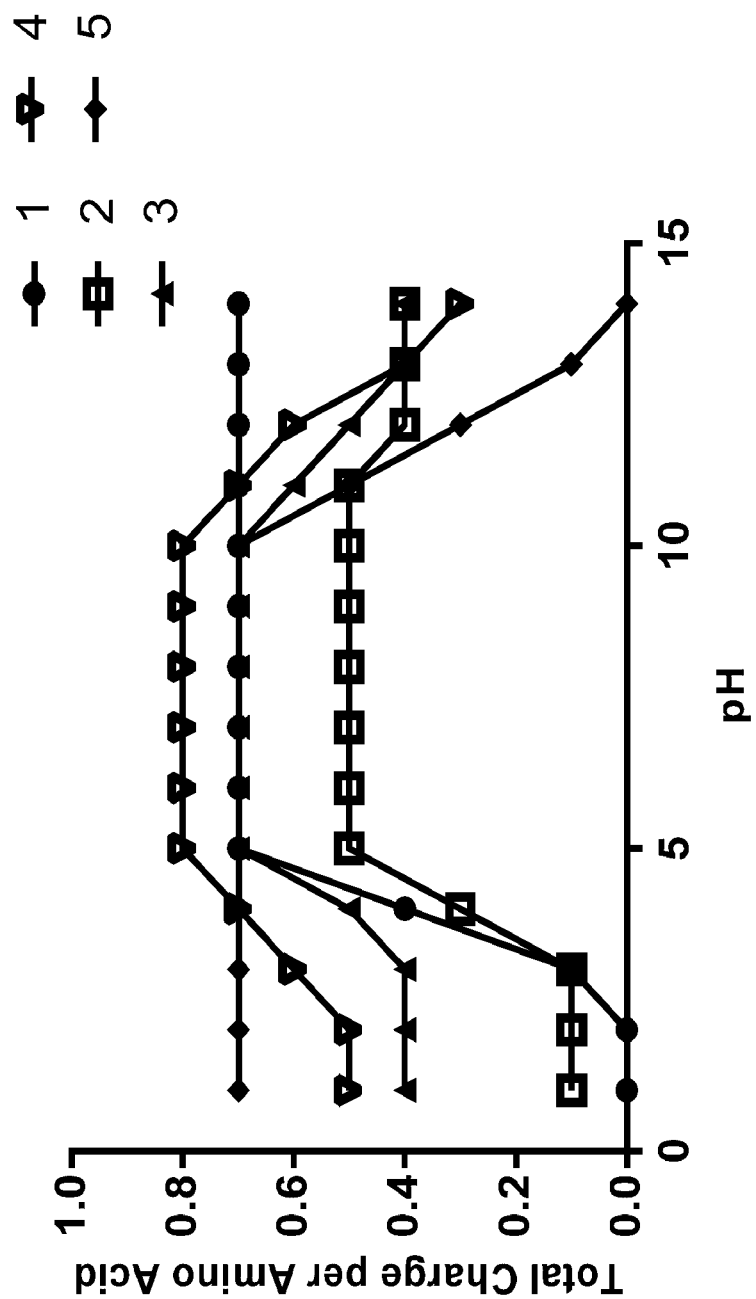
FIG. 3 is a chart demonstrating total charge per amino acid over a range of pHs for exemplary nutritive polypeptides. (1) SEQID-00475, (2) SEQID-00009, (3) SEQID-00478, (4) SEQID-00433, (5) SEQID-00472.

FIG. 3 demonstrates example nutritive polypeptides, which, based on primary sequence, are predicted to have extremely high solubility. This set includes polypeptides with a low pI (<4) and very negative net charge per amino acid across a wide range ((1) SEQID-00475, (2) SEQID-00009). This set includes polypeptides with a high pI (>10) and very positive net charge per amino acid across a wide range of pH ((4) SEQID-00433, (5) SEQID-00472). This set includes polypeptides with more neutral pI ((3) SEQID-00478). Many of the polypeptides displayed here show high charge even at extreme pH values, such as <4 and >12: The entire set is expected to be extremely soluble and resist precipitation across a wide range of pH.

In this demonstration, the *E. coli* cells were harvested from shake flask fermentation by centrifugation, and the whole cells were distributed into tubes (1 gram of cells per tube). To each tube, 4 mL of lysis solution was added, and cells were lysed by sonication at 75 Amps for 30 seconds. Lysis solutions included: Water, 8 M Urea 0.1 M Tris 0.1 M NaCl, 0.1 M Acetate 10% gly 0.1% Tween-80 0.3 M Arg 0.3M NaCl 10 mM EDTA, 10 mM Imidazole pH 5.0, 0.1 M Acetate 10% gly 0.1% Tween-80 0.3 M Arg 0.3M NaCl 10 mM EDTA, 10 mM Imidazole pH 7.0, 100 NaCl 100 Hepes 10 Imidazole pH 7.5, 500 NaCl 100 Hepes 10 Imidazole pH 7.5, 100 mM Phos, 150 mM NaCl, 10 mM Imidazole pH 7.5, 0.1 M NaCl 0.1 M Hepes 10 mM Imidazole 50 mM CaCl2 PH 7.5, 0.1 M Hepes 3.5 M Am Sulfate pH 7.5, 0.1 M Hepes 2 M Am. Sulfate pH 7.5, 0.1 M Tris, 0.1 M Tris 0.5 M NaCl, 150 mM NaCl 10 mM Acetate 15 mM Imidazole pH 6.04, and 500 mM NaCl 100 mM Acetate 1.5 mM Imidazole pH 6.04. The lysate was clarified by centrifugation and 0.2 um filtration. The clarified supernatant was analyzed by SDS-PAGE (blue stain), as described herein. SEQID-00009 demonstrated solubility in each of these conditions. *E. coli* host cell proteins generally demonstrated solubility in these conditions as well, with one exception. In the presence of 3.5 M ammonium sulfate effectively precipitated the majority of the host cell proteins resulting in 85% purified SEQID-00009 after the cell harvest stage of the process. This result indicates that SEQID-00009 is more soluble than most *E. coli* host cell proteins and that precipitation can be used as part of a low cost method for isolation. This correlates with the high total charge of SEQID-00009 and supports that the prediction is accurate. Furthermore, it is predicted that polypeptides With more charge than SEQID-00009 would be even more soluble which could have the benefit over SEQID-00009 of higher polypeptide yield.

Figure 4:
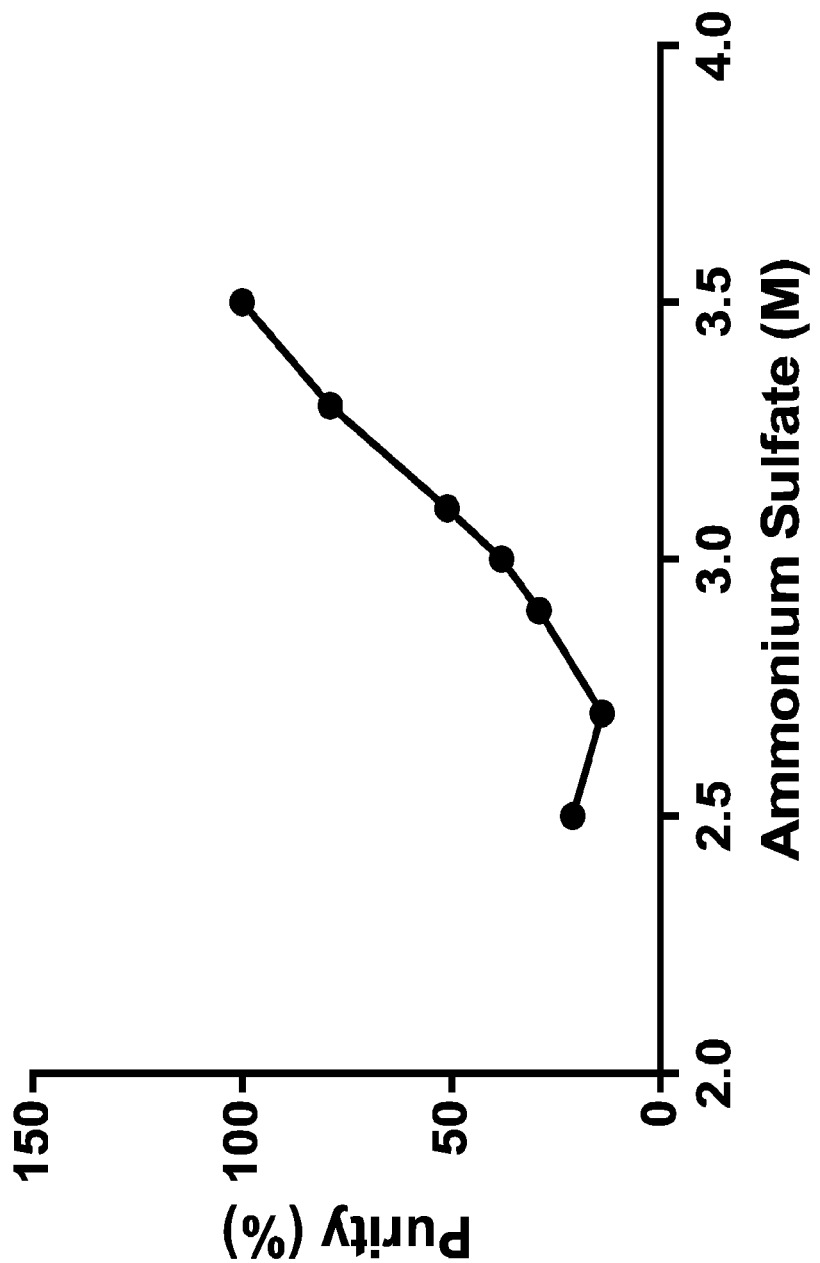
FIG. 4 is a chart demonstrating purity of SEQID-00009 is as a function of ammonium sulfate concentration.

In subsequent experiments, SEQID-00009 was purified to 99% purity with a single stage of ammonium sulfate precipitation. In this demonstration, the *E. coli* cells were harvested from shake flask fermentation by centrifugation, and the whole cells were suspended in 0.1 M sodium carbonate, pH 10 (1 gram of cells in 4 mL of solution). The cells were lysed by sonication (80 Amp for 2 minutes). The lysate was clarified by centrifugation and 0.2 m membrane filtration. The clarified supernatant was divided into a series of 3 mL fractions, to which a stock solution of 4 M ammonium sulfate, pH 9.8 was added. Variable amounts of stock solution were added to achieve a range of ammonium sulfate concentrations. The samples were mixed for 10 minutes at room temperature, and clarified by centrifugation and 0.2 um membrane filtration. The clarified supernatants were analyzed by SDS-PAGE (blue stain), as described herein. FIG. 4 shows the purity of SEQID-00009 is as a function of ammonium sulfate concentration.

Multiplexed Purification: Ion Exchange Chromatography

In some cases, an entire library of proteins is tested in a multiplexed screening experimental platform. 168 nutritive polypeptides were transfected and expressed in a multiplexed expression system in which a single growth condition was used to produce each polypeptide in a single container. This multiplexed expression system allows any set of polypeptide sequences to be tested in parallel for a wide range of manufacturability parameters, each of which can be used to rank order the set of polypeptides being examined. A set of manufacturability parameters includes expression level, polypeptide solubility, ability of polypeptide to be purified by chromatography, ability to resist thermal denaturation, ability of polypeptide to digest, ability of polypeptide to be purified by resisting harsh treatments.

The set of 168 nutritive polypeptides was tested for intracellular expression in *E. coli*. The solubly expressed polypeptides were pre-treated as a group and then subjected to a series of purification conditions so that the set could be rank ordered in terms of their ease of purification by multiple methodologies. As described herein, it is expected that the same subset of proteins will be identified from each expression system to bind a particular mode of chromatography based on the primary sequence analysis, specifically net charge per amino acid.

For *E. coli* multiplexed purification, the set of nutritive polypeptide sequences was HIS8 tagged. The cells were cultured, as described herein, ruptured, and the solution was clarified, as described herein. This production resulted in a solution containing all of the polypeptides from the set which were both expressed and soluble. That set of soluble polypeptides was passed over an 5 ml IMAC column, and eluted, as described herein. This IMAC purification effectively isolated the solubly expressed nutritive polypeptides as a set by removing the majority of *E. coli* host cell proteins. The elution fraction was concentrated and buffer exchanged into a low salt solution buffered near neutral pH before testing various purification methods. The methods tested include anion exchange chromatography, cation exchange chromatography, and negative precipitation, in which the impurities precipitate and the polypeptides that remain soluble rank the highest. In this case, impurities have been removed, so the polypeptides are rank ordered amongst themselves. Additionally, the set of proteins was tested for thermal stability, by heating, wherein the polypeptides which remain soluble after heating are more thermal stable than those which precipitate.

This mixture of polypeptides was rank ordered for their ability to bind anion exchange and cation exchange chromatography resins. Four chromatography resins were tested. Two anion exchange resins: Capto DEAE, from GE Lifesciences and Eshmuno® Q Resin from EMD. Two cation exchange resins: POROS® XS Strong Cation Exchange Resin from Life Technologies and Eshmuno® S Resin from EMD. Each resin was tested with eight different buffering conditions, as follows. Buffers used for anion wxchange: Water (no buffer), pH 7; 15 mM Na2HPO4, pH 8.7; 30 mM Na2HPO4, pH 9.0; 15 mM Tris Base, pH 9.6; 30 mM Tris Base, pH 10.0; 30 mM Na2CO3, pH 11.2; 25 mM Arginine, pH 10.1. Buffers used for cation exchange: Water (no buffer), pH 7; 15 mM KH2PO4, pH 4.2; 30 mM KH2PO4, pH 4.5; 15 mM Tris Acid, pH 4.9; 30 mM Tris Acid, pH 4.7; 15 mM MES Acid, pH 3.9; 25 mM MES Acid, pH 4.1.

The resins were distributed to a 96 well filterplate (20 µL of resin per well) and each was equilibrated three times. The protein set was mixed with the equilibration buffers and allowed to bind to the resins. The unbound proteins in solution were separated from the resin by centrifuging the liquid through the filterplate for collection in a 96 well plate below. The remaining unbound proteins were further rinsed off the resin with a wash of equilibration buffer. The bound proteins were then sequentially eluted with three stages of increasing salt concentration (50, 250, 1500 mM NaCl buffered in the appropriate set of buffers above). The loosely bound proteins were removed first, and the proteins that were removed in the final elution condition were very tightly bound to the resin. Thus, a library of 168 proteins was expressed in *E. coli* and rank ordered for their binding affinity to anion exchange and cation exchange chromatography resin.

The experiment described herein produced 160 samples (four resins, eight buffers, five collections). The five collection stages include: the flow through fraction, the wash fraction, the 50 mM NaCl elution, the 250 mM NaCl elution, and the 1500 mM NaCl elution. All 160 samples were analyzed by UV-vis absorbance at 280 nm, by Bradford total protein assay, by Chip electrophoresis, and select samples were analyzed by LC/MS/MS. All analytical assays are described herein.

The assays demonstrated that some protein flowed through the resin and was not bound. In most cases, the wash fraction did not elute a significant amount of protein, indicating that any further protein to elute was in fact bound to the resin. As the NaCl concentration increased, the total protein being removed also increased demonstrating successful binding and elution in nearly every condition. The proteins detected by electrophoresis in 1500 mM NaCl elution conditions remained bound through the 250 mM NaCl wash condition, indicating strong binding. Select conditions were selected for LC/MS/MS analysis. The LC/MS/MS analysis was performed with the 1500 mM NaCl elution sample from anion exchange chromatography resin (Capto DEAE) in the 30 mM Tris Base buffering condition. The LC/MS/MS results were searched against the sequences of all 168 nutritive polypeptides originally expressed in the library. Eight unique polypeptides were identified as having high binding affinity to this anion exchange resin in this condition are SEQID-00341, SEQID-00346, SEQID-00497, SEQID-00525, SEQID-00555, SEQID-00605, SEQID-00606, SEQID-00610. For each polypeptide sequence in this set, the net charge per amino acid was calculated based on primary sequence across the range of pH tested. As described herein, it is expected that polypeptides which bind tightly to anion exchange resin's have a net charge per amino acid below 0 across the pH range, and this is demonstrated to be true, with a single exception. Any exception is expected to be due to the fact that there is charge heterogeneity across the length of the sequence, and as described, net charge per amino acid does not always capture that. This multiplexed screen identified a set of polypeptides from a larger library based on their affinity to bind anion exchange resin, and this result can be predicted based on the primary sequence analysis, as described herein.

The LC/MS/MS analysis was performed with the 1500 mM NaCl elution sample from cation exchange chromatography resin (Poros XS) in the 15 mM Tris Acid buffering condition. The LC/MS/MS results were searched against the sequences of all 168 nutritive polypeptides originally expressed in the library. Eight unique polypeptides were identified as having high binding affinity to this cation exchange resin in this condition are SEQID-00302, SEQID-495, SEQID-00522, SEQID-00537, SEQID-00546, SEQID-00547, SEQID-00560, SEQID-00598. For each polypeptide sequence in this set, the net charge per amino acid was calculated based on primary sequence across the range of pH tested. As described herein, it is expected that polypeptides which bind tightly to cation exchange resins have a net charge per amino acid above 0 across the pH range, and this is demonstrated to be true, with minor exception. Any exception is expected to be due to the fact that there is charge heterogeneity across the length of the sequence, and as described, net charge per amino acid does not always capture that. This multiplexed screen identified a set of polypeptides from a larger library based on their affinity to bind cation exchange resin, and this result can be predicted based on the primary sequence analysis, as described herein.

In the *Bacillus subtilis* example of multiplexed purification, the set of polypeptide sequences was expressed without any type of purification tag. The cells were cultured in flasks, as described herein and expressed and secreted the polypeptides into the growth media. The cells were removed by centrifugation and the solution was further clarified by membrane filtration, as described herein. This production process resulted in a solution containing all of the polypeptides from the set which were both expressed and solubly secreted. That set of soluble polypeptides was concentrated and buffer exchanged into a solution of phosphate, pH 7.0 before testing various purification methods. The methods tested include anion exchange chromatography, cation exchange chromatography, and negative precipitation, in which the impurities precipitate and the polypeptides that remain soluble rank the highest. In these multiplexed purification studies, the polypeptides are purified away from each other and from the host cell proteins in order to be rank ordered amongst themselves.

This mixture of polypeptides was rank ordered for their ability to bind to anion exchange and cation exchange chromatography resins. Four chromatography resins were tested. Two anion exchange resins: Capto DEAE, from GE Lifesciences and Eshmuno® Q Resin from EMD. Two cation exchange resins: POROS® XS Strong Cation Exchange Resin from Life Technologies and Eshmuno® S Resin from EMD. Each resin was tested with eight different buffering conditions. Buffers used for Anion Exchange: 18 mM BIS-TRIS, pH 6.5; 13 mM HEPES, pH 7.0; 18 mM HEPES, pH 7.5; 16 mM TRIS, pH 8.0; 32 mM TRIS, pH 8.5; 88 mM TRIS, pH 9.0; 13 mM Na2CO3, pH 9.5; 20 mM Na2CO3, pH 10.0. Buffers used for Cation Exchange: 19 mM Citrate, pH 3.0; 13 mM Citrate, pH 3.5; 49 mM Acetate, pH 4.0; 22 mM Acetate, pH 4.5; 14 mM Acetate, pH 5.0; 10 mM Acetate, pH 5.5; 24 mM MES, pH 6.0; 15 mM MES, pH 6.5.

The resins were distributed to a 96 well filterplate (50 µL of resin per well) and each was equilibrated three times. The protein set was mixed with the equilibration buffers and allowed to bind to the resins. The unbound proteins in solution were separated from the resin by centrifuging the liquid through the filterplate for collection in a 96 well plate below. The remaining unbound proteins were further rinsed off the resin with two wash cycles of equilibration buffer. The bound proteins were then sequentially eluted with increasing salt concentration (250, 500, 1000 mM, 2000 mM NaCl). Each salt solution was buffered in the appropriate equilibration buffer except for the 2000 mM NaCl solution which was buffered with MES at pH 6.0 for anion exchange resins and with TRIS at pH 8.0 for cation exchange resins. The loosely bound proteins were removed first, and the proteins that were removed in the final elution condition were very tightly bound to the resin. Thus, the library of proteins was expressed in *Bacillus subtilis* and rank ordered for their binding affinity to anion exchange and cation exchange chromatography resin.

The experiment described herein produced 192 samples (four resins, eight buffers, six collections). The six collection stages include: the flow through fraction, the wash fraction, the 250 mM NaCl elution, the 500 mM NaCl elution, the 1000 mM NaCl elution, and the 2000 mM NaCl elution. All 192 samples were analyzed by Chip electrophoresis. Select samples were analyzed by SDS-PAGE. Select samples were analyzed by LC/MS/MS. All analytical assays are described herein. Identification of strongly bound proteins is performed by a combination of Chip electrophoresis, SDS-PAGE, and LC/MS/MS.

SDS-PAGE results demonstrate that the majority of polypeptides do not bind to these resins, in fact they are found in the flow through fraction. Therefore, the polypeptides that bind to the resins are unique in their ability to be purified from the majority of other polypeptides. The set of polypeptides in the various elution fractions have been isolated from a larger set based on their properties in a purification process; which has implications for the manufacture, cost, development time, and eventual purity of these polypeptides. Furthermore, of the polypeptides that bind to resins, these can be rank ordered by their ability to remain bound to the resin through stringent wash conditions with increasing concentrations of NaCl. Those polypeptides found in the 2000 mM NaCl samples have been able to remain bound through 1000 mM NaCl wash conditions. It is widely accepted that any polypeptide which can remain bound to an ion exchange resin above 500 mM NaCl is considered to have very high affinity for that resin. The banding pattern is similar between the two cation exchange resins supporting that the proposed mechanism. Likewise, the banding pattern is similar between the two anion exchange resins, and represents a different sample set than those identified by cation exchange. To rank order the individual polypeptides identified in any subset, LC/MS/MS is utilized.

As an exemplary dataset, the LC/MS/MS results identified the following polypeptides as binding to the Capto DEAE anion exchange resin at pH 7.5: P39645, P37869, P80698, P80868, P21880, P80239, P50849, P12425, O34669, P39138, P37871, P19669, P29727, P80643, O34981, P80879, P54716, P37477. As an exemplary dataset, the LC/MS/MS results identified the following polypeptides as binding to the Poros XS cation exchange resin at pH 4.0: O34669, P19405, O31803, O05411, O31973, O31643, P80239, P26901, P08821, P80240, P49814, O34310, P0CI78, O31925, P71014, P42111.

These polypeptides identified as having high binding affinity were analyzed for physicochemical properties based on their primary sequence. The net charge per amino acid was calculated based on primary sequence across the range of pH tested. As described herein, it is expected that polypeptides which bind tightly to anion exchange resins have a net charge per amino acid below 0 across the pH range, and this was generally demonstrated to be true. As described herein, it is expected that polypeptides which bind tightly to cation exchange resins have a net charge per amino acid above 0 across the pH range, and this was generally demonstrated to be true. Any exception is expected to be due to the fact that there is charge heterogeneity across the length of the sequence, and as described, net charge per amino acid does not always capture that. This multiplexed screen identified a set of polypeptides from a larger library based on their affinity to bind anion exchange resin, and this result can be predicted based on the primary sequence analysis, as described herein.

In the *Bacillus subtilis* example of multiplexed purification, the set of 168 nutritive polypeptide sequences was expressed without any type of purification tag. The cells were cultured in flasks, as described herein and expressed and secreted the polypeptides into the growth media. The methods tested included negative flocculation/precipitation, in which the impurities precipitate and the polypeptides that remain soluble rank the highest. In these multiplexed purification studies, impurities are present in the form of soluble impurities (e.g. host cell proteins, DNA, phospholipids, and product-related impurities, such as isoforms or aggregated species), insoluble impurities, cells, or cellular debris (e.g. membrane fragments). Negative precipitation was performed prior to and following removal of insoluble impurities, cells, and cellular debris centrifugation and further clarification by membrane filtration.

The set of solubly expressed and secreted polypeptides in the cell suspension (prior to centrifugation and membrane filtration) and clarified supernatant (following centrifugation and membrane filtration) were rank ordered for their ability to associate with the flocculating agents. Furthermore, the flocculating agents were rank ordered for their ability to associate with the impurities. 48 flocculating agents were tested at two different concentrations, as follows: Ammonium Bicarbonate (100 mM, 200 mM); Manganese Chloride (100 mM, 200 mM); Nickel Sulfate (100 mM, 200 mM); Sodium Citrate (100 mM, 200 mM); Lithium Acetate (100 mM, 200 mM); Propylene Glycol (10% v/v, 20% v/v); Ammonium Nitrate (100 mM, 200 mM); Potassium Chloride (100 mM, 200 mM); Sodium Sulfate (100 mM, 200 mM); Sodium Molybdate (100 mM, 200 mM); Acetic Acid (100 mM, 200 mM); Chitosan MMW (0.1% w/v, 0.2% w/v); Ammonium Sulfate (100 mM, 200 mM); Sodium Chloride (0.5M, 1.0M); Zinc Sulfate (100 mM, 200 mM); Sodium Nitrate (100 mM, 200 mM); Citric Acid (100 mM, 200 mM); Guanidine HCl (0.6M, 1.2M); Ammonium Chloride (100 mM, 200 mM); Zinc Chloride (100 mM, 200 mM); Potassium Carbonate (100 mM, 200 mM); Sodium Phosphate (100 mM, 200 mM); Hydrochloric Acid (100 mM, 200 mM); PEG 1000 (5% w/v, 10% w/v); Calcium Chloride (100 mM, 200 mM); Iron Citrate (100 mM, 200 mM); Potassium Nitrate (100 mM, 200 mM); Sodium Propionate (100 mM, 200 mM); Potassium Hydroxide (100 mM, 200 mM); PEG 4000 (5% w/v, 10% w/v); Choline Chloride (100 mM, 200 mM); Copper Sulfate (100 mM, 200 mM); Potassium Phosphate (100 mM, 200 mM); Sodium Succinate (100 mM, 200 mM); Sodium Hydroxide (100 mM, 200 mM); Triton X-100 (0.5% w/v, 1.0% w/v); Iron Chloride (100 mM, 200 mM); Iron Sulfate (100 mM, 200 mM); Deoxycholic Acid (0.5% w/v, 1.0% w/v); Sodium Thiocyanate (100 mM, 200 mM); Ethanol (10% v/v, 20% v/v); Tween 80 (0.5% w/v, 1.0% w/v); Magnesium Chloride (100 mM, 200 mM); Magnesium Sulfate (100 mM, 200 mM); Sodium Carbonate (100 mM, 200 mM); Sodium Thiosulfate (100 mM, 200 mM); Isopropanol (10% v/v, 20% v/v); Urea (0.8M, 1.6M).

The cell suspension (prior to centrifugation and membrane filtration) and clarified supernatant (following centrifugation and membrane filtration) were distributed into a 96-well filter plate (300 µL per well for the low flocculating agent concentration and 267 µL for the high flocculating agent concentration). These loads were diluted 0.1× or 0.2× by adding 33 µL or 67 µL, respectively, of concentrated flocculating agent solutions. The resulting solution was mixed for 1 hour at room temperature. Following mixing, the remaining soluble material was separated from the insoluble material by centrifuging the liquid through the filterplate for collection in a 96 well plate below. All 192 samples were analyzed by Chip electrophoresis. Select samples were analyzed by SDS-PAGE. Select samples were analyzed by LC/MS/MS. All analytical assays are described herein.

SDS-PAGE results demonstrated that some conditions effectively precipitated many polypeptides, indicating that the soluble polypeptides in those conditions were rather soluble, and can be isolated in these conditions. The polypeptides that were soluble in the various precipitation conditions were isolated from a larger set based on their properties in a purification process, which has implications for the manufacture, cost, development time, and eventual purity of these polypeptides. Some polypeptides are widely soluble across a range of conditions due to their high charge, according the mechanism described herein. To rank order the individual polypeptides identified in any subset, LC/MS/MS is utilized.

As an exemplary dataset, the LC/MS/MS results demonstrated that the following polypeptides were isolated due to their sustained solubility in 100 mM Acetic Acid, pH 5.18: O34669, P54423, P21879, P10475, P28598, O31803, P40767, P17889, O34918, Q08352, P24327, P37871, O31973, P81101, P50849, P26901, P80700, O34385, P70960, P42111, P21880, P27876, P80868, P54716, O34313, O07603, O05411, P54531, O05497, P12425, O07921, P19405, Q06797, P02394, P24141, P09339, P37965, P07343, P37809, P0CI78, P39824, P49814, P39632, P39773, P51777, P21883, O06989, P25152, P70961, O07593, O34310, P80860, P37437, P80698, P13243, P38494, P39645, P39148, O31398, P08821, P08877, O05268, PO4957, P28366, P31103, P94421, P14949, P80864, P37869, P80240, P80859, O06993, O34666, O34714, P37546, Q9KWU4, O31605, P16616, P80239, O34788, P71014, P37571, P09124, P42971, O31925, P39793, P17865, P16263, P18429, P05653, P26908, P33166, O34499, P08750, P54602, Q45071, P12047, P42919, O34334, O34358, P39120, P39126, P00691, P14192, P22250, P37870, P39116, P54484, P54488, P54547, P56849, O31579, O34629, P30949, P54422, P54530, P54542, P96739.

As an exemplary dataset, the LC/MS/MS results demonstrated that the following polypeptides were isolated due to their sustained solubility in 100 mM Potassium Carbonate, pH 9.66: O34669, P54423, P21879, P24327, P40767, P17889, O31973, P10475, P28598, P80700, P37871, P80868, O31803, P81101, P70960, P27876, P19405, P28366, P71014, P26901, O34385, P21880, Q06797, P24141, P07343, P80698, P13243, P42971, P39793, O31643, P39071, O32210, P21468, P42199, P54531, P37965, P37809, P21883, P38494, P39148, P08877, P09124, P17865, P16263, P54602, P46906, O34918, Q08352, P42111, O05411, O05497, O07921, P02394, P09339, P49814, P39632, P37437, P39645, P08821, P04957, P31103, Q9KWU4, P80239, O34788, P18429, P05653, P26908, O34499, P08750, P12047, P37870, P54547, Q06796, Q45477, P25144, P46898, P40871, O31501, P21464, P21465, P40409.

As an exemplary dataset, the LC/MS/MS results demonstrated that the following polypeptides were isolated due to their sustained solubility in 100 mM Calcium Chloride, pH 7.50: O34669, P54423, P21879, O34918, O31803, P10475, P28598, P24327, P40767, P80700, P27876, P37871, O34385, P13243, Q08352, O07921, P17889, O31973, P80868, P26901, P24141, P80698, P02394, Q06797, P39148, P19405, P54531, P37965, P09339, P39645, O34788, P37571, O07909, P70960, P21880, P42971, P37809, P80239, Q45477, P94421, P81101, P07343, P39793, P39071, P38494, P17865, P42111, P12425, P39773, O06989, P80864, O05411, O05497, P25144, P0CI78, P39824, P25152, P70961, O31398, O05268, P37869, P80859, O32150, P39138, O31643, P21468, P42199, P21883, P09124, P49814, P05653, Q06796, O34313, P51777, O34310, O06993, O34666, O31925, P33166, P39634, P37808, P39779, P28366, P08877, P16263, P39632, P08821, PO4957, O34499, P08750, P46898, P50849, P54716, P80860, P14949, P80240, Q45071, O34334, O34358, P39120, P39126, P20278, P53001, P54375, O06006, O06988, O34667, O34981, P08164, P19669, P30950, P37487, P45694, P81102, P71014, P54602, P46906, P31103, P18429, P26908, P12047, P40871, O07603, O34714, P37546, P42919, P00691, P22250, P39116, P54488, P40924, C0SP93, O31760, O32023, O32106, O32167, O34962, P12048, P25995, P28015, P28599, P34957, P35137, P37253, P37477, P37812, P37940, P46354, P49778, P54169, P54418, P54550, P54941, P80885, P94576, Q04796, Q06004, Q07868, Q9R911.

As an exemplary dataset, the LC/MS/MS results demonstrated that the following polypeptides were isolated due to their sustained solubility in 100 mM Iron Chloride, pH 4.54: P26901, O34669, O34918, P54423, O31803, P96657, O31973, P37871, O07921, O31643, Q06796, P17889, P80698, P80239, O05411, O07909, O31925, P20278, P71014, P21879, P10475, P80700, P27876, Q08352, P81101, P42111, P0CI78, P39824, O32210, P28598, P24327, O34385, Q06797, P19405, P37571, P38494, O31398, P09124, P51777, P08821, P18429, O07593, P80868, P09339, P39645, O34788, O05268, P49814, P08877, P39632, P04957, P14949, P31103, O06746, O07555, P40767, P02394, P54531, P37965, P70960, P37809, P07343, P39773, P33166, P39634, P16263, P46898, P50849, P54716, P80240, Q45071, P53001, P54375, P26908, P42919, P40924, P14192, P54484, P56849, O06748, P12878, P21477, P32081, P46899, P50620, P54464.

These polypeptides identified as having high solubility were analyzed for physicochemical properties based on their primary sequence. The total charge per amino acid was calculated based on primary sequence across the range of pH tested. As described herein, it is expected that the most soluble polypeptides have a high total charge per amino acid, and this was generally demonstrated to be true. This multiplexed screen identified a set of polypeptides from a larger library based on their affinity to bind anion exchange resin, and this result can be predicted based on the primary sequence analysis, as described herein.

Multiplexed Purification: Precipitation & Flocculation

Conventional biopharmaceutical protein purification methods used to remove cells and cellular debris include centrifugation, microfiltration, and depth filters. Filter aids, such as diatomaceous earth, can be used to enhance performance of these steps, but they are not always effective and sometimes significantly bind the product of interest. Their use may also require the addition of a solid or a homogeneous suspension that can be challenging as part of large-scale biopharmaceutical operations.

Polymeric flocculants can be used to aid in the clarification of mammalian cell culture process streams, but they can have limitations. For example, protamine sulfate preparations typically used as processing aids are limited in application due to concerns about inactivation of the protein of interest or product loss due to precipitation (Scopes, Protein Purification Principles and Practice 3rd edition, Cantor eds. 22-43; 171 (1994)).

High quality reagents, such as that sold for medical use, can be expensive. In certain instances, removal to very low levels be required to ensure there are no adverse effects in patients. For example, chitosan is not a well-defined reagent and there are concerns about its consistent performance in routine use in clarification applications. Multiple charged polymers, such as DEAE dextran, acrylamide-based polymers often used in waste-water treatment (NALCO Water Handbook, Section 2.1: Applications—Impurity Removal, 3rd ed., McGraw-Hill, 2009) and polyethylene amine (PEI) have been considered for use in clarification applications. With respect to the latter two types of polymers, the acrylamide reagents have the potential for contamination with toxic reagents and polyethylene amine, while a highly effective clarification reagent, is often contaminated with varying amounts of ethylenimine monomer, a suspected cancer agent (Scawen et al., Handbook of Enzyme Biotechnology, 2nd edition, Wiseman eds.:15-53 (1985)). Moreover, many of these polymers, including PEI, tend to bind almost irreversibly to many chromatography resins, thereby limiting downstream processing options. The regulatory and raw material reuse concerns associated with these polymers have limited their application primarily to academic studies.

Non-polymer based flocculants, such as alum and iron salts, have been utilized in the wastewater treatment industry (NALCO Water Handbook, Section 2.1: Applications—Impurity Removal, 3rd ed., McGraw-Hill, 2009). These substances may appear to be non-useful in processing protein products, because they may bind to the protein product or may catalyze chemical reactions resulting in modifications of the protein that could affect safety or efficacy.

In some cases, an entire library of proteins is tested in a multiplexed screening experimental platform. The 168 nutritive polypeptide library was transfected and expressed in a multiplexed expression system in which a single growth condition was used to produce each polypeptide in a single container. This multiplexed expression system allows any set of polypeptide sequences to be tested in parallel for a wide range of manufacturability parameters, each of which can be used to rank order the set of polypeptides being examined. A set of manufacturability parameters includes expression level, polypeptide solubility, ability of polypeptide to be purified by chromatography, ability to resist thermal denaturation, ability of polypeptide to digest, ability of polypeptide to be purified by resisting harsh treatments.

For E. coli multiplexed purification by precipitation, the set of 168 nutritive polypeptide sequences was HIS8 tagged. The cells were cultured, as described herein, ruptured, and the solution was clarified, as described herein. This production resulted in a solution containing all of the polypeptides from the set which were both expressed and soluble. That set of soluble polypeptides was passed over an IMAC column, and eluted, as described herein. This IMAC purification effectively isolated the solubly expressed nutritive polypeptides as a set by removing the majority of E. coli host cell proteins. The elution fraction was concentrated and buffer exchanged into a low salt solution buffered near neutral pH before testing various purification methods. The methods tested include anion exchange chromatography, cation exchange chromatography, and negative precipitation, in which the impurities precipitate and the polypeptides that remain soluble rank the highest. In this case, impurities have been removed, so the polypeptides are rank ordered amongst themselves. Additionally, the set of proteins was tested for thermal stability, by heating, wherein the polypeptides which remain soluble after heating are more thermal stable than those which precipitate.

The pre-treated group of polypeptides expressed by E. coli was distributed to 32 wells of a 96 well plate (4.7 µL of protein stock per well at a total protein concentration of 43 g/L). Stock solutions were added to each well to create the following conditions: Control (No Additives); 42 mM Citrate/Phosphate, pH 7.1; 42 mM Citrate/Phosphate, pH 6.5; 42 mM Citrate/Phosphate, pH 6.0; 42 mM Citrate/Phosphate, pH 5.6; 42 mM Citrate/Phosphate, pH 5.0; 42 mM Citrate/Phosphate, pH 4.6; 42 mM Citrate/Phosphate, pH 4.3; 42 mM Citrate/Phosphate, pH 3.9; 42 mM Citrate/Phosphate, pH 3.7; 42 mM Citrate/Phosphate, pH 2.8; 75 mM Tris Base; 50 mM Na2CO3; 50 mM Piperazine Base; 100 mM sodium phosphate dibasic; 50 mM ethanolamine; 100 mM sodium phosphate monobasic; 100 mM MES Acid; 100 mM Sodium Acetate, pH 4.1; 100 mM MOPS Acid; 100 mM Tris HCl; 25 mM Acetic Acid; 25 mM Boric Acid; 25 mM Citric Acid; 50 mM PIPES Acid; 50 mM Succinic Acid; 1.2 M sodium sulfite; 1.5 M sodium sulfite; 2.5 M Ammonium Sulfate; 3.5 M Ammonium Sulfate; 200 mM CaCl2; 60% methanol. Water was added such that each well contained a total of 40 µL of solution at 5 g/L. The plates were mixed for 30 minutes at room temperature, then centrifuged at 3,000 RCF for 10 minutes to pellet any precipitated protein. A sample was taken from each well for analysis. The 96 well plate sas then heated at 95° C. for 2 minutes. The plate was again centrifuged at 3,000 RCF for 10 minutes to pellet any precipitated protein, and a sample was taken from each well for analysis. All 64 samples were analyzed by Bradford assay, and select samples were analyzed by chip electrophoresis, followed by LC/MS/MS. All analytical assays are described herein. The measurements of total protein remaining in solution demonstrate that many conditions caused polypeptide precipitation, indicating that a portion of the conditions tested were rigorous harsh conditions.

LC/MS/MS analysis was performed with four select samples, described in the Table E9D. The detection of nutritive polypeptide in the soluble fraction is noted with an X.

TABLE E9D

Nutritive polypeptides detected in the soluble fraction of select conditions. Detection is noted with an X.

| SEQID | 42 mM citrate/ phosphate, pH 5.6, heated | 100 mM sodium phosphate monobasic | 50 mM PIPES acid, heated | 2.5M Ammonium sulfate |
|---|---|---|---|---|
| SEQID-00105 | X | | | |
| SEQID-00115 | X | | | |
| SEQID-00302 | X | X | X | X |
| SEQID-00304 | X | | | |
| SEQID-00305 | X | X | X | X |
| SEQID-00316 | X | X | | |
| SEQID-00323 | X | X | | |
| SEQID-00338 | X | X | X | X |
| SEQID-00341 | X | X | X | X |
| SEQID-00343 | X | X | X | X |
| SEQID-00345 | X | X | X | X |
| SEQID-00346 | X | X | X | |
| SEQID-00352 | X | X | X | X |
| SEQID-00354 | X | X | X | X |
| SEQID-00356 | X | | | |
| SEQID-00357 | X | | X | X |
| SEQID-00485 | | X | X | |
| SEQID-00495 | X | X | X | |
| SEQID-00497 | | X | X | |
| SEQID-00502 | X | X | X | X |
| SEQID-00507 | | | X | |
| SEQID-00509 | X | | | |
| SEQID-00510 | X | X | X | X |
| SEQID-00511 | X | X | X | |
| SEQID-00515 | X | | | |
| SEQID-00518 | X | | | |
| SEQID-00521 | | X | X | |
| SEQID-00522 | X | X | X | X |
| SEQID-00525 | X | X | X | X |
| SEQID-00528 | | X | X | |
| SEQID-00529 | X | X | | |
| SEQID-00533 | | X | X | |
| SEQID-00537 | X | | X | |
| SEQID-00540 | X | X | X | |
| SEQID-00546 | X | X | | |
| SEQID-00547 | X | X | X | |
| SEQID-00553 | X | X | X | X |
| SEQID-00555 | | X | X | |
| SEQID-00559 | X | | | |
| SEQID-00560 | X | X | | X |
| SEQID-00564 | X | X | X | X |
| SEQID-00570 | X | X | X | |
| SEQID-00585 | X | X | X | X |
| SEQID-00587 | X | X | X | |
| SEQID-00592 | X | X | X | |
| SEQID-00598 | X | X | X | |
| SEQID-00601 | X | X | X | |
| SEQID-00603 | | | X | |
| SEQID-00605 | | X | X | X |
| SEQID-00606 | | X | X | |
| SEQID-00610 | | | X | |
| SEQID-00613 | X | X | X | |
| SEQID-00619 | X | | | |
| SEQID-00622 | | X | X | |
| SEQID-00623 | X | X | X | X |
| SEQID-00631 | X | X | X | |
| SEQID-00632 | X | X | X | X |
| SEQID-00633 | X | X | X | |
| SEQID-00641 | X | | | |
| SEQID-00647 | X | X | X | |
| SEQID-00648 | | | X | |

LC/MS/MS data identified a number of soluble polypeptides in each condition. The different conditions tested across the screen represent a number of different mechanisms of precipitation, and these different conditions were able to identify different sets of polypeptides based on their different physicochemical properties. Based on the number of polypeptides which remained soluble, of the conditions examined by LC/MS/MS, the harshest condition is the 2.5 M ammonium sulfate condition at room temperature. The polypeptides that were soluble in that condition were generally soluble in all three other conditions tested, with few exceptions. A large number of polypeptides were identified as being soluble after being heated to 95° C. for two minutes. In this experiment, a library of nutritive polypeptides was physically screened for solubility across a wide variety of conditions, and subsets of soluble peptides were identified within each condition.

Example 11

Selection of Amino Acid Sequences of Nutritive Polypeptides from Amino Acid Sequence Libraries Based on Solvation Scores and Aggregation Scores, and Other Sequence-Based Analyses Solvation Score.

The solvation score is a primary sequence-based metric for assessing the hydrophilicity and potential solubility of a given protein. It is defined as the total free energy of solvation (i.e. the free energy change associated with transfer from gas phase to a dilute solution) for all amino acid side chains, assuming each residue were solvated independently, normalized by the total number of residues in the sequence. The side chain solvation free energies were found computationally by calculating the electrostatic energy difference between a vacuum dielectric of 1 and a water dielectric of 80 (by solving the Poisson-Boltzmann equation) as well as the non-polar, Van der Waals energy using a linear solvent accessible surface area model (D. Sitkoff, K. A. Sharp, B. Honig. "Accurate Calculation of Hydration Free Energies Using Macroscopic Solvent Models". J. Phys. Chem. 98, 1994). These solvation free energies correlate well with experimental measurements. For amino acids with ionizable sidechains (Arg, Asp, Cys, Glu, His, Lys and Tyr), an average solvation free energy is based on the relative probabilities for each ionization state at the specified pH. The solvation score is effectively a measure of the solvation free energy assuming all polar residues are solvent exposed and non-polar residues are solvent excluded upon folding.

Aggregation Score.

The aggregation score is a primary sequence based metric for assessing the hydrophobicity and likelihood of aggregation of a given protein. Using the Kyte and Doolittle hydrophobity scale (Kyte J, Doolittle R F (May 1982). "A simple method for displaying the hydropathic character of a protein". J. Mol: Biol. 157 (1): 105-32), which gives hydrophobic residues positive values and hydrophilic residues negative values, the effective hydrophobicity as a function of sequence position is calculated using a moving average of 5 residues centered around each residue. The aggregation score is found by summing all those average hydrophobicity values greater than 0 and normalizing by the total length of the protein. The underlying understanding is that aggregation is the result of two or more hydrophobic patches coming together to exclude water and reduce surface exposure, and the likelihood that a protein will aggregate is a function of how densely packed its hydrophobic (i.e., aggregation prone) residues are.

Charge Content.

The absolute or net charge per amino acid is calculated as a function of pH and independently of the location of the residue within the protein. Given a pH value and the pKa of a titratable residue, the Henderson-Hasselbalch equation is solved to determine the relative concentrations of each titration state (e.g. −1 or 0 for the acidic residue glutamate).

$$pH = pK_a + \log_{10}(([A^-])/([HA]))$$

The Henderson-Hasselbalch Equation

The average charge for that titratable residue is found by converting these relative concentrations into effective probabilities of being charged and multiplying by the charge and number of instances of that amino acid. The net or absolute charge found from this procedure is then divided by the number of amino acids to get the per amino acid value.

The residue types shown below in Table E11A are used with the corresponding pKa values and relevant titration states. These pKa values come from the pKa table provided in the European Molecular Biology Open Software Suite (Rice, P. Longden, I. and Bleasby, A. EMBOSS: The European Molecular Biology Open Software Suite. Trends in Genetics, 16, 2000).

TABLE E11A

| Residue | pKa | Titration States |
|---|---|---|
| Glutamate | −4.1 | −1, 0 |
| Aspartate | −3.9 | −1, 0 |
| Arginine | −12.5 | 0, +1 |
| Lysine | −10.8 | 0, +1 |
| Histidine | −6.5 | 0, +1 |
| Cysteine | −8.5 | −1, 0 |
| Tyrosine | −10.1 | −1, 0 |
| C-terminus | −3.6 | −1, 0 |
| N-terminus | −8.6 | 0, +1 |

Weighted Euclidean Distance.

To identify candidate proteins with a similar amino acid breakdown to a known, clinically efficacious blend, a weighted Euclidean distance based search strategy is used. In principle, this means computing the weighted percent differences for each amino acid relative to the target amino acid distribution, as defined by the following equation:

$$\text{Distance} = \sqrt{\left(\Sigma(i \in AA)\left[\alpha_i(x_i - x_i^T)^2\right]\right)}$$

where AA is the set of all amino acids in the target distribution, $x_i$ is the fraction by weight of amino acid i in the candidate protein sequence, $x_i^T$ is the fraction by weight of amino acid i in the target amino acid distribution, and $\alpha_i$ is the relative weight associated with amino acid i. The relative weights were applied to ensure that large deviations from the most important amino acid targets were appropriately penalized.

As an example, for treatment of sarcopenia, support of exercise, and stimulation of thermogenesis amino acid blends (given the relative importance of Leucine and the other two branched chain amino acids, Isoleucine and Valine) relative weights of 3:2:2 for Leucine, Valine, and Isoleucine were used. All other amino acids were given a relative weight of 1.

Allergenicity.

The allergenicity score is a primary sequence based metric based on WHO recommendations (fao.org/ag/agn/food/pdf/allergygm.pdf) for assessing how similar a protein is to any known allergen, the primary understanding being that high percent identity between a target and a known allergen is likely indicative of cross reactivity. For a given protein, the likelihood of eliciting an allergic response is assessed via a complimentary pair of sequence homology based tests. The first test determines the protein's percent identity across the entire sequence via a global-local sequence alignment to a database of known allergens using the FASTA algorithm with the BLOSUM50 substitution matrix, a gap open penalty of 10, and a gap extension penalty of 2. It is suggested that proteins with less than 50% global homology across both sequence's are unlikely to be allergenic (Goodman R. E. et al. Allergenicity assessment of genetically modified crops—what makes sense? Nat. Biotech. 26, 73-81 (2008); Aalberse R. C. Structural biology of allergens. J. Allergy Clin. Immunol. 106, 228-238 (2000).).The second test assesses the local allergenicity along the protein sequence by determining the local allergenicity of all possible contiguous 80 amino acid fragments via a global-local sequence alignment of each fragment to a database of known allergens using the FASTA algorithm with the BLOSUM50 substitution matrix, a gap open penalty of 10, and a gap extension penalty of 2. The highest percent identity of any 80 amino acid window with any allergen is taken as the final score for the protein of interest. The WHO guidelines suggest using a 35% identity cutoff. The custom database comprises pooled allergen lists collected by the Food Allergy Research and Resource Program (allergenonline.org/), UN IPROT annotations (uniprot.org/docs/allergen), and the Structural Database of Allergenic Proteins (SDAP, fermi.utmb.edu/SDAP/sdap_lnk.html). This database includes all currently recognized allergens by the International Union of Immunological Socicities (IUIS, allergen.org/) as well as a large number of additional allergens not yet officially named.

Toxicity/Nonallergenicity/Antinutricity.

The toxicity, nonallergenicity, and anti-nutricity of a protein are all assessed similarly, by determining the protein's percent identity to databases of known toxic, nonallergenic, and protease inhibitory proteins, respectively. The toxicity and anti-nutritive qualities are assumed to be a function of the whole protein (i.e., a fragment of a known toxic protein will not be toxic), as their toxic and inhibitory mechanisms of action are often structural in nature (Huntington J, Read R, Carrell R. "Structure of a serpin-protease complex shows inhibition by deformation". Nature 407 (2000): 923-6; Van den Born H. K. et al. Theoretical analysis of the structure of the peptide fasciculin and its docking to acetylcholinesterase. Protein Sci. 4 (1995): 703-715.; and Harel M. Crystal structure of an acetylcholinesterase-fasciculin complex: interaction of a three-fingered toxin from snake venom with its target. Structure. 3 (1995): 1355-1366.). Given that protein structure is a function of the entire protein sequence, a global-global alignment is performed of the protein of interest against the two respective databases using the FASTA algorithm with the BLOSUM50 substitution matrix, a gap open penalty of 10, and a gap extension penalty of 2. A cut off of 35% can be used. While it does not provide specific instructions of how to avoid toxic/antinutritive polypeptides, reference Delaney B. et al. Evaluation of protein safety in the context of agricultural biotechnology. Food. Chem. Toxicol. 46 (2008: S71-S97 suggests that one should avoid both known toxic and antinutritive polypeptides when assessing the safety of a possible food protein.

The nonallergenicity of a protein is related to its likelihood of eliciting an allergenic response upon exposure (similar to but opposite of allergenicity). Specifically, the human immune system is exposed to a multitude of possible allergenic proteins on a regular basis, and has the intrinsic ability to determine self from non-self. The exact nature of this ability is not always clear, and there are many diseases that arise as a result of the failure of the body to differentiate self from non-self (e.g. arthritis). Nonetheless, the understanding is that proteins that look (i.e. share a large degree of sequence homology to) a lot like nonallergenic (i.e., human) proteins are less likely to elicit an immune response. In particular, it has been shown that for some protein families with known allergenic members (tropomyosins, parvalbumins, caseins), those proteins that bear more sequence homology to their human counterparts relative to known allergenic proteins, are not thought to be allergenic (Jenkins J. A. et al. Evolutionary distance from human homologs reflects allergenicity of animal food proteins. J. Allergy Clin Immunol. 120 (2007): 1399-1405.) For a given protein, the nonallergenicity score is measured by determining the maximum percent identity of the protein to a database of human proteins from a global-local alignment using the FASTA algorithm with the BLOSUM50 substitution matrix, a gap open penalty of 10, and a gap extension penalty of 2. Cutoffs can vary. For example, Jenkins J. A. et al. (Evolutionary distance from human homologs reflects allergenicity of animal food proteins. J. Allergy Clin Immunol. 120 (2007): 1399-1405) claim that proteins with a sequence identity to a human protein above ~62% are less likely to be allergenic.

Example 12

Expression of Nutritive Polypeptides

The lists below include all the nutritive protein sequences that were expressed in *Escherichia coli, Bacillus, Aspergillus niger*, and mammalian cells. In *E. coli*, the proteins were detected in either whole cell lysates or in the soluble fraction of the cell lysate. In *Bacillus*, expression was detected in either cell lysates or secreted supernatants of *Bacillus subtilis* or *Bacillus megaterium*. In *Aspergillus niger*, proteins were secreted from the fungus and detected in the supernatant. For proteins expressed in mammalian cells, they were expressed in either in Chinese Hamster Ovarian-S strain (CHO-S) or Human Embryonic Kidney 293F strain (HEK293F). Expression was measured by the following metrics: mass spectrometry spectrum counts for protein expression data acquired from LC-MS/MS in pooled library, SDS-PAGE, Chip Electrophoresis, dot blot, Western blot and ELISA for individual protein expression as described above.

The following nutritive polypeptides were detected in either whole cell lysates or in the soluble fraction of the cell lysates of *Escherichia coli*: SEQID-00001, SEQID-00002, SEQID-00003, SEQID-00004, SEQID-00005, SEQID-00007, SEQID-00008, SEQID-00009, SEQID-00011, SEQID-00012, SEQID-00013, SEQID-00014, SEQID-00015, SEQID-00016, SEQID-00020, SEQID-00021, SEQID-00024, SEQID-00025, SEQID-00027, SEQID-00028, SEQID-00029, SEQID-00030, SEQID-00031, SEQID-00033, SEQID-00043, SEQID-00049, SEQID-00051, SEQID-00052, SEQID-00053, SEQID-00054, SEQID-00055, SEQID-00057, SEQID-00059, SEQID-00060, SEQID-00061, SEQID-00068, SEQID-00070, SEQID-00071, SEQID-00073, SEQID-00074, SEQID-00075, SEQID-00076, SEQID-00077, SEQID-00078, SEQID-00083, SEQID-00084, SEQID-00085, SEQID-00086, SEQID-00087, SEQID-00088, SEQID-00090, SEQID-00091, SEQID-00092, SEQID-00093, SEQID-00098, SEQID-00099, SEQID-00100, SEQID-00101, SEQID-00102, SEQID-00103, SEQID-00104, SEQID-00105, SEQID-00106, SEQID-00107, SEQID-00108, SEQID-00110, SEQID-00112, SEQID-00113, SEQID-00115, SEQID-00116, SEQID-00117, SEQID-00118, SEQID-00123, SEQID-00124, SEQID-00128, SEQID-00130, SEQID-00131, SEQID-00132, SEQID-00134, SEQID-00137, SEQID-00139, SEQID-00140, SEQID-00141, SEQID-00142, SEQID-00143, SEQID-00145, SEQID-00146, SEQID-00148, SEQID-00150, SEQID-00151, SEQID-00152, SEQID-00153, SEQID-00154, SEQID-00155, SEQID-00157, SEQID-00158, SEQID-00159, SEQID-00162, SEQID-00166, SEQID-00169, SEQID-00175, SEQID-00193, SEQID-00194, SEQID-00195, SEQID-00196, SEQID-00197, SEQID-00198, SEQID-00199, SEQID-00200, SEQID-00201, SEQID-00202, SEQID-00203, SEQID-00204, SEQID-00205, SEQID-00211, SEQID-00212, SEQID-00213, SEQID-00214, SEQID-00215, SEQID-00216, SEQID-00218, SEQID-00219, SEQID-00220, SEQID-00221, SEQID-00223, SEQID-00224, SEQID-00225, SEQID-00226, SEQID-00227, SEQID-00228, SEQID-00230, SEQID-00232, SEQID-00233, SEQID-00234, SEQID-00235, SEQID-00236, SEQID-00237, SEQID-00239, SEQID-00240, SEQID-00241, SEQID-00264, SEQID-00265, SEQID-00266, SEQID-00267, SEQID-00268, SEQID-00269, SEQID-00270, SEQID-00271, SEQID-00273, SEQID-00274, SEQID-00275, SEQID-00276, SEQID-00284, SEQID-00287, SEQID-00297, SEQID-00298, SEQID-00299, SEQID-00302, SEQID-00303, SEQID-00304, SEQID-00305, SEQID-00306, SEQID-00307, SEQID-00309, SEQID-00318, SEQID-00322, SEQID-00325, SEQID-00326, SEQID-00327, SEQID-00328, SEQID-00329, SEQID-00332, SEQID-00335, SEQID-00336, SEQID-00337, SEQID-00338, SEQID-00341, SEQID-00343, SEQID-00344, SEQID-00345, SEQID-00346, SEQID-00349, SEQID-00350, SEQID-00352, SEQID-00353, SEQID-00354, SEQID-00355, SEQID-00356, SEQID-00357, SEQID-00358, SEQID-00359, SEQID-00360, SEQID-00362, SEQID-00363, SEQID-00408, SEQID-00409, SEQID-00415, SEQID-00416, SEQID-00418, SEQID-00424, SEQID-00481, SEQID-00482, SEQID-00483, SEQID-00484, SEQID-00485, SEQID-00486, SEQID-00487, SEQID-00488, SEQID-00489, SEQID-00490, SEQID-00491, SEQID-00492, SEQID-00493, SEQID-00494, SEQID-00495, SEQID-00496, SEQID-00497, SEQID-00498, SEQID-00499, SEQID-00500, SEQID-00501, SEQID-00502, SEQID-00503, SEQID-00504, SEQID-00505, SEQID-00506, SEQID-00507, SEQID-00508, SEQID-00509, SEQID-00510, SEQID-00511, SEQID-00512, SEQID-00513, SEQID-00514, SEQID-00515, SEQID-00516, SEQID-00517, SEQID-00518, SEQID-00519, SEQID-00520, SEQID-00521, SEQID-00522, SEQID-00523, SEQID-00524, SEQID-00525, SEQID-00526, SEQID-00527, SEQID-00528, SEQID-00529, SEQID-00530, SEQID-00531, SEQID-00532, SEQID-00533, SEQID-00534, SEQID-00535, SEQID-00536, SEQID-00537, SEQID-00538, SEQID-00539, SEQID-00540, SEQID-00541, SEQID-00542, SEQID-00543, SEQID-00544, SEQID-00545, SEQID-00546, SEQID-00547, SEQID-00548, SEQID-00549, SEQID-00550, SEQID-00551, SEQID-00552, SEQID-00553, SEQID-00554, SEQID-00555, SEQID-00556, SEQID-00557, SEQID-00558, SEQID-00559, SEQID-00560, SEQID-00561, SEQID-00562, SEQID-00563, SEQID-00564, SEQID-00565, SEQID-00566, SEQID-00567, SEQID-00568, SEQID-00569, SEQID-00570, SEQID-00571, SEQID-00572, SEQID-00573, SEQID-00574, SEQID-00575, SEQID-00576, SEQID-00577, SEQID-00578, SEQID-00579, SEQID-00580, SEQID-00581, SEQID-00582, SEQID-00583, SEQID-00584, SEQID-00585, SEQID-00586, SEQID-00587, SEQID-00588, SEQID-00589, SEQID-00590, SEQID-00591, SEQID-00592, SEQID-00593, SEQID- 00594, SEQID-00595, SEQID-00596, SEQID-00597, SEQID-00598, SEQID-00599, SEQID-00600, SEQID-00601, SEQID-00602, SEQID-00603, SEQID-00604, SEQID-00605, SEQID-00606, SEQID-00607, SEQID-00608, SEQID-00609, SEQID-00610, SEQID-00611, SEQID-00612, SEQID-00613, SEQID-00614, SEQID-00615, SEQID-00616, SEQID-00617, SEQID-00618, SEQID-00619, SEQID-00620, SEQID-00621, SEQID-00622, SEQID-00623, SEQID-00624, SEQID-00625, SEQID-00626, SEQID-00627, SEQID-00628, SEQID-00629, SEQID-00630, SEQID-00631, SEQID-00632, SEQID-00633, SEQID-00634, SEQID-00635, SEQID-00636, SEQID-00637, SEQID-00638, SEQID-00639, SEQID-00640, SEQID-00641, SEQID-00642, SEQID-00643, SEQID-00644, SEQID-00645, SEQID-00646, SEQID-00647, SEQID-00648, SEQID-00669, SEQID-00670, SEQID-00671, SEQID-00672, SEQID-00673, SEQID-00674, SEQID-00675, SEQID-00676, SEQID-00677, SEQID-00678, SEQID-00679, SEQID-00680, SEQID-00681, SEQID-00682, SEQID-00716, SEQID-00717, SEQID-00718, SEQID-00719, SEQID-00720, SEQID-00723, SEQID-00724, SEQID-00725, SEQID-00726, SEQID-00727, SEQID-00728, SEQID-00729, SEQID-00730, SEQID-00731, SEQID-00732, SEQID-00734, SEQID-00735, SEQID-00736, SEQID-00737, SEQID-00738, SEQID-00739, SEQID-00740, SEQID-00741, SEQID-00742, SEQID-00743, SEQID-00744, SEQID-00745, SEQID-00746, SEQID-00747, SEQID-00748, SEQID-00749, SEQID-00750, SEQID-00751, SEQID-00752, SEQID-00753, SEQID-00754, SEQID-00755, SEQID-00756, SEQID-00757, SEQID-00758, SEQID-00759, SEQID-00760, SEQID-00761, SEQID-00763, SEQID-00765, SEQID-00766, SEQID-00767, SEQID-00768, SEQID-00769, SEQID-00770, SEQID-00771, SEQID-00772, SEQID-00773, SEQID-00774, SEQID-00775, SEQID-00777, SEQID-00778, SEQID-00780, SEQID-00781, SEQID-00782, SEQID-00783, SEQID-00784, SEQID-00785, SEQID-00786, SEQID-00787, SEQID-00788, SEQID-00789, SEQID-00790, SEQID-00791, SEQID-00792, SEQID-00793, SEQID-00794, SEQID-00795, SEQID-00796, SEQID-00797, SEQID-00798, SEQID-00799, SEQID-00801, SEQID-00802, SEQID-00803, SEQID-00804, SEQID-00805, SEQID-00806, SEQID-00807, SEQID-00808, SEQID-00809, SEQID-00810, SEQID-00811, SEQID-00812, SEQID-00813, SEQID-00814, SEQID-00815, SEQID-00816, SEQID-00817, SEQID-00818, SEQID-00819, SEQID-00820, SEQID-00821, SEQID-00822, SEQID-00823, SEQID-00824, SEQID-00825, SEQID-00826, SEQID-00827, SEQID-00828, SEQID-00829, SEQID-00830, SEQID-00831, SEQID-00832, SEQID-00833, SEQID-00834, SEQID-00835, SEQID-00836, SEQID-00837.

The following nutritive polypeptides were detected in either cell lysates or secreted supernatants of *Bacillus subtilis* or *Bacillus megaterium*: SEQID-00003, SEQID-00004, SEQID-00005, SEQID-00087, SEQID-00099, SEQID-00102, SEQID-00103, SEQID-00105, SEQID-00115, SEQID-00218, SEQID-00220, SEQID-00223, SEQID-00226, SEQID-00236, SEQID-00240, SEQID-00267, SEQID-00271, SEQID-00276, SEQID-00297, SEQID-00298, SEQID-00299, SEQID-00302, SEQID-00303, SEQID-00304, SEQID-00305, SEQID-00306, SEQID-00307, SEQID-00309, SEQID-00318, SEQID-00322, SEQID-00325, SEQID-00326, SEQID-00327, SEQID-00328, SEQID-00329, SEQID-00330, SEQID-00332, SEQID-00335, SEQID-00336, SEQID-00337, SEQID-00338, SEQID-00340, SEQID-00341, SEQID-00343, SEQID-00344, SEQID-00345, SEQID-00346, SEQID-00349, SEQID-00350, SEQID-00352, SEQID-00353, SEQID-00354, SEQID-00355, SEQID-00356, SEQID-00357, SEQID-00358, SEQID-00359, SEQID-00360, SEQID-00361, SEQID-00362; SEQID-00363, SEQID-00374, SEQID-00389, SEQID-00398, SEQID-00403, SEQID-00404, SEQID-00405, SEQID-00407, SEQID-00409, SEQID-00415, SEQID-00416, SEQID-00417, SEQID-00418, SEQID-00419, SEQID-00420, SEQID-00421, SEQID-00424, SEQID-00481, SEQID-00482, SEQID-00483, SEQID-00484, SEQID-00485, SEQID-00486, SEQID-00487, SEQID-00488, SEQID-00489, SEQID-00490, SEQID-00491, SEQID-00492, SEQID-00493, SEQID-00494, SEQID-00495, SEQID-00496, SEQID-00497, SEQID-00498, SEQID-00499, SEQID-00500, SEQID-00501, SEQID-00502, SEQID-00503, SEQID-00504, SEQID-00505, SEQID-00506, SEQID-00507, SEQID-00508, SEQID-00509, SEQID-00510, SEQID-00511, SEQID-00512, SEQID-00513, SEQID-00514, SEQID-00515, SEQID-00516, SEQID-00517, SEQID-00518, SEQID-00519, SEQID-00520, SEQID-00521, SEQID-00522, SEQID-00523, SEQID-00524, SEQID-00525, SEQID-00526, SEQID-00527, SEQID-00528, SEQID-00529, SEQID-00530, SEQID-00531, SEQID-00532, SEQID-00533, SEQID-00534, SEQID-00535, SEQID-00536, SEQID-00537, SEQID-00538, SEQID-00539, SEQID-00540, SEQID-00541, SEQID-00542, SEQID-00543, SEQID-00544, SEQID-00545, SEQID-00546, SEQID-00547, SEQID-00548, SEQID-00549, SEQID-00550, SEQID-00551, SEQID-00552, SEQID-00553, SEQID-00554, SEQID-00555, SEQID-00556, SEQID-00557, SEQID-00558, SEQID-00559, SEQID-00560, SEQID-00561, SEQID-00562, SEQID-00563, SEQID-00564, SEQID-00565, SEQID-00566, SEQID-00567, SEQID-00568, SEQID-00569, SEQID-00570, SEQID-00571, SEQID-00572, SEQID-00573, SEQID-00574, SEQID-00575, SEQID-00576, SEQID-00577, SEQID-00578, SEQID-00579, SEQID-00580, SEQID-00581, SEQID-00582, SEQID-00583, SEQID-00584, SEQID-00585, SEQID-00586, SEQID-00587, SEQID-00588, SEQID-00589, SEQID-00590, SEQID-00591, SEQID-00592, SEQID-00593, SEQID-00594, SEQID-00595, SEQID-00596, SEQID-00597, SEQID-00598, SEQID-00599, SEQID-00600, SEQID-00601, SEQID-00602, SEQID-00603, SEQID-00604, SEQID-00605, SEQID-00606, SEQID-00607, SEQID-00608, SEQID-00609, SEQID-00610, SEQID-00611, SEQID-00612, SEQID-00613, SEQID-00614, SEQID-00615, SEQID-00616, SEQID-00617, SEQID-00618, SEQID-00619, SEQID-00620, SEQID-00621, SEQID-00622, SEQID-00623, SEQID-00624, SEQID-00625, SEQID-00626, SEQID-00627, SEQID-00628, SEQID-00629, SEQID-00630, SEQID-00631, SEQID-00632, SEQID-00633, SEQID-00634, SEQID-00635, SEQID-00636, SEQID-00637, SEQID-00638, SEQID-00639, SEQID-00640, SEQID-00641, SEQID-00642, SEQID-00643, SEQID-00644, SEQID-00645, SEQID-00646, SEQID-00647, SEQID-00648, SEQID-00653, SEQID-00654, SEQID-00655, SEQID-00656, SEQID-00657, SEQID-00659, SEQID-00660, SEQID-00664, SEQID-00668, SEQID-00670, SEQID-00671, SEQID-00672, SEQID-00673, SEQID-00674, SEQID-00675, SEQID-00676, SEQID-00678, SEQID-00679, SEQID-00680, SEQID-00681, SEQID-00682, SEQID-00690, SEQID-00710, SEQID-00711, SEQID-00712, SEQID-00713, SEQID-00714, SEQID-00715, SEQID-00716, SEQID-00717, SEQID-00718, SEQID-00719, SEQID-00720, SEQID-00723, SEQID-00724, SEQID-00725, SEQID-00726, SEQID-00727, SEQID-00728, SEQID-00729, SEQID-00730, SEQID-00731, SEQID-00734, SEQID-00735, SEQID-00736, SEQID-00737, SEQID-00738, SEQID-00739, SEQID-00740, SEQID-00741, SEQID-00742, SEQID-00743, SEQID-00744, SEQID-00745, SEQID-00746, SEQID-00747, SEQID-00748, SEQID-00749, SEQID-00750, SEQID-00751, SEQID-00752, SEQID-00753, SEQID-00754, SEQID-00755, SEQID-00756, SEQID-00757, SEQID-00758, SEQID-00759, SEQID-00760, SEQID-00761, SEQID-00763, SEQID-00765, SEQID-00766, SEQID-00767, SEQID-00768, SEQID-00769, SEQID-00770, SEQID-00771, SEQID-00772, SEQID-00773, SEQID-00774, SEQID-00775, SEQID-00777, SEQID-00778, SEQID-00780, SEQID-00781, SEQID-00782, SEQID-00783, SEQID-00784, SEQID-00785, SEQID-00786, SEQID-00787, SEQID-00788, SEQID-00789, SEQID-00790, SEQID-00791, SEQID-00792, SEQID-00793, SEQID-00794, SEQID-00795, SEQID-00796, SEQID-00797, SEQID-00798, SEQID-00799, SEQID-00800, SEQID-00801, SEQID-00802, SEQID-00803, SEQID-00804, SEQID-00805, SEQID-00806, SEQID-00807, SEQID-00808, SEQID-00809, SEQID-00810, SEQID-00811, SEQID-00812, SEQID-00813, SEQID-00814, SEQID-00815, SEQID-00816, SEQID-00817, SEQID-00818, SEQID-00819, SEQID-00820, SEQID-00821, SEQID-00822, SEQID-00823, SEQID-00824, SEQID-00825, SEQID-00826, SEQID-00827, SEQID-00828, SEQID-00829, SEQID-00830, SEQID-00831, SEQID-00832, SEQID-00833, SEQID-00834, SEQID-00835, SEQID-00836, SEQID-00837.

The following nutritive polypeptides were detected from the secreted supernatant of *Aspergillus niger*: SEQID-00087, SEQID-00103, SEQID-00105, SEQID-00112, SEQID-00115, SEQID-00218, SEQID-00298, SEQID-00341, SEQID-00352, SEQID-00354, SEQID-00363, SEQID-00406, SEQID-00409, SEQID-00415, SEQID-00416, SEQID-00417, SEQID-00418, SEQID-00419, SEQID-00420, SEQID-00421, SEQID-00424, SEQID-00552, SEQID-00554.

The following nutritive polypeptides were expressed in the mammalian cell lines Chinese Hamster Ovarian-S strain (CHO-S) or Human Embryonic Kidney 293F strain (HEK293F): SEQID-00001, SEQID-00103, SEQID-00105, SEQID-00298.

Example 13

Expression of Nutritive Polypeptides in *E. coli* Bacteria

A nutritive polypeptide sequence library was generated from edible species and screened to demonstrate nutritive polypeptide expression in *E. coli*.

Gene Synthesis & Plasmid Construction.

All genes were made synthetically by either Life Technologies/GeneArt or DNA2.0, and optimized for expression in *Escherichia coli*. The genes were cloned into pET15b (EMD Millipore/Novagen) using the NdeI-BamHI restriction sites within the multiple cloning site (therefore containing an amino-terminal MGSSHHHHHHSSGLVPRGSH tag), or cloned into the NcoI-BamHI sites (therefore removing the amino terminal tag on the plasmid) using primers to include an amino terminal tag containing MGSHHHHHHHH or MGSHHHHHHHHSENLYFQG. pET15b contains a pBR322 origin of replication, a lac-controlled T7 promoter, and a bla gene conferring resistance to carbenicillin. For manually cloned fragments, inserts were verified by Sanger sequencing using both the T7 promoter primer and the T7 terminator primer. For the secreted constructs, the genes were cloned into pJ444 vector (DNA 2.0, USA) upstream of T5 terminator with C-terminal HHHHHHHH tag and DsbA signal peptide (ATGAAAAAGATTTGGCTGGCGCTGGCTGGTTTAGTTTAGCGTTTAGCGCATCGG CG) in N-terminal.

Strain Construction.

T7 Express Competent *E. coli* was purchased from New England Biolabs and was used as the parent strain. T7 Express is an enhanced BL21 derivative which contains the T7 RNA polymerase in the lac operon, while still lacking the Lon and OmpT proteases. The genoptype of T7 Express is: fhuA2 lacZ::T7 gene1 [lon] ompT gal sulA11 R(mcr-73::miniTn10-TetS)2 [dcm] R(zgb-210::Tn10-TetS) endA1 Δ(mcrC-mrr)114::IS10. For secreted constructs, CGSC 5610 (Yale *E. coli* genetic stock center, USA) was used for the study. The genotype of CGSC 5610 is F-, lacY1 or Δ(cod-lacI)6, glnV44(AS), galK2(Oc), galT22, λ-, e14-, mcrA0, rfbC1, metB1, mcrB1, hsdR2. Roughly 1 ng of purified plasmid DNA described above was used to transform chemically competent T7 Express and single colonies were selected on LB agar plates containing 100 mg/l carbenicillin after roughly 16 hr of incubation at 37° C. Single colonies were inoculated into liquid LB containing 100 mg/l carbenicillin and grown to a cell-density of OD600 nm 0.6, at which point, glycerol was supplemented to the medium at 10% (v/v) and an aliquot was taken for storage in a cryovial at −80° C.

Expression Testing. Expression cultures were grown in LB medium (10 g/l NaCl, 10 g/l tryptone, and 5 g/l yeast extract) or in BioSilta EnBase medium and induced with isopropyl β-D-1-thiogalactopyranoside (IPTG). For expression testing in LB media, a colony or stab from a glycerol stock was inoculated into 3 ml LB supplemented with 100 mg/l carbenicillin and grown overnight (roughly 16 hr) at 37° C. and 250 rpm. The next morning, the cell-density (spectrophotometrically at OD600 nm) was measured and diluted back to OD600 nm=0.05 into 3 ml LB medium supplemented with carbenicillin and grown at 37° C. and 250 rpm. At OD600 nm≈0.8±0.2 the cultures were induced with 1 mM IPTG. Heterologous expression was allowed to proceed for 2 hr at 37° C. and 250 rpm, at which point the cultures were terminated. The terminal cell-density was measured. For expression with Enbase media, a colony or stab from a glycerol stock was inoculated into 3 ml LB with 100 mg/l carbenicillin and transferred to Enbase media with 100 mg/l carbenicillin and 600 mU/l of glucoamylase at OD600 and grown overnight at 37° C. and 250 rpm and induced with 1 mM IPTG next day. Heterologous expression was allowed for 24 hours at 37° C. and 250 rpm, at which point the cultures were terminated. The terminal cell-density was measured and the cells were harvested by centrifugation (3000 rpm, 10 min, RT). To determine intracellular production the cells were lyzed with B-PER (Pierce) according to manufacturer's protocol and then assayed to measure protein of interest (POI). To determine the levels of secreted protein, 0.5-ml aliquots of the culture supernatants were filtered by a 0.22 μm filter. The filtrates were then assayed to determine the levels of secreted protein of interest (POI).

Fermentation.

The intracellular soluble proteins SEQID-00105, SEQID-00240, SEQID-00338, SEQID-00341, SEQID-00352, SEQID-00363, SEQID-00423, SEQID-00424, SEQID-00425, SEQID-00426, SEQID-00429, SEQID-00559, and SEQID-00587 were expressed in *E. coli* host cells NEB T7 Express (New England BioLabs) in 20 and/or 250 L fermentations. The fermentation occurred in a carbon and nitrogen rich media containing: Yeast Extract, Soy Hydrolysate, Glycerol, Glucose, and Lactose. The fermentation occurred at 30° C. and induction occurred when the Glucose present in the media was exhausted and Lactose became the primary carbon source sugar. The fermentation process time generally lasted 24-26 hrs. Fermentation run parameters were controlled at a pH of 6.9, temperature of 30° C., and a percent dissolved oxygen of 35%. The culture was supplemented with a Glycerol based feed in the later stages of the culture duration. Harvest occurred when the cells entered stationary phase and no longer required oxygen supplementation to maintain the 35% set point.

Nutritive Polypeptide Library Gene Synthesis & Plasmid Construction.

Genes encoding for 168 different edible species polypeptide sequences were generated as linear fragments and codon-selected for expression in *Escherichia coli*. In some cases, a single linear fragment contained two or more nucleic acid sequences encoding two or more distinct polypeptide sequences that had a flanking 5' NdeI restriction site and 3' BamHI restriction site. All linear fragments were combined at equal molar concentrations. The linear fragments were digested with NdeI and BamHI and the digested mixture was cloned into pET15b (EMD Millipore/Novagen) using primers to include an amino terminal tag containing MGSHHHHHHHH and NdeI-BamHI restriction sites. pET15b contains a pBR322 origin of replication, a lac-controlled T7 promoter, and a bla gene conferring resistance to carbenicillin. For cloned fragments, inserts were verified by Sanger sequencing using both the T7 promoter primer and the T7 terminator primer.

168 Nutritive Polypeptide Library Strain Construction.

T7 Express Competent *E. coli* (New England Biolabs) was used as the parent strain. T7 Express is an enhanced BL21 derivative which contains the T7 RNA polymerase in the lac operon, while lacking the Lon and OmpT proteases. The genotype of T7 Express is: fhuA2 lacZ::T7 gene1 [lon] ompT gal sulA11 R(mcr-73::miniTn10-TetS)2 [dcm] R(zgb-210::Tn10-TetS) endA1 Δ(merC-mrr)114::IS10. For secreted constructs, CGSC 5610 (Yale *E. coli* genetic stock center, USA) was used. The genotype of CGSC 5610 is F-, lacY1 or Δ(cod-lacI) 6, glnV44(AS), galK2(Oc), galT22, λ-, e14-, mcrA0, rfbC1, metB1, mcrB1, hsdR2. Approximately 10 ng of ligated DNA mixture were transformed into chemically competent T7 Express and single colonies were selected on LB agar plates containing 100 mg/l carbenicillin after roughly 16 hr of incubation at 37° C. Multiple transformations were done and approximately 1000 colonies were pooled together and suspended into LB medium. The DNA from 50-100 colonies was sequenced to determine the diversity of the generated library.

168 Nutritive Polypeptide Library Expression Testing.

The colony mixtures resuspended in LB medium were initially grown in 3 ml of LB medium (10 g/l NaCl, 10 g/l tryptone, and 5 g/l yeast extract) with 100 mg/l carbenicillin, then transferred to BioSilta Enbase media with 100 mg/l carbenicillin and 600 mU/l of glucoamylase at OD600=0.1, grown overnight at 37° C. and 250 rpm and induced with 1 mM IPTG next day. Heterologous expression was allowed for 24 hours at 37° C. and 250 rpm, at which point the cultures were terminated. The terminal cell-density was measured and the cells were harvested by centrifugation (3000 rpm; 10 min, RT). To determine intracellular production the cells were lysed using a microfluidizer and the soluble fraction was purified in 5 ml Nickel Affinity column according to manufacturer's protocol and then assayed using LC-MS/MS to identify the proteins that were expressed as described below. 114/168 different proteins were successfully solubly expressed in *E. coli* based on MS spectral count. Based on this result, certain genes were individually cloned and tested for intracellular soluble expression in *E. coli*.

Fungal Nutritive Polypeptides Expressed in *E. coli* Strain Backgrounds

Four strains were used to express fungal nutritive polypeptides: T7 Express, Shuffle T7, and Shuffle T7 Express from New England Biolabs; and Origami B(DE3) from EMD Millipore.

T7 Express is an enhanced BL21 derivative which contains the T7 RNA polymerase in the lac operon, while lacking the Lon and OmpT proteases. The genotype of T7 Express is: fhuA2 lacZ::T7 gene1 [lon] ompT gal sulA11 R(mcr-73::miniTn10-TetS)2 [dcm] R(zgb-210::Tn10-TetS) endA1 Δ(mcrC-mrr)114::IS10.

Shuffle T7 is a K12 derivative strain that promotes cytoplasmic disulfide bond formation and expresses a chromosomal copy of T7 RNAP. The genotype of Shuffle T7 is F⁻ lac, pro, lacIQ/Δ(ara-leu)7697 araD139 fhuA2 lacZ::T7 gene1 Δ(phoA)PvuII phoR ahpC* galE (or U) galK λatt::pNEB3-r1-cDsbC (SpecR, lacIq) ΔtrxB rpsL150(StrR) Δgor Δ(malF)3.

Shuffle T7 Express is a BL21 derivative strain that promotes cytoplasmic disulfide bond formation and expresses a chromosomal copy of T7 RNAP. The genotype of Shuffle T7 Express is fhuA2 lacZ::T7 gene1 [lon] ompT ahpC gal λatt::pNEB3-r1-cDsbC (SpecR, lacIq) ΔtrxB sulA11 R(mcr-73::miniTn10-TetS)2 [dcm] R(zgb-210::Tn10-TetS) endA1 Δgor Δ(mcrC-mrr)114::IS10.

Origami B(DE3) is a BL21 derivative that contains mutations in trxB and gor that promote disulfide bond formation in the cytoplasm. The genotype of Origami B(DE3) is F-ompT hsdSB(rB-mB-) gal dcm lacY1 ahpC (DE3) gor522:: Tn10 trxB (KanR, TetR)

Expression screening of these strains was completed as described for *E. coli*.

Example 14

Expression of Nutritive Polypeptides in *B. subtilis* Bacteria

Gene Synthesis & Plasmid Construction.

All of the genes encoding proteins of interest (POI) were cloned by PCR. The templates for PCR amplification of these genes were either synthetic genes, generated for expression in *E. coli* (see above), or genomic DNA from a source organism (e.g. *B. subtilis*). Synthetic genes were codon optimized for expression in *E. coli*. All of the genes were cloned with a sequence encoding a 1×FLAG tag (a.a.=DYKDDDK) fused, in frame, to their 3'-terminus immediately preceding the stop codon. For expression in *B. subtilis*, genes were cloned in the MoBiTec (Göttingen, Germany) expression vector, pHT43, using the Gibson Assembly Master Mix (New England Biolabs, Beverly, Mass.) and the cloning host *E. coli* Turbo (New England Biolabs) according to manufacturer's instructions. The genes were cloned into pHT43 either as secretion expression constructs (gene fused in-frame with DNA encoding the α-amylase signal peptide (SamyQ) from *Bacillus amyloliquefaciens*) or as an intracellular expression constructs (gene inserted immediately downstream of the ribosomal binding site (RBS), removing the SamyQ sequence). Following transformation into *E. coli*, cells containing recombinant plasmids were selected on LB agar plates containing 100 µg/ml carbenicillin (Cb100). Recombinant plasmids were isolated from *E. coli* and their DNA sequences were verified by Sanger sequencing prior to transformation into the *B. subtilis* expression host.

Strain Construction.

*B. subtilis* strain WB800N was purchased from MoBiTec (Göttingen, Germany) and used as the expression host. WB800N is a derivative of a well-studied strain (*B. subtilis* 168) and it has been engineered to reduce proteolytic degradation of secreted proteins by deletion of genes encoding 8 extracellular proteases (nprE, aprE, epr, bpr, mpr, nprB, vpr and wprA). *B. subtilis* transformations were performed according to the manufacturer's instructions. Approximately 1 µg of each expression construct was transformed into WB800N and single colonies were selected at 37° C. by plating on LB agar containing 5.0 µg/ml chloramphenicol (Cm5). Individual transformants were grown in LB broth containing Cm5 until they reached log phase. Aliquots of these cultures were mixed with glycerol (20% final concentration) and frozen at 80° C.

Expression Testing.

Frozen glycerol stocks of *B. subtilis* expression strains were used to inoculate 1-ml of 2×-MAL medium (20 g/l NaCl, 20 g/l tryptone, and 10 g/l yeast extract, 75 g/l maltose) with Cm5, in deep well blocks (96-square wells). Culture blocks were covered with porous adhesive plate seals and incubated overnight in a micro-expression chamber (Glas-Col, Terre Haute, Ind.) at 37° C. and 880 rpm. Overnight cultures were used to inoculate fresh, 2×-MAL, Cm5 cultures, in deep well blocks, to a starting OD600=0.1. These expression cultures were incubated at 37° C., 880 rpm until the OD600=1.0 (approx. 4 hrs) at which time they were induced by adding isopropyl β-D-1-thiogalactopyranoside (IPTG) at a final concentration of 0.1 M and continuing incubation for 4 hrs. After 4 hrs, the cell densities of each culture was measured (OD600) and cells were harvested by centrifugation (3000 rpm, 10 min, RT). After centrifugation, culture supernatant was carefully removed and transferred to a new block and cell pellets were frozen at −80° C. To determine the levels of secreted protein, 0.5-ml aliquots of the culture supernatants were filtered first through a 0.45-µm filter followed by a 0.22 µm filter. The filtrates were then assayed to determine the levels of secreted protein of interest (POI).

To determine levels of intracellularly produced POI, frozen cell pellets were thawed and 0.5 g of 0.1 mm zirconium beads were added to each sample followed by 0.5 ml of PBS. The cells were lysed in the cold room (4° C.) by bead-beating for 5 min in a Qiagen TissuelyserII (Qiagen, Hilden, Germany) equipped with a 96-well plate adapter. Cell lysates were centrifuged at 3000 rpm for 10 min and the supernatant was removed and analyzed for POI concentration as described below. To determine the levels of secreted protein, 0.5-ml aliquots of the culture supernatants were filtered by a 0.22 µm filter. The filtrates were then assayed to determine the levels of secreted protein of interest (POI).

Shake Flask Expression.

A single colony was picked from an agar plate for each SEQID and inoculated into 5 mL of 2×Mal media. These shake flasks inocula were grown in a 30° C. shaker incubator overnight. 5 mLs of this overnight culture was used to inoculate 250 mL 2×Mal. Cultures were grown for 4 hours at 30° C. then induced for 4 hours at 30° C. Cultures were harvested by centrifugation. Centrifuged supernatants for each SEQID were sterile filtered and frozen at −80° C.

Fermentation Expression.

Soluble protein for SEQID-00105 has been secreted from engineered *Bacillus subtilis* strains containing episomal or integrated plasmids. The fermentation occurred at a volume of 4 L in a carbon and nitrogen rich media containing Phytone Peptone, Yeast Extract, and Glucose. Fermentation cultures were grown at 30° C., at a pH of 7.0 and a percent dissolved oxygen of 40%. Induction, via the addition of IPTG, occurred at an OD600 nm of 5.0 (+/−1.0). The cultures were supplemented with a Glucose based feed post induction. The cultures were harvested 5-8 hours post induction. The biomass was then removed via centrifugation and the supernatant was clarified via filtration and stored at 4° C. until processing.

168 Nutritive Polypeptide Library Gene Synthesis & Plasmid Construction.

For expression in *B. subtilis*, the vector that was used was derived from pHT43 backbone vector (MoBiTec Göttingen, Germany) with no signal peptide and grac promoter substituted with aprE promoter and lacI expression cassette removed. 168 genes encoding for 168 different protein sequences that were identified above were made synthetically by Life Technologies/GeneArt as linear fragments (GeneStrings) and selected for expression in *Escherichia coli*. In most cases two genes were synthesized together in a single linear fragment that had a flanking 5' NdeI restriction site and 3' BamHI restriction site. All the linear fragments were mixed together at equal molar concentrations. Then the linear fragments mixture was digested with NdeI and BamHI. The digested mixtures were cloned into the vector either as secretion expression constructs (gene fused in-frame with DNA encoding the lipase signal peptide (LipAsp) from *Bacillus subtilis*) or as an intracellular expression constructs (gene inserted immediately downstream of the ribosomal binding site (RBS), with and without N-terminal tag containing MGSHHHHHHH). The library of genes was ligated to the vector PCR product using T4 DNA ligase (New England Biolabs, Beverly, Mass.). The ligation products were transformed into the cloning host, *E. coli* Turbo (New England Biolabs) according to manufacturer's instructions. 50-100 colonies were sequenced to determine the diversity of the leader peptide library. The colonies on the agar plate were then suspended in LB media and harvested for plasmid purification.

168 Nutritive Polypeptide Library Strain Construction.

WB800N is a derivative of a well-studied strain (*B. subtilis* 168) and it has been engineered to reduce proteolytic degradation of secreted proteins by deletion of genes encoding 8 extracellular proteases (nprE, aprE, cpr, bpr, mpr, nprB, vpr and wprA). *B. subtilis* strain WB800N was purchased from MoBiTec (Göttingen, Germany) and was modified to have the following mutations WB800N: pXylA-comK::Erm, degU32(Hy), ΔsigF. This new strain was used as the expression host. Roughly 1 µg of the plasmid mixture purified from *E. coli* cells was transformed into the expression strain. After transformation, 100 µL of the culture were plated onto four LB 1.5% agar plates containing 5 mg/L chloramphenicol and incubated at 37° C. for 16 hrs. After incubation, 2 mL of LB media with 5 mg/L chloramphenicol were added to the surface of each plate containing several thousand transformants, and the cells were suspended in the surface medium by scraping with a cell spreader and mixing. Suspended cells from the four replicates were pooled together to form the preinoculum culture for the expression experiment.

168 Nutritive Polypeptide Expression Testing.

The OD600 of the preinoculum culture made from resuspended cells was measured using a plate reader to be roughly 20-25. A 500 mL baffled shake flask containing 50 mL of 2×Mal medium (20 g/L NaCl, 20 g/L Tryptone, 10 g/L yeast extract, 75 g/L D-Maltose) with 5 mg/L chloramphenicol was inoculated to OD600 to form the inoculum culture, and incubated at 30° C. shaking at 250 rpm for roughly 6 hours. OD600 was measured and the inoculum culture was used to inoculate the expression culture in a 2 L baffled shake flask containing 250 ml 2×Mal medium with 5 mg/L chloramphenicol, 1× Teknova Trace Metals, and 0.01% Antifoam 204 to an OD600 of 0.1. The culture was shaken for 30° C. and 250 rpm for 18 hours, at which point the culture was harvested. For the secreted protein library constructs, the terminal cell density was measured and the supernatant was harvested by centrifugation (5000×g, 30 min, RT) and filtered using 0.22 um filter. For the intracellular protein library constructs, the terminal cell density was measured and the cells were harvested by centrifugation (5000×g, 30 min, RT). Cells were then lysed using microfluidizer and the soluble fraction was purified using nickel affinity column if the construct library had N-terminal His tag. Otherwise the soluble fraction was used for further analysis. All the samples were run on SDS-PAGE gels, separated into tell fractions, and then analyzed using LC-MS/MS as described below. 40/168 proteins were successfully secreted, 10/168 proteins were successfully produced intracellularly without His tag and 28/168 proteins were successfully produced intracellularly with 5' 8×His tag in *Bacillus subtilis*. Based on the results, certain genes were individually cloned and tested for individual secretion in *Bacillus subtilis*.

Secreted Nutritive Polypeptide Plasmid Construction.

For this study, the pHT43 backbone vector with no signal peptide was modified by removing the SamyQ signal peptide to allow for the native signal peptide to guide secretion, substituting the grac promoter with the aprE promoter, removing the lacI region, and adding a 1×FLAG tag (DYKDDDDK) before the terminator region. The unmodified pHT43 vector from MoBiTec contains the Pgrac promoter, the SamyQ signal peptide, Amp and Cm resistance genes, a lacI region, a repA region, and the ColE1 origin of replication. To amplify the genes of interest, genomic DNA preps were made from wild-type *Bacillus* strains. Secreted nutritive polypeptide genes including their native signal peptide coding regions were PCR amplified using PCR primers with tails containing 25 bp homology regions to the pHT43 backbone and were run on a 1% Agarose TAE gel to check for correct insert size. 10 µL from each PCR were pooled together into a single library of inserts, and the mix was Gibson ligated to a pHT43 backbone vector. The ligation was transformed into 10-Beta electrocompetent cells (New England Biolabs), and transformed cells were plated at a 10-1 dilution onto four LB agar plates with 100 mg/L carbenicillin. One plate was sequenced using a forward primer that binds in the promoter region and a reverse primer that binds in the terminator region. 2 mL of LB medium with 100 mg/L carbenicillin was added to the remaining three plates. Cells were scraped and suspended into the LB medium, and the plasmids were extracted from the cell suspensions to form the multiplex plasmid mix to be transformed into the expression strain. The secreted polypeptide library strain construction and expression were done similar to 168 nutritive polypeptide library strain construction and expression testing.

Secretion Leader Peptide Library Construction.

Secretion signal peptide libraries facilitate the secretion of any given protein of interest. One approach to enhancing secretion is to fuse a library of signal peptide sequences to the protein of interest and screen for those that result in the highest level of secretion. The signal peptide library described here consists of 173 signal peptides that were identified as being associated to naturally Sec mediated secreted proteins in *Bacillus subtilis* (Brockmeier et al Molecular Biology, 2006). A signal peptide library was generated for SEQID-43136, starting with plasmid pES1207 which has SEQID-43136 fused to the signal peptide from the *B. amyloliquefaciens* α-amylase (SamyQ). pES1207 was used as template for a PCR reaction with primers, Pfwd and Prev, which amplified the entire plasmid except for the SamyQ sequence. Pfwd and Prev possessed tails that had AarI restriction sites and the PCR products were purified and cut with Aar I. The fragment was then dephosphorylated using Antarctic phosphatase (New England Biolabs, Beverly, Mass.). DNA encoding the individual signal peptides was constructed by duplexing single stranded oligonucleotides comprising the forward- and reverse-strands of each signal peptide sequence. The oligonucleotides were designed such that single strand tails were formed at the 5'-ends of the duplexed molecule. These were complementary of the overhangs generated by the AarI digestion of the vector PCR fragment. To duplex the oligonucleotides, the direct strand and the reverse strand oligonucleotides were mixed together, phosphorylated using T4 polynucleotide kinase (New England Biolabs, Beverly, Mass.) and annealed. Post annealing, signal peptide DNA sequences were mixed in equal proportion in a single tube. The library of signal peptides was ligated to the vector PCR product using T4 DNA ligase (New England Biolabs, Beverly, Mass.). The ligation products were transformed into the cloning host, *E. coli* Turbo (New England Biolabs) according to manufacturer's instructions. 50-100 colonies were sequenced to determine the diversity of the leader peptide library for SEQID-00298 and SEQID-00338. The colonies on the agar plate were then suspended in LB media and harvested for plasmid purification.

Secretion Leader Peptide Library Strain Construction.

*B. subtilis* strain WB800N (MoBiTec, Göttingen, Germany) was used as the expression host. Approximately 10 µg of signal peptide library of a particular protein construct was transformed into WB800N and single colonies were selected at 37° C. by plating on LB agar containing 5.0 µg/ml chloramphenicol (Cm5). The leader peptide library screening for SEQID-00105, SEQID-00352, SEQID-00341, SEQID-00103 were carried out in *B. subtilis* WB800N that has been modified to have mutations in the sigF sporulation factor and also the intracellular serine protease (ispA) was disrupted with an antibiotic marker. The strain also had an inducible comK (the competence initiation transcription factor) integrated into chromosome for higher transformation efficiency.

Secretion Leader Peptide Library Expression Screening.

400-500 individual transformants of the *B. subtilis* signal peptide library were used to inoculate individual, 1-ml cultures of 2×-MAL medium (20 g/l NaCl, 20 g/l tryptone, and 10 g/l yeast extract, 75 g/l maltose) with Cm5, in deep well blocks (96-square wells). In addition to the signal peptide library strains, a strain containing plasmid with the protein of interest and the SamyQ leader peptide was inoculated as a control. Culture blocks were covered with porous adhesive plate seals and incubated overnight in a micro-expression chamber (Glas-Col, Terre Haute, Ind.) at 37° C. and 800 rpm. Overnight cultures were used to inoculate fresh, 2×-MAL, Cm5 cultures, in deep well blocks, to a starting OD600=0.15.

Expression cultures were incubated at 37° C., 880 rpm until the OD600=1.0 (approx. 4 hrs) at which time they were induced by adding isopropyl β-D-1-thiogalactopyranoside (IPTG) at a final concentration of 1 mM and continuing incubation for 4 hrs. After 4 hrs, the cell densities of each culture was measured (OD600) and cells were harvested by centrifugation (3000 rpm, 10 min, RT). After centrifugation, the culture supernatant was carefully removed and transferred to a new block and cell pellets were frozen at −80° C. To determine the levels of secreted protein, 0.5-ml aliquots of the culture supernatants were filtered first through a 0.45-μm filter followed by a 0.22 μm filter. The filtrates were then assayed by Chip electrophoresis, as described herein, to determine the levels of secreted protein of interest (POI) and compared with the level of secretion of base construct.

Diluted overnight cultures were used as inoculum for LB broth cultures containing Cm5. These cultures were grown at 37 C until they reached log phase. Aliquots of these cultures were mixed with glycerol (20% final concentration) and frozen at −80° C. The top 10-15 hits were then purified using Instagene matrix (Biorad, USA) and amplified around the signal peptide and sent for sequencing to identify the signal peptide sequence.

TABLE E14A

Exemplary results of B. subtilis leader peptide library screening.

| SEQID | Gene Name | Protein Sequence | SEQID-298 mg/l/OD | SEQID-00338 mg/l/OD | SEQID-00105 mg/l/OD | SEQID-00352 mg/l/OD | SEQID-00341 mg/l/OD | SEQID-00103 mg/l/OD | Other SEQ IDs mg/l/OD |
|---|---|---|---|---|---|---|---|---|---|
| 3921 | abnA | MKKKKTWKRFLHFSSA ALAAGLIFTSAAPAEA | 4.4 | 9.5 | 135.7 | ~ | 148.14 | 12.1 | 3.1 SEQID-00405 |
| 3922 | bglC | MKRSISIFITCLLITLLT MGGMIASPASA | 7.8 | ~ | 73.6 | 2.7 | 33.9 | 12.1 | ~ |
| 3923 | bpr | MRKKTKNRLISSVLSTV VISSLLFPGAAGA | ~ | ~ | ~ | ~ | 40.4 | ~ | ~ |
| 3924 | glpQ | MRKNRILALFVLSLGLL SFMVTPVSA | ~ | 5.7 | ~ | ~ | 41.9 | ~ | 5.5 SEQID-00398 |
| 3925 | lipA | MKFVKRRIIALVTILML SVTSLFALQPSAKAA | 14.1 | ~ | ~ | 10.9 | ~ | 16.1 | ~ |
| 3926 | lytB | MKSCKQLIVCSLAAILL LIPSVSFA | ~ | 3.4 | ~ | ~ | ~ | ~ | ~ |
| 3927 | lytF | MKKKLAAGLTASAIVG TTLNVTPAEA | ~ | ~ | ~ | ~ | ~ | 14.8 | ~ |
| 3928 | mpr | MKLVPRFRKQWFAYLT VLCLALAAAVSFGVPA KA | 10.8 | ~ | ~ | ~ | ~ | ~ | ~ |
| 3929 | nprB | MRNLTKTSLLLAGLCT AAQMVFVTHASA | ~ | ~ | ~ | ~ | 37.5 | ~ | ~ |
| 3930 | pclB | MKRLCLWFTVFSLFLV LLPGKALG | ~ | ~ | ~ | ~ | 64.4 | ~ | ~ |
| 3931 | penP | MKLKTKASIKFGICVGL LCLSITGFTPFFNSTHAE A | ~ | ~ | ~ | 2.8 | ~ | ~ | ~ |
| 3932 | phoB | MKKFPKKLLPIAVLSSI AFSSLASGSVPEASA | 7.9 | ~ | ~ | ~ | ~ | ~ | ~ |
| 3933 | wapA | MKKRKRRNFKRFIAAF LVLALMISLVPADVLA | ~ | 7 | ~ | 2.14 | ~ | ~ | ~ |
| 3934 | xynA | MFKFKKNFLVGLSAAL MSISLFSATASA | 4.3 | 9.8 | 114.4 | ~ | 83.3 | 13.4 | ~ |
| 3935 | ybfO | MKRMIVRMTLPLLIVC LAFSSFSASARA | ~ | ~ | ~ | 0.69 | ~ | ~ | ~ |
| 3936 | yckD | MKRITINIITMFIAAAVI SLTGTAEA | ~ | ~ | ~ | ~ | 61.7 | ~ | ~ |
| 3937 | yddT | MRKKRVITCVMAASLT LGSLLPAGYASA | ~ | ~ | 135.6 | ~ | ~ | ~ | ~ |
| 3938 | yfhK | MKKKQVMLALTAAAG LGLTALHSAPAAKA | ~ | ~ | ~ | ~ | ~ | 20.8 | ~ |

TABLE E14A-continued

Exemplary results of B. subtilis leader peptide library screening.

| SEQID | Gene Name | Protein Sequence | SEQID-298 mg/l/OD | SEQID-00338 mg/l/OD | SEQID-00105 mg/l/OD | SEQID-00352 mg/l/OD | SEQID-00341 mg/l/OD | SEQID-00103 mg/l/OD | Other SEQ IDs mg/l/OD |
|---|---|---|---|---|---|---|---|---|---|
| 3939 | yfjS | MKWMCSICCAAVLLAGGAAQA | ~ | ~ | ~ | ~ | ~ | 9.4 | ~ |
| 3940 | yjcM | MKKELLASLVLCLSLSPLVSTNEVFA | ~ | ~ | 83.4 | ~ | 80.2 | ~ | ~ |
| 3941 | yjdB | MNFKKTVVSALSISALALSVSGVASA | ~ | ~ | 152.7 | ~ | ~ | 14.3 | ~ |
| 3942 | yjfA | MKRLFMKASLVLFAVVFVFAVKGAPAKA | ~ | ~ | ~ | ~ | ~ | 20 | ~ |
| 3943 | ykoJ | MLKKKWMVGLLAGCLAAGGFSYNAFA | ~ | ~ | ~ | 2.23 | 132.5 | ~ | ~ |
| 3944 | ylqB | MKKIGLLFMLCLAALFTIGFPAQQADA | ~ | ~ | ~ | ~ | ~ | 13.3 | ~ |
| 3945 | yndA | MRFTKVVGFLSVLGLAAVFPLTAQA | ~ | ~ | 124.3 | ~ | ~ | ~ | ~ |
| 3946 | yqgA | MKQGKFSVFLILLLMLTLVVAPKGKAEA | 3.9 | ~ | ~ | ~ | ~ | ~ | ~ |
| 3947 | yraJ | MTLTKLKMLSMLTVMIASLFIFSSQALA | ~ | 6.3 | ~ | ~ | ~ | ~ | ~ |
| 3948 | yuaB | MKRKLLSSLAISALSLGLLVSAPTASFAAE | ~ | ~ | ~ | ~ | ~ | ~ | 2.5 SEQID-00404 |
| 3949 | yurI | MTKKAWFLPLVCVLLISGWLAPAASASA | ~ | ~ | ~ | 2.26 | ~ | ~ | ~ |
| 3950 | yveE | MRKSLITLGLASVIGTSSFLIPFTSKTASA | ~ | ~ | 124.4 | ~ | ~ | 14.6 | ~ |
| 3951 | yvgO | MKRIRIPMTLALGAALTIAPLSFASA | ~ | ~ | ~ | ~ | ~ | 17.7 | ~ |
| 3952 | yvnB | MRKYTVIASILLSFLSVLSGG | ~ | ~ | ~ | ~ | ~ | 26.2 | ~ |
| 3953 | ywaD | MKKLLTVMTMAVLTAGTLLLPAQSVTPAAHA | ~ | ~ | ~ | ~ | ~ | ~ | 3.4 SEQID-403 |
| 3954 | ywsB | MNKPTKLFSTLALAAGMTAAAGGAGTIHA | ~ | ~ | 131 | ~ | ~ | ~ | ~ |
| 3955 | yxaK | MVKSFRMKALIAGAAVAAAVSAGAVSDVPAAKVLQPTAAYA | ~ | ~ | ~ | 3.7 | ~ | ~ | ~ |
| 3956 | yxiT | MKWNNMLKAAGIAVLLFSVFAYAAPSLKAVQA | ~ | 7.9 | ~ | 0.95 | 41.5 | ~ | ~ |

Example 15

Expression of Nutritive Polypeptides in *Aspergillus niger* Fungi

Gene Synthesis & Plasmid Construction.

Genes encoding natively secreted proteins were PCR amplified from the *Aspergillus niger* ATCC 64974 using primers designed from the genome sequence of *Aspergillus niger* CBS 513.88. In one example, genes included native 5' secretion sequences and were cloned into the expression vector pAN56-1 (Genbank: Z32700.1) directly under the control of the gpdA promoter from *Aspergillus nidulans* with the addition of a C-terminal 3×FLAG tag (DYKDHDGDYKDHDIDYKDDDDK). In another example genes included only the mature peptide with the addition of a heterologous 5' secretion signal. Plasmids were constructed using the Gibson Assembly Kit (New England Biolabs, Beverly, Mass.). Recombinant plasmids were sequence verified before transformation into *Aspergillus* hosts.

pFGLAHIL6T was obtained from the BCCM/LMBP (Ghent, Netherlands). Plasmids were constructed using the Gibson Assembly Kit (New England Biolabs, Beverly, Mass.). Recombinant plasmids were sequence verified before transformation into *Aspergillus* hosts.

The pyrA nutritional marker was PCR amplified from *Aspergillus niger* ATCC 64974 using primers designed from genome sequence of *Aspergillus niger* ATCC 1015. The pyrA PCR fragment was digested with XbaI and ligated into an XbaI fragment of pCSN44 (Staben et al., 1989) to construct pES1947. pCSN44 was obtained from the BCCM/LMBP (Ghent, Netherlands). The recombinant plasmid was sequence verified before transformation into *Aspergillus* hosts.

Strain Construction.

A protease deficient derivate of *Aspergillus niger* ATCC 62590 was used as the expression host. Expression vectors were co-transformed with pES1947 using the protoplast method as described in Punt et al., 1992, Methods in Enzymology, 216, 447-457. Approximately 5 ug of each plasmid was transformed into *Aspergillus niger* protoplasts. Transformants were selected on minimal media supplemented with 1.2 M sorbitol and 1.5% bacto agar (10 g/l glucose, 4 g/l sodium nitrate, 20 ml/l salts solution (containing 26.2 g/l potassium chloride and 74.8 g/l Potassium phosphate monobasic at pH 5.5), 1 ml/l vitamin solution (containing 100 mg/l Pyridoxine hydrochloride, 150 mg/l Thiamine hydrochloride, 750 mg/l 4-Aminobenzoic acid, 2.5 g/l Nicotinic acid, 2.5 g/l riboflavin, 20 g/l choline chloride, and 30 mg/l biotin), and 1 ml/l of metals solution (containing 20 g/l Zinc sulfate heptahydrate (ZnSO4-7H2O), 11 g/l Boric acid (H3BO3), 5 g/l Manganese (II) chloride tetrahydrate (MnCl2-4H2O), 5 g/l Iron (II) sulfate heptahydrate (FeSO4-7H2O), 1.7 g/l Cobalt(II) chloride hexahydrate (CoCl2-6H2O), 1.6 g/l Copper(II) sulfate pentahydrate (CuSO4-5H2O), 1.5 g/l Sodium molybdate dihydrate (NaMoO4-2H2O), and 5.0 g/l EDTA disodium salt dihydrate (Na2EDTA-2H2O) at pH 6.5). Individual transformants were isolated on minimal media plates and allowed to grow at 30 C until they sporulated. Spores were harvested in water and stored at 4 C.

Expression Testing.

Spore stocks of *Aspergillus niger* strains were inoculated at $10^6$ spores/mL into 2 mL of CM (MM plus 5.0 g/l yeast extract, 2.0 g/l casamino acids) adjusted to pH 7 with 40 mM MES and SigmaFast Protease Inhibitor Cocktail (1 tab/100 mL, Sigma Aldrich) in 24 well square bottom deep well blocks. Culture blocks were covered with porous adhesive plate seals and incubated for 48 hrs in a micro-expression chamber (Glas-Col, Terre Haute, Ind.) at 30° C. at 600 rpm. After the growth period, 0.5-ml aliquots of the culture supernatants were filtered first through a 25 μm/0.45-μm dual stage filter followed by a 0.22 μm filter. The filtrates were then assayed to determine the levels of secreted protein of interest (POI).

TABLE E15A

Exemplary results of *Aspergillus* leader peptide library screening.

| SEQID | signal peptide name (gene name_species name) | signal sequence | Genotype |
|---|---|---|---|
| 3957 | native signal peptide | MRWLLTSSALLVPAAA | PgpdA-native signal peptide-SEQID-00409-3XFlag |
| 3958 | AXHA_ASPNG | MKFLKAKGSLLSSGIYLIALAPFVNA | PgpdA-AXHA_ASPNG-SEQID-00409-3XFlag |
| 3959 | PPIB_ASPNG | MNFKNIFLSFFFVLAVGLALVHA | PgpdA-PPIB_ASPNG-SEQID-00409-3XFlag |
| 3960 | FAEA_ASPNG | MKQFSAKYALILLATAGQALA | PgpdA-FAEA_ASPNG-SEQID-00409-3XFlag |
| 3961 | BGAL_ASPNG | MKLSSACAIALLAAQAAGA | PgpdA-BGAL_ASPNG-SEQID-00409-3XFlag |
| 3962 | PLYA_ASPNG | MKYSTIFSAAAAVFAGSAAA | PgpdA-PLYA_ASPNG-SEQID-00409-3XFlag |
| 3963 | PRTA_ASPNG | MKFSTILTGSLFATAALA | PgpdA-PRTA_ASPNG-SEQID-00409-3XFlag |
| 3964 | AGALC_ASPNG | MIGSSHAVVALGLFTLYGHSAA | PgpdA-AGALC_ASPNG-SEQID-00409-3XFlag |
| 3965 | PHYB_ASPNG | MPRTSLLTLACALATGASA | PgpdA-PHYB_ASPNG-SEQID-00409-3XFlag |
| 3966 | AORSN_ASPOR | MRPLSHLSFFNGLLLGLSALSA | PgpdA-AORSN_ASPOR-SEQID-00409-3XFlag |
| 3967 | DPP5_ASPOR | MGALRWLSIAATASTALA | PgpdA-DPP5_ASPOR-SEQID-00409-3XFlag |
| 3968 | PHYA_ASPNG | MGVSAVLLPLYLLSGVTSGLAVP | PgpdA-PHYA_ASPNG-SEQID-00409-3XFlag |
| 3969 | EXG_ASPOR | MLPLLLCIVPYCWS | PgpdA-EXG_ASPOR-SEQID-00409-3XFlag |
| 3970 | native signal peptide | MHFLQNAVVAATMGAALA | PgpdA-native signal peptide-SEQID-00420-3XFlag |
| 3971 | PPA1_ASPNG | MKGTAASALLIALSATAAQA | PgpdA-PPA1_ASPNG-SEQID-00420-3XFlag |
| 3972 | PEPC_ASPNG | MKGILGLSLLPLLTAA | PgpdA-PEPC_ASPNG-SEQID-00420-3XFlag |
| 3973 | PRTA_ASPNG | MKFSTILTGSLFATAALA | PgpdA-PRTA_ASPNG-SEQID-00420-3XFlag |
| 3974 | AGALC_ASPNG | MIGSSHAVVALGLFTLYGHSAA | PgpdA-AGALC_ASPNG-SEQID-00420-3XFlag |

TABLE E15A-continued

Exemplary results of *Aspergillus* leader peptide library screening.

| SEQID | signal peptide name (gene name_species name) | signal sequence | Genotype |
|---|---|---|---|
| 3975 | RNT1_ASPOR | MMYSKLLTLTTLLLPTALALPSLVER | PgpdA-RNT1_ASPOR-SEQID-00420-3XFlag |
| 3976 | PGLR1_ASPNG | MHSYQLLGLAAVGSLVSA | PgpdA-PGLR1_ASPNG-SEQID-00420-3XFlag |
| 3977 | ORYZ_ASPOR | MQSIKRTLLLLGAILPAVLGA | PgpdA-ORYZ_ASPOR-SEQID-00420-3XFlag |
| 3978 | PLYB_ASPNG | MHYKLLFAAAAASLASAVSA | PgpdA-PLYB_ASPNG-SEQID-00420-3XFlag |
| 3979 | NUS1_ASPOR | MPRLLPISAATLALAQLTYG | PgpdA-NUS1_ASPOR-SEQID-00420-3XFlag |
| 3980 | PHYB_ASPNG | MPRTSLLTLACALATGASA | PgpdA-PHYB_ASPNG-SEQID-00420-3XFlag |
| 3981 | TAN_ASPOR | MRQHSRMAVAALAAGANA | PgpdA-TAN_ASPOR-SEQID-00420-3XFlag |
| 3982 | PDI_ASPNG | MRSFAPWLVSLLGASAVVAA | PgpdA-PDI_ASPNG-SEQID-00420-3XFlag |
| 3983 | XYN2_ASPNG | MLTKNLLLCFAAAKAALA | PgpdA-XYN2_ASPNG-SEQID-00420-3XFlag |
| 3984 | PHYA_ASPOR | MAVLSVLLPITFLLSSVTG | PgpdA-PHYA_ASPOR-SEQID-00420-3XFlag |
| 3985 | DPP5_ASPOR | MGALRWLSIAATASTALA | PgpdA-DPP5_ASPOR-SEQID-00420-3XFlag |
| 3986 | PHYA_ASPNG | MGVSAVLLPLYLLSGVTSGLAVP | PgpdA-PHYA_ASPNG-SEQID-00420-3XFlag |
| 3987 | PEPA_ASPNG | MVVFSKTAALVLGLSTAVSA | PgpdA-PEPA_ASPNG-SEQID-00420-3XFlag |
| 3988 | AGLU_ASPNG | MVKLTHLLARAWLVPLAYGASQSLL | PgpdA-AGLU_ASPNG-SEQID-00420-3XFlag |
| 3989 | ABFA_ASPNG | MVAFSALSGVSAVSLLLSLVQNAHG | PgpdA-ABFA_ASPNG-SEQID-00420-3XFlag |
| 3990 | AMYG_ASPNG | MSFRSLLALSGLVCTGLA | PgpdA-AMYG_ASPNG-SEQID-00420-3XFlag |
| 3991 | PHOA_ASPNG | MFTKQSLVTLLGGLSLAVA | PgpdA-PHOA_ASPNG-SEQID-00420-3XFlag |
| 3992 | ABFB_ASPNG | MFSRRNLVALGLAATVSA | PgpdA-ABFB_ASPNG-SEQID-00420-3XFlag |

*Aspergillus* Niter Signal Peptide Library Construction.

It is difficult to predict which secretion signal peptide will facilitate the secretion of any given protein of interest best. Therefore, one approach to optimizing secretion is to fuse a library of signal peptide sequences to the protein and screen for those that result in the highest level of secretion. We constructed a signal peptide library for SEQID-00409 and SEQID-00420. Table E15A shows the signal peptides that were fused with SEQID-00409 and SEQID-00420. DNA encoding the individual signal peptides was constructed by duplexing single stranded oligonucleotides comprising the forward- and reverse-strands of each signal peptide sequence. The oligonucleotides were designed such that single strand tails were formed at the 5'-ends of the duplexed molecule. Genes encoding natively secreted proteins SEQID-00409 and SEQID-00420 were PCR amplified from the *Aspergillus niger* ATCC 64974 using primers designed from the genome sequence of *Aspergillus niger* CBS 513.88. Genes included native 5' secretion sequences and were cloned into the expression vector pAN56-1 (Genbank: Z32700.1) directly under the control of the gpdA promoter from *Aspergillus nidulans* with the addition of a C-terminal 3xFLAG tag (DYKDHDGDYKDHDIDYKDDDDK). Then the vectors were amplified without the native signal peptide and plasmids with different signal peptides were reconstructed with the duplex signal peptide sequences using the Gibson Assembly Kit (New England Biolabs, Beverly, Mass.). Recombinant plasmids were sequence verified before transformation into *Aspergillus* hosts.

The pyrA nutritional marker was PCR amplified from *Aspergillus niger* ATCC 64974 using primers designed from genome sequence of *Aspergillus niger* ATCC 1015. The pyrA PCR fragment was digested with XbaI and ligated into an XbaI fragment of pCSN44 (Staben et al., 1989) to construct pES1947. pCSN44 was obtained from the BCCM/LMBP (Ghent, Netherlands). The recombinant plasmid was sequence verified before transformation into *Aspergillus* hosts.

*Aspergillus niger* signal peptide library strain construction. A protease deficient derivate of *Aspergillus niger* ATCC 62590 was used as the expression host. Each signal peptide-gene combination vector was individually co-transformed with plasmid containing the nutritional marker pyrG using the protoplast method as described in Punt et al., 1992. Approximately 5 ug of each plasmid were transformed into *Aspergillus niger* protoplasts. Transformants were selected on minimal media supplemented with 1.2 M sorbitol and 1.5% bacto agar (10 g/l glucose, 4 g/l sodium nitrate, 20 ml/l salts solution (containing 26.2 g/l potassium chloride and 74.8 g/l Potassium phosphate monobasic at pH 5.5), 1 ml/l vitamin solution (containing 100 mg/l Pyridoxine hydrochloride, 150 mg/l Thiamine hydrochloride, 750 mg/l 4-Aminobenzoic acid, 2.5 g/l Nicotinic acid, 2.5 g/l riboflavin, 20 g/l choline chloride, and 30 mg/l biotin), and 1 ml/1 of metals solution (containing 20 g/l Zinc sulfate heptahydrate (ZnSO4-7H2O), 11 g/l Boric acid (H3B03), 5 g/l Manganese (II) chloride tetrahydrate (MnCl2-4H2O), 5 g/l Iron (II) sulfate heptahydrate (FeSO4-7H2O), 1.7 g/l Cobalt(II) chloride hexahydrate (CoCl2-6H2O), 1.6 g/l Copper(II) sulfate pentahydrate (CuSO4-5H2O), 1.5 g/l Sodium molybdate dihydrate (NaMoO4-2H2O), and 5.0 g/l EDTA disodium salt dihydrate (Na2EDTA-21-120) at pH 6.5). Individual transformants were isolated on minimal media plates and allowed to grow at 30 C until they sporulated.

*Aspergillus niger* Signal Peptide Library Expression Testing.

Six different primary transformants from each construct were inoculated into 1 ml of minimal media as defined above supplemented with 5.0 g/l yeast extract, 2.0 g/l casamino acids) adjusted to pH 7 with 160 mM MES in 96 deep well culture blocks. Culture blocks were covered with porous adhesive plate seals and incubated for 48 hrs in a micro-expression chamber (Glas-Col, Terre Haute, Ind.) at 33° C. at 800 rpm. After the growth period, 0.5-ml aliquots of the culture supernatants were filtered first through a 25 µm/0.45-µm dual stage filter followed by a 0.22 µm filter. The filtered supernatants were then analyzed using Chip Electrophoresis as described below or anti-FLAG DOT-BLOT and SDS-PAGE as described below. Based on these results the primary transformants, which demonstrated higher secretion than the native signal peptide, were isolated on minimal media plate and allowed to grow at 30° C. until they sporulated.

Spore stocks of the above *Aspergillus niger* strains along with the control *Aspergillus niger* strain that contain expression construct of pgpdA promoter and native signal peptide of SEQID-00409 and SEQID-00424 were inoculated at $10^6$ spores/mL into 10 mL of minimal media as defined above supplemented with 5.0 g/l yeast extract, 2.0 g/l casamino acids) adjusted to pH 7 with 160 mM MES in 125 ml plastic flask. *Aspergillus* spores were then grown at 30° C. with 150 RPM for two days. After the growth period, aliquots of the culture supernatants were filtered first through a 25 µm/0.45-µm dual stage filter followed by a 0.22 µm filter. The filtrates were then analyzed using SDS-PAGE as described herein.

Figure 5:
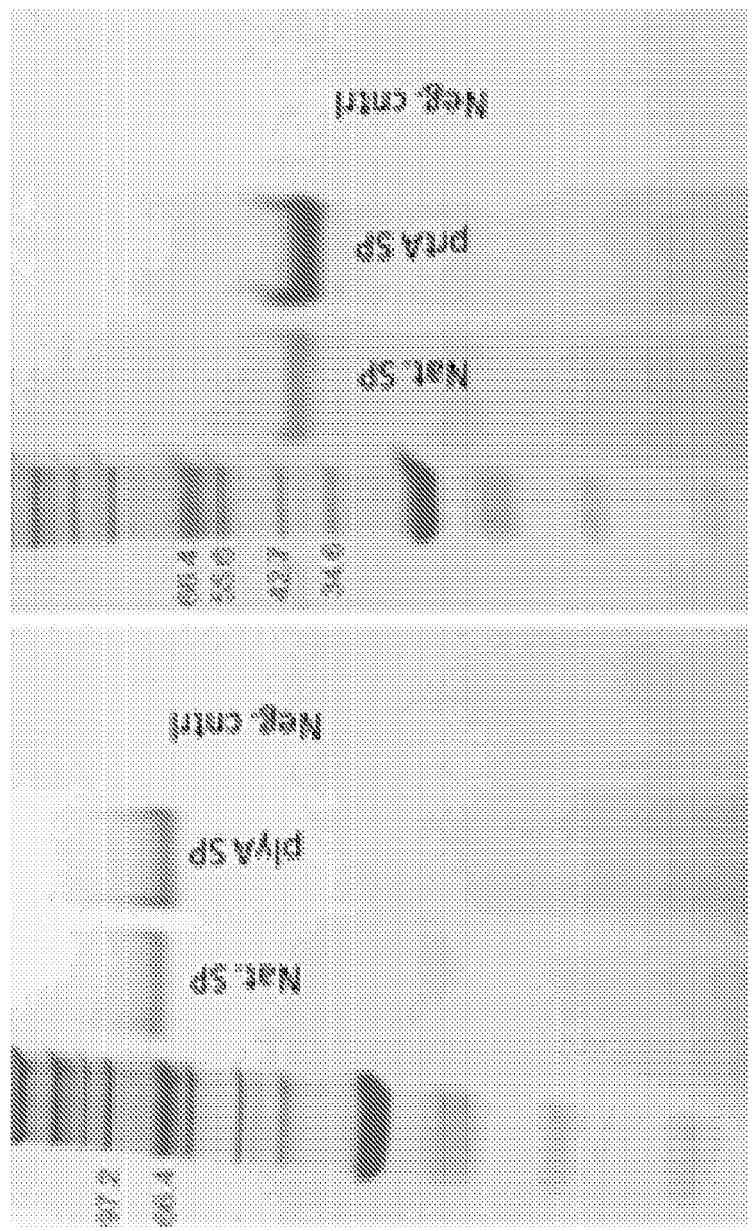
FIG. 5 is an image demonstrating SDS-PAGE analysis demonstrating secretion of SEQID-00409 (left) and SEQID-00420 (right) with new signal peptide compared to native signal peptide.

FIG. 5. demonstrates the secretion of SEQID-00409 (left) and SEQID-00420 (right) with new signal peptide compared to native signal peptide.

*Aspergillus niger* Heterologous Nutritive Polypeptide Gene Synthesis & Plasmid Construction.

Genes encoding nutritive polypeptides were synthesized (Geneart, Life Technologies). Genes were codon optimized for expression in *Aspergillus niger*. Synthesized genes were PCR amplified and cloned into the expression vector pAN56-1 (Genbank: Z32700.1) fused to glucoamylase with its native leader sequence under the control of the gpdA promoter from *Aspergillus nidulans* with the addition of a C-terminal 3xFLAG tag (DYKDHDGDYKDHDI-DYKDDDDK) and Kexin protease site (NVISKR) between glucoamylase gene and gene of interest. Plasmids were constructed using the Gibson Assembly Kit (New England Biolabs, Beverly, Mass.). Recombinant plasmids were sequence verified before transformation into *Aspergillus* hosts.

SEQID-00087, SEQID-00103, SEQID-00105, SEQID-00115, SEQID-00218, SEQID-00298, SEQID-00302, SEQID-00341, SEQID-00352, SEQID-00354 genes were utilized.

*Aspergillus niger* Heterologous Nutritive Polypeptide Strain Construction.

A protease deficient derivate of *Aspergillus niger* D15#26 (E. Karnaukhova et al, Microbial Cell Factories, 6:34) was used as the expression host. 10 ug of Expression vectors were co-transformed with 1 ug plasmid containing pyrG selection marker using the protoplast method described in Punt et al., 1992, Methods in Enzymology, 216, 447-457. Transformants were selected on minimal media containing 10 g/l glucose, 6 g/l sodium nitrate, 20 ml/1 salts solution (containing 26 g/l potassium chloride and 76 g/l Potassium phosphate monobasic at, pH 5.5), 2 mM magnesium sulphate, 1 ml/l vitamin solution (containing 100 mg/l Pyridoxine hydrochloride, 150 mg/l Thiamine hydrochloride, 750 mg/l 4-Aminobenzoic acid, 2.5 g/l Nicotinic acid, 2.5 g/l riboflavin, 20 g/l choline chloride, and 30 mg/l biotin), and 1 ml/l of metals solution (containing 20 g/l Zinc sulfate heptahydrate (ZnSO4-7H2O), 11 g/l Boric acid (H3B03), 5 g/l Manganese (II) chloride tetrahydrate (MnCl2-4H2O), 5 g/l Iron (II) sulfate heptahydrate (FeSO4-7H2O), 1.7 g/l Cobalt(II) chloride hexahydrate (CoCl2-6H2O), 1.6 g/l Copper(11) sulfate pentahydrate (CuSO4-5H2O), 1.5 g/l Sodium molybdate dihydrate (NaMoO4-2H2O), and 5.0 g/l EDTA disodium salt dihydrate (Na2EDTA-2H2O) at pH 6.5) and supplemented with 1.2 M sorbitol and 1.5% bacto agar. Individual transformants were isolated on minimal media plates and allowed to grow at 30 C until they sporulated. Spores were harvested in water at stored at 4 C.

*Aspergillus niger* Heterologous Nutritive Polypeptide Expression Testing.

90 different primary transformants from each construct were inoculated into 1 ml of minimal media as defined above supplemented with 1 g/L casamino acids in 96 deep well culture blocks ($1^{st}$ MTP). Culture blocks were covered with porous adhesive plate seals and incubated for 72 hrs in a micro-expression chamber (Glas-Col, Terre Haute, Ind.) at 33° C. at 800 rpm. After the growth period, 0.5-ml aliquots of the culture supernatants were filtered first through a 25 µm/0.45-µm dual stage filter followed by a 0.22 µm filter. The filtrates were then assayed using an anti-FLAG ELISA method, as described herein, to determine the levels of secreted protein of interest (POI). At least five colonies from nine expression constructs excluding SEQID-00302 yielded positive signals in an anti-flag ELISA as reported in Table E15B. At least 5 primary transformants that showed positive signals in anti-FLAG ELISA assay from each of the nine expression strains were also streaked onto a fresh minimal media agar plate for single spore purification and retested for confirmation ($2^{nd}$ MTP).

Spores were harvested from the plate and inoculation was done with fresh spore crops with a density of approximately 1E9 spores/ml. 10 ul of these spore crops were added to 10 ml of minimal medium giving a start density of 1E6 spores/ml. *Aspergillus* spores were then grown at 33 C with 150 RPM for three days. After the growth period, aliquots of the culture supernatants were filtered first through a 25 µm/0.45-µm dual stage filter followed by a 0.22 µm filter. The filtrates were then analyzed using anti-FLAG ELISA, anti-flag western blot and SDS-PAGE described below.

Certain clones from different expression construct were grown using fresh spore crops with a final density of approximately. 1E6 spores/ml in one liter minimal media. *Aspergillus* spores were then grown at 33 C with 150 RPM for three days. After the growth period, aliquots of the culture supernatants were filtered first through a 25 µm/0.45-µm dual stage filter followed by a 0.22 µm filter. The filtrates were then analyzed using anti-FLAG ELISA, anti-flag western blot and SDS-PAGE described below. Any secreted protein above 39 mg/l in an anti-flag ELISA from a one liter shake flask were detected by an anti-FLAG western blot and SDS-PAGE.

TABLE E15B demonstrates the anti-flag ELISA results and anti-FLAG western blot results of different protein secretion in *Aspergillus niger*

| Seq ID # | ELISA 1st MTP (mg/l) | ELISA 2nd MTP (mg/l) | ELISA 10 ml shake flask (mg/l) | Western 10 ml shake flask | ELISA 1 litre shake flask (mg/l) |
|---|---|---|---|---|---|
| SEQID-00103 | 14.7-42.2 | 3.0-29.1 | 1.6-4.0 | ++ | 1.2-5.6 |
| SEQID-00105 | 1.4-20.2 | 0-2.1 | 0-2.4 | + | 0.2-1.6 |
| SEQID-00298 | 66.0-215.4 | 5.2-119.5 | 1.3-79.4 | +++ | 93.9-224.3 |
| SEQID-00897 | 11.9-21.4 | 3.6-17.5 | 0.6-2.2 | + | — |
| SEQID-00115 | 16.3-96.2 | 0-4.9 | 0.7-3.7 | − | — |
| SEQID-00218 | 28.2-69.3 | 0.4-191.7 | 2.1-13.3 | + | — |
| SEQID-00341 | 10.4-25.3 | 1.9-20.5 | 3.0-8.3 | +++ | 1.0-3.6 |
| SEQID-00352 | 27.1-207.6 | 0-16.2 | 0.7-245.70 | +++ | 39.0-124.3 |
| SEQID-00354 | 9.1-120.4 | 0-47.2 | 0.9-7.8 | +++ | 0-1.2 |

Example 16

Expression of Nutritive Polypeptides in Cultured Mammalian Cells

Gene Synthesis and Plasmid Construction. All genes were made synthetically (GeneArt, Life Technologies) and optimized for expression in *Homo Sapiens*. Genes encoding SEQID-00001, SEQID-00103, SEQID-00105, SEQID-00298 and SEQID-00363 were chosen for secretion in mammalian cells. All the genes were fused with 5' signal peptide sequence from Ig-kappa protein (METDTLLLWV-LLLWVPGSTGD) and HHHHHHHH tag in the 3' end. All the gene constructs were cloned to pcDNA 3.1 (+) vector (Life Technologies) downstream of pCMV promoter in the multiple cloning site of NheI and BamHI. All gene sequences contained the GCC sequence upstream of start codon to generate GCCATGG Kozak sequence. All plasmids were transformed in *E. coli*, sequence verified and 10 mg of each plasmid were purified for transfection into mammalian cells.

Strain Construction.

The cell lines selected for experimentation are 2 transient lines from Invitrogen, FreeStyle™ CHO-S Cells (PN 51-4448) and FreeStyle™ 293F Cells (PN 51-0029). Cell lines were received from Invitrogen and stored in liquid nitrogen until sub-culturing was initiated. For sub-culturing prior to transfection, cells were thawed into specific media: CHO-S cells were thawed into 30 mL of FreeStyle™ CHO Expression Media (Invitrogen PN 12651-014) supplemented with 8 mM Glutamax (Invitrogen PN 35050-061) and 1× HT (Invitrogen PN 11067-030). 293F cells were thawed into 30 mL FreeStyle™ 293 Expression Medium (Invitrogen PN 12338-018). Cells were allowed to recover in suspension for 72 hrs under 80% humidity, 8% Carbon Dioxide, 36.5° C., shaking at 110 rotations per minute. Cells were passed from viable cell densities (VCD) not exceeding 2.0×10 6 cells/mL to 0.2×10 6 cells/mL. Sub-culturing continued for 5 passages prior to transfection.

At 26 hrs prior to transfection the cultures were passed back to 0.6×10 6 viable cells/mL in a volume of 60 mL. Each nutritive polypeptide was transfected in duplicate with 2 mock transfections performed as control for each cell line. On the day of transfection cells were counted and determined to be at 1.1×10 6 cells/mL with greater than 98% viability.

Transfection Procedure.

Preparation of DNA-lipid complexes for 120 mL total volume (60 mL/250 mL shake flask) transfections.

The following procedure was performed in a Laminar Flow Hood. 150 μg of plasmid DNA were diluted into OptiPRO™ SFM Reduced Serum Medium (Invitrogen PN: 12307-050 to a total volume of 2.4 mL. This solution was mixed gently and 0.2 μm filter sterilized. Diluted 150 μL of FreeStyle™ MAX Reagent (Invitrogen PN 16447-100) in OptiPRO™ SFM Reduced Serum Medium to a total volume of 2.4 mL, mixed gently and incubated for 5 minutes at room temperature. After 5-minute incubation, the 2.4 mL of diluted DNA was added to the 2.4 mL of the diluted reagent, gently mixed and incubated for 20 min at room temperature to form the DNA-lipid complex. After 20-minute incubation, 2.4 mL of complex was added to each duplicate flask. Control Flask received 2.4 mL of OptiPRO™ SFM reduced serum medium. Transfected flasks were placed back in incubated shaker under 80% humidity, 8% Carbon Dioxide 36.5° C., shaking at 110 rotations per minute. Cultures were monitored for % Viability and VCD. All flasks were supplemented on Day 3 with a 20% Phytone Peptone Feed made in the media specific to each cell line. The final concentration of Phytone Peptone in the flask equaled 2%. Cultures were harvested on Day 4 via centrifugation and 0.2 um filtration of the supernatant. Supernatants were run on a non-reducing SDS-PAGE 12% Bis-Tris Gel to confirm expression of nutritive polypeptides at molecular weights. SEQID-00001, SEQID-00103, SEQID-00105, and SEQID-00298 were confirmed as being expressed from 293F cells but no visible bands could be detected in any of the CHO-S cultures. SEQID-00363 could not be visualized on the gel from either 293F or CHO-S cultures. Supernatants from 293F cultures for SEQID-00001, SEQID-00103, SEQID-00105, SEQID-00298, and SEQID-00363 as well as CHO-S supernatants for SEQID-00103 and SEQID-00105 were purified via IMAC. SEQID-00103, SEQID-00105, and SEQID-00298 were scaled up to 190 mL transfection volume in a 1 L shake flask using 293F cells. Transfection procedure was also scaled accordingly. 4×190 mL cultures for both SEQID-00103 and SEQID-00105 and 2×190 mL cultures for SEQID-00298 were run. On Day 2 these cultures were fed with the 20% Phytone Peptone feed to a final concentration of 2% in culture and were harvested on Day 5.

Example 17

Nutritive Polypeptide Expression Analysis

Nutritive polypeptides intracellularly expressed and/or secreted were detected using a variety of methods. These methods include electrophoresis, western blot, dot-blot, ELISA, and quantitative LC/MS/MS.

Electrophoresis Analysis.

Extracellular and/or intracellular expressed proteins were analyzed by chip electrophoresis (Labchip GXII) or SDS-PAGE analysis to evaluate expression level.

For SDS-PAGE, 10 µl sample in Invitrogen LDS Sample Buffer mixed with 5%β-mercaptoethanol was boiled and loaded onto either: 1) a Novex®, NuPAGE® 12% Bis-Tris gel (Life Technologies), or 2) a Novex®16% Tricine gel (Life Technologies), and run using standard manufacturer's protocols. Gels were stained using SimplyBlue™ SafeStain (Life Technologies) using the standard manufacturer's protocol and imaged using the Molecular Imager® Gel Doc™ XR+ System (Bio-Rad). Over-expressed heterologous proteins were identified by comparison against a molecular weight marker and control cultures.

For chip electrophoresis (Labchip GX II) samples were analyzed using a HT Low MW Protein Express LabChip® Kit (following the manufacturer's protocol) by adding 2 µl of sample to 7 µl sample buffer. A protein ladder was loaded every 12 samples for molecular weight determination and quantification (molecular weight in kDa).

LC-MS/MS Analysis.

Whole cell, cell lysate and secreted samples can be analyzed for protein expression using LC-MS/MS. To analyze samples, 10 µg of sample were loaded onto a 10% SDS-PAGE gel (Invitrogen) and separated approximately 2 cm. The gel was excised into ten segments and the gel slices were processed by washing with 25 mM ammonium bicarbonate, followed by acetonitrile. Gel slices were then reduced with 10 mM dithiothreitol at 60° C., followed by alkylation with 50 mM iodoacetamide at room temperature. Finally, the samples were digested with trypsin (Promega) at 37° C. for 4 h and the digestions were quenched with the addition of formic acid. The supernatant samples were then analyzed by nano LC/MS/MS with a Waters NanoAcquity HPLC system interfaced to a ThermoFisher Q Exactive. Peptides were loaded on a trapping column and eluted over a 75 µm analytical column at 350 nL/min; both columns were packed with Jupiter Proteo resin (Phenomenex). A 1 h gradient was employed. The mass spectrometer was operated in data-dependent mode, with MS and MS/MS performed in the Orbitrap at 70,000 FWHM resolution and 17,500 FWHM resolution, respectively. The fifteen most abundant ions were selected for MS/MS. Data were searched against an appropriate database using Mascot to identify peptides. Mascot DAT files were parsed into the Scaffold software for validation, filtering and to create a nonredundant list per sample. Data were filtered at 1% protein and peptide false discovery rate (FDR) and requiring at least two unique peptides per protein.

Anti-FLAG Western Blot.

Extracellular and/or intracellular protein was analyzed using western blot to evaluate expression level.

For SDS-PAGE, 10 µl sample in Invitrogen LDS Sample Buffer mixed with 5% β-mercaptoethanol was boiled and loaded onto a Novex® NuPAGE® 12% Bis-Tris gel (Life Technologies). For standards, 0.5 µg to 2 µg Amino-terminal FLAG-BAP™ Fusion Protein (Sigma) were loaded as a positive control. Gel electrophoresis was performed according to manufacturer's protocol. Once run, the gel was transferred onto an iBlot® Mini Transfer Stack nitrocellulose 0.2 µm pore size membrane (Life Technologies) according to manufacturer protocol. Next, the nitrocellulose membrane was removed from the stack and assembled into a Millipore SNAP i.d.® 2.0 Protein Detection Apparatus. 30 ml of Millipore Blok CH Noise Cancelling reagent was placed into an assembled reservoir tray and vacuumed through. 3 ml of antibody solution was prepared by diluting 2 µl of Sigma Monoclonal ANTI-FLAG® M2-Peroxidase (HRP) antibody into 3 ml of Millipore Blok CH Noise Cancelling Reagent. Antibody solution was added to reservoir tray and allowed to incubate for 10 minutes without vacuum. After incubation, the reservoir tray was filled with 90 ml of 1×PBS+0.1% Tween 20 and vacuumed through as the final wash step. After wash, the nitrocellulose membrane was removed and placed into a reagent tray. 20 ml of Millipore Luminata Classico Western HRP substrate was added and allowed to incubate for 1 minute. After incubation, the membrane was placed into imaging tray of Gel Doc™ XR+ System (Bio-rad) and imaged using a chemiluminescent protocol.

Anti-FLAG Dot Blot.

Extracellular and/or intracellular proteins were analyzed using dot blot to evaluate expression level.

110 µl of 0.2 µm filtered sample was mixed with 110 µl 8.0M Guanidine Hydrochloride, 0.1 M Sodium Phosphate (Denaturing Buffer) to allow for even protein binding. A standard curve of Amino-terminal FLAG-BAP™ Fusion Protein (Sigma) was prepared in the same matrix as the samples, starting at 2 µg, diluting 2× serially to 0.0313 µg. invitrogen 0.45 µm nitrocellulose membrane was pre-wet in 1×PBS buffer for 5 minutes and then loaded onto Bio-Rad Dot Blot Apparatus. 300 µl of PBS was vacuumed through to further wet the membrane. Next, 200 µl the 1:1 Sample: Denaturing Buffer mixture was loaded into each well and allowed to drain through the dot blot apparatus by gravity for 30 minutes. Next, a 300 µl PBS is wash was performed on all wells by vacuum followed by loading 300 µl of Millipore Blok CH Noise Cancelling reagent and incubating for 60 minutes. After blocking, membrane was washed with 300 µl of 1×PBS+0.1% Tween 20. Next, antibody solution was prepared by adding 2.4 µl of Sigma Monoclonal ANTI-FLAG® M2-Peroxidase (HRP) antibody to 12 ml of Millipore Blok CH Noise Cancelling reagent (1:5000 dilution). 100 µl of the resulting antibody solution was added to each well and allowed to incubate for 30 minutes by gravity. After antibody incubation, three final washes were performed with 300 µl 1×PBS+0.1% Tween 20 by vacuum. After washes, nitrocellulose membrane was removed and placed into a reagent tray. 20 ml of Millipore Luminata Classico Western HRP substrate was added and allowed to incubate for 1 minute. After incubation, membrane was placed into imaging tray of Gel Doc™ XR+ System (Bio-rad) and imaged using a chemiluminescent protocol.

Anti-FLAG ELISA.

Protein expression was detected by direct ELISA using an anti-FLAG antibody. Briefly, a dilution series (0.005-10 mg/mL) of FLAG fusion protein (Sigma) was prepared in 0.1 M NaHCO3 (pH 9.5). A dilution series (0.01-20 µg/mL) of FLAG fusion protein was also prepared in spent medium from an empty fungus culture diluted 10-fold in 0.1 M NaHCO3 (pH 9.5). Experimental cultured medium samples were diluted 10-fold in 0.1 M NaHCO3 (pH 9.5). The FLAG fusion protein dilution series and the experimental samples were then transferred (0.2 mL) to the wells of a Nunc-immuno™ Maxisorp™ (Thermo) 96-well plate and incubated overnight at 2-8° C. to facilitate protein adsorption. The following morning, plates were rinsed three times with Tris-buffered saline (TBS) containing 0.05% TWEEN 80 (TBST). The wells were blocked from non-specific protein binding by incubation with 0.2 mL of 1% non-fat dried milk dissolved in TBST for 1 h at room temperature. The plates were rinsed three more times with TBST and then incubated at room temperature for 1 h with 0.2 mL of the monoclonal antibody anti-FLAG M2-HRP (Sigma) diluted 1:2000 in blocking buffer. The plates were again rinsed three more times with TBST before incubation with 0.2 mL/well of SIGMAFAST™ o-phenylenediamine dihydrocholride (OPD) (Sigma) for 30 min at room temperature. The reaction was terminated with the addition of 0.05 mL/well of 1 M HCl and the absorbance of samples was measured at 492 nm on a spectrophotometer equipped with a plate reader.

Example 18

Therapeutic Liquid Formulations of Nutritive Polypeptides

Nutritive polypeptide sequences were administered for therapeutic purposes in a variety of liquid formulations. For example, the formulations utilized differ by protein concentration, solution pH, presence or absence of particulates, minerals, tastants, and/or excipient additives. In therapeutic liquid formulations, the concentration of protein ranges from 0.1% to 60% w/w in solution. In certain instances, a lower concentration is preferable. For example, SEQID-00105 has been dosed as low as 10%. In some cases a higher concentration is preferable. For example, SEQID-00105 and SEQID-00363 were dosed as 35% solutions. In some cases a nutritive polypeptide sequence is dosed at its maximum solubility, which varies by protein and is generally in the range of 0.1% to 60% w/w. Both SEQID-00105 and SEQID-00363 were shown to be a soluble liquid at 50% w/w in solution. In therapeutic liquid formulations, the solution pH generally ranges from 2 to 11. Protein solubility is known to be a strong function of solution pH (C. Tanford, Physical Chemistry of Macromolecules, p. 242, Wiley, New York, 1961.) In most cases, nutritive polypeptide sequences are least soluble at their isoelectric point (pI), and thus solution pH is often adjusted to be above or below the pI of the nutritive polypeptide sequence. This modulation of pH allows control over protein solubility. For example, SEQID-00105 and SEQID-00363 have isoelectric points near 4. These nutritive polypeptide sequences were purposely formulated at pH 8-9, so they would be above their pI. For example, SEQID-00587 has a pI of 9.7 and was purposely formulated at pH 7, so that it would be below its pI. Nutritive polypeptides that are soluble at their pI, can be formulated at their pI so that the liquid formulation does not require an additional buffering species to maintain the solution pH. In this case, the protein itself acts to buffer the solution pH, as its own amino acids are protonated and deprotonated. A protein solution formulated at the pI of the protein shows resistance to changes in pH when acid or base are added, indicating that the solution is, in fact, buffered by the protein itself. In some therapeutic liquid formulations, a nutritive polypeptide includes particulate matter. Particulate matter is visible to the eye, and/or it contains subvisible particulates (example soluble aggregates). Particulate matter is product-related, and/or it is foreign. Particulate matter occurs in suspension, as a slurry, and/or settles at the bottom of the solution. In some embodiments, particulate matter is desirable because wherein it is indigestible or slowly digestible in the stomach, it acts as a carrier delivering the nutritive polypeptide to the intestine. In some embodiments, particulate matter is desirable in a liquid formulation because it allows dosing the nutritive polypeptide above its limit of solubility. In the case of SEQID-00105, there is no visible particulate matter. SEQID-00424 was dosed with suspended particulate matter.

In therapeutic liquid formulations, a nutritive polypeptide sequence is typically formulated with one or more excipients dissolved in the formulation. Each excipient is included for a specific purpose. Buffers (examples: Tris, phosphate, ammonium bicarbonate, sodium carbonate, acetate, citrate, arginine) are added to control the solution pH. Sugars are added to control aggregation and solubility (examples: trehalose, glucose, sucrose, and mannitol). Detergents are added to control solubility and aggregation (examples tween, triton, CHAPS, and deoxycholate). Polyalcohols are added to control solubility and aggregation (glycerol, PEG). Chaotropes are added to increase protein solubility (example thiocyanate and urea). Antioxidants are added to prevent protein oxidation (examples ascorbic acid and methionine). Salts are added to increase protein solubility and/or are added to achieve a desired osmolality (example sodium chloride). SEQID-00105, SEQID-00363, SEQID-00426 were formulated in sodium phosphate and sodium chloride and dosed orally. SEQID-00587 and SEQID-00559 were formulated in ammonium bicarbonate and dosed orally. SEQID-00240 was formulated in sodium carbonate and dosed orally. Tastants were added to nutritive polypeptides to enhance the gustatory experience of the user, with successful result. Vanilla extract was added in combination with sucralose according to Tang et al. (Tang J E, Moore D R, Kujbida G W, Tarnopolsky M A, Phillips S M. J Appl Physiol (1985). 2009 September; 107(3):987-92). The qualitative benefit of enhanced flavor was documented by users as being "quite pleasant."

The two tables Table E18A and Table E18B summarize a number of administrations of nutritive polypeptides to humans and to rats.

TABLE E18A

Therapeutic liquid formulations of nutritive polypeptides used for human administration.

| | | | Human Administration | | |
|---|---|---|---|---|---|
| SEQID | Conc (g/L) | Protein dosed (g) | pH Buffer | NaCl | Tastants |
| SEQID-00105 | 350 | 35 | 8.7 2 mM phosphate | 6 mM | Each formulation contained 8 mL of |
| SEQID-00363 | 350 | 35 | 7 3 mM phosphate | 14 mM | vanilla extract per liter and 4 grams |

TABLE E18A-continued

Therapeutic liquid formulations of nutritive polypeptides used for human administration.
Human Administration

| SEQID | Conc (g/L) | Protein dosed (g) | pH | Buffer | NaCl | Tastants |
|---|---|---|---|---|---|---|
| SEQID-00105 | 117 | 20 | 8.7 | 2 mM phosphate | 6 mM | of sucralose per liter, according to |
| SEQID-00105 | 117 | 20 | 8.7 | 2 mM phosphate | 6 mM | Tang, et al. |
| SEQID-00363 | 117 | 20 | 7 | 3 mM phosphate | 14 mM | |
| SEQID-00426 | 117 | 20 | 7 | none | none | |

TABLE E18B

Therapeutic liquid formulations of nutritive polypeptides used for human administration.
Rat Administration

| SEQID | Conc (g/L) | dosage (mg protein per kg body weight) | pH | Buffer | NaCl |
|---|---|---|---|---|---|
| SEQID-00105 | 250 | 2,850 | 8.7 | 2 mM phosphate | 6 mM |
| SEQID-00105 | 250 | 2,850 | 8.7 | 2 mM phosphate | 6 mM |
| SEQID-00338 | 250 | 2,850 | 8.7 | 2 mM phosphate | 6 mM |
| SEQID-00338 | 250 | 2,850 | 8.7 | 2 mM phosphate | 6 mM |
| SEQID-00105 | 98 | 1,113 | 8.7 | 2 mM phosphate | 6 mM |
| SEQID-00240 | 135 | 1,539 | 10.8 | 25 mM Na2CO3 | 0 mM |
| SEQID-00105 | 156 | 1,781 | 8.7 | 2 mM phosphate | 6 mM |
| SEQID-00363 (a-mannosidase treated) | 229 | 2,850 | 7 | 3 mM phosphate | 14 mM |
| SEQID-00363 (hydrolyzed) | 250 | 2,850 | 7 | 3 mM phosphate | 14 mM |
| SEQID-00105 | 250 | 2,850 | 8.7 | 2 mM phosphate | 6 mM |
| SEQID-00105 | 250 | 2,850 | 8.7 | 2 mM phosphate | 6 mM |
| SEQID-00105 | 250 | 2,850 | 8.7 | 2 mM phosphate | 6 mM |
| SEQID-00105 | 250 | 2,850 | 8.7 | 2 mM phosphate | 6 mM |
| SEQID-00105 | 250 | 2,850 | 8.7 | 2 mM phosphate | 6 mM |
| SEQID-00338 | 250 | 2,850 | 8.7 | 2 mM phosphate | 6 mM |
| SEQID-00352 | 250 | 2,850 | 7 | 3 mM phosphate | 14 mM |
| SEQID-00363 | 250 | 2,850 | 7 | 3 mM phosphate | 14 mM |
| SEQID-00363 | 250 | 2,850 | 7 | 3 mM phosphate | 14 mM |
| SEQID-00423 | 250 | 2,850 | 7 | 3 mM phosphate | 14 mM |
| SEQID-00424 | 250 | 2,850 | 7 | 3 mM phosphate | 14 mM |
| SEQID-00425 | 250 | 2,850 | 7 | 3 mM phosphate | 14 mM |
| SEQID-00426 | 250 | 2,850 | 7 | none | 0 mM |
| SEQID-00426 | 250 | 2,850 | 7 | none | 0 mM |
| SEQID-00429 | 250 | 2,850 | 7 | 3 mM phosphate | 14 mM |
| SEQID-00559 | 250 | 2,850 | 7.7 | 25 mM NH4HCO3 | 0 mM |
| SEQID-00587 | 250 | 2,850 | 7.7 | 25 mM NH4HCO3 | 0 mM |

Example 19

Therapeutic Formulations of Nutritive Polypeptides

Alternative to soluble, homogenous, liquid formulations, nutritive polypeptides can be prepared alternatively. This example describes alternative nutritive polypeptide formulations such as slurries, gels, tablets and food ingredients.

Slurry Formulations.

Slurries are semiliquid mixtures that contain both soluble and insoluble material which generally appear as fine granules in solution. Nutritive polypeptide slurries are prepared when a nutritive polypeptide is either concentrated above its maximum solubility, or, when a lyophilized or freeze dried preparation of a nutritive polypeptide is resuspended above its maximum solubility. Optionally, addition of an emulsifier such as soy lecithin is added at a concentration between 0.1-1% to stabilize the homogeneity of a slurry (van Nieuwenhuyzen et al., 1999 Eur. Journal of Lipid Sci. and Tech.).

Gel Formulations.

Alternatively, nutritive polypeptides are formulated as gels. Gels are solid, jelly-like formulations that are generally formed through molecular cross linking. Nutritive polypeptides are formulated as gels through treatment with transglutaminase (EC Number 2.3.2.13). Transglutaminase can catalyze the cross linking of nutritive polypeptides between g-carboxamide groups of peptide bound glutamine residues and the e-amino groups of nutritive polypeptide bound lysine residues. This formation of a g-glutamyl-e-lysine cross links proteins in solution; thus, promoting gel formation.

Human transglutaminase is a calcium (Ca2+) dependent enzyme with a Kd for calcium in the range of 0.3-3 uM (Ahvazi et al., 2003 Journal of Biological Chemistry). Due to the precipitave effects of calcium in preparations of nutritive polypeptides, a microbial (*Streptomyces mobaraensis*) orthologue of transglutaminase has been identified that acts in a calcium-independent manner (Ando et al, 1989 Agric Biol Chem). To prepare a gelatinous preparation of nutritive polypeptides, nutritive polypeptides are solubly formulated at 250 g/L at neutral pH. Transglutaminase is spiked into the preparation at 10 EU per g nutritive polypeptide and allowed to react at 35° C. until adequate gel formation has occurred (Chen et al., 2003 Biomaterials).

Tablet Formulations.

Preparation of solid tablets of nutritive polypeptides is accomplished according to Sakarkar et al. 2009 (International Journal of Applied Pharmaceutics). Tablets are formulated as a mixture of nutritive polypeptides, excipients and binding agents. Tablets are composed of 50% w/w nutritive polypeptide, 26% w/w microcrystalline cellulose, 7.5 w/w sodium bicarbonate-citric acid mixture (70:30), 6.5% w/w lactose, 5.5% w/w magnesium stearate and bound by 4.5% w/w polyvinyl pyrrolidone solution in isopropanol. Tablets are dehumidified and granulated prior to compression into 100 mg tablets. Tablets are coated with 12.5% w/w ethyl cellulose solution in dichloromethane and diethyl phthalate as a plasticizer.

Inhalable Dry Powder.

Nutritive polypeptides are formulated to be administered as an inhalable dry powder as described in Lucas et al., 1998 Pharm Res. Nutritive proteins are co-processed with maltodextrin by spray-drying to produce model protein particles. Aerosol formulations are then prepared by tumble mixing protein powders with α-lactose monohydrate (63-90 μm) or modified lactoses containing between 2.5 and 10% w/w fine particle lactose (FPL) or micronised polyethylene glycol 6000. Powder blends are then characterized in terms of particle size distribution, morphology and powder flow.

Conventional Food Formulations.

Nutritive polypeptides are formulated as a food ingredients as dry, solid formulations. For example, nutritive polypeptides are incorporated into pasta dough by mixing dry nutritive polypeptide formulations into water, durum semolina, *Arabica* gum, mono- and diglycerides, fiber, yeast and citric acid. Dough is cut to shape, dried and packaged.

Example 20

In Vitro Screening of Amino Acids and Nutritive Polypeptides for GLP-1. Production Glucagon-like peptide-1 (GLP-1) is a peptide hormone, produced by L-cells of the intestine in response to multiple nutrient stimuli. GLP-1 is an incretin that decreases blood glucose levels by increasing insulin release from the pancreas. GLP-1 acts on other peripheral tissues increasing glucose uptake and storage in skeletal muscle and adipose tissue, decreasing the rate of gastric emptying, and decreasing hepatic glucose production (Baggio L L & D J Drucker. 2007. Biology of incretins: GLP-1 and GIP. *Gastroenterology.* 132:2131-2157). GLP-1 is a product of the post-translational cleavage of proglucagon to generate active GLP-1 (7-36) this is rapidly degraded after secretion by dipeptidyl peptidase IV (DPPIV) to GLP-1 (9-36).

Several mammalian gastrointestinal cell lines are used as models for L-cell secretion of GLP-1 (IEC-6 from rats, NCl-H716 and FHs74Int from Humans, and STC-1 and GLUTag from mice). The purpose of these experiments is to determine which amino acid combinations, nutritive protein digests, and/or full length nutritive proteins induce GLP-1 secretion in vitro.

The NCl-H716 cell line is obtained from the American Type Culture Collection (Catalog number ATCC® CCL-251TM, Manassas, Va.). RPMI-1640, Dulbecco's Modified Eagle Medium (DMEM) and Dulbecco's Phosphate Buffered Saline (DPBS) are obtained from Life Technologies (Catalog numbers 11875, 11965 and 14190, respectively; Carlsbad, Calif.). Penicillin-Streptomycin Solution is obtained from ATCC (Catalog number 30-2300, Manassas, Va.). Antibiotic-Antimycotic Solution (100×) is obtained from Sigma-Aldrich (Catalog number A5955, St. Louis, Mo.). Fetal bovine serum is obtained from GE Healthcare (Catalog number SH3007103HI, Wilmington, Mass.). Bovine serum albumin is obtained from Fisher Scientific (Catalog number BP1600-100, Pittsburgh, Pa.). Fatty-acid free bovine serum albumin is obtained from Sigma-Aldrich (Catalog number A7030, St. Louis, Mo.). Phenylmethyl sulfonyl fluoride (PMSF), a protease inhibitor, is obtained from Thermo Scientific (Catalog number 36978, Waltham, Mass.). Diprotin A, a DPPIV inhibitor, is obtained from Sigma-Aldrich (Catalog number 19759, St. Louis, Mo.). Tissue Protein Extraction Reagent (T-PER) is obtained from Thermo Scientific (Catalog number 78510, Waltham, Mass.). Active GLP-1 concentration is determined using the AlphaLisa GLP-1 (7-36 amide) Immunoassay Research Kit (Catalog number AL215, PerkinElmer, Waltham, Mass.) and read on an EnSpire Alpha plate reader (PerkinElmer, Waltham, Mass.). Data are analyzed using Microsoft Excel version 14.0.7128.5000 (Microsoft Corporation, Redmond, Wash.) and GraphPad Prism version 6.03 for Windows (GraphPad Software, La Jolla, Calif.). Krebs Ringer Buffer (KRB) is prepared and the AlphaLISA GLP-1 (7-36 amide) Immunoassay Research Kit is obtained from PerkinElmer (Catalog number AL215, Waltham, Mass.).

Ninety-six well plates are pre-coated with MatriGel. 80 μL of MatriGel is added to 5 mL Dulbecco's Modified Eagle Medium (DMEM) without glucose. 50 μL are added per well and the plate incubated at 37° C., 5% CO2 for 30 minutes. MatriGel solution is aspirated prior to addition of cells.

NCl-H716 cells are maintained in RPMI-1640 medium supplemented with 10% fetal bovine serum (FBS) and 1% Antibiotic-Antimycotic Solution and incubated in T-75 tissue culture flasks at 37° C., 5% CO2. Cells are passaged 1:3 or 1:6 every 2 to 3 days.

Cells are detached with 0.25% trypsin-EDTA incubated at 37° C., 5% CO2 and centrifuged at 750 rpm for 10 minutes to pellet cells. Cell pellet is washed twice with 1× Dulbecco's Phosphate Buffered Saline (DPBS) supplemented with 1% FBS and centrifuged at 750 rpm for 10 minutes to pellet cells. The cells are resuspended in Dulbecco's Modified Eagle Medium (DMEM) supplemented with 10% FBS and 1% penicillin/streptomycin and counted on a hemocytometer. Cells are diluted to 1.8×106 cells/mL and 200 μL added to each well of a 96 well plate pre-coated with Matri-Gel. Cells are incubated for 2 days at 37° C., 5% CO2.

Screening of GLP-1 Secretion to Amino Acid Treatments in NCl-H716 Cells

Following two day incubation, medium is aspirated and replaced with 200 μL Starvation Buffer [i.e. Krebs-Ringer Buffer (KRB) containing 50 μg/mL PMSF, 34 μg/mL Diprotin A, and 0.2% fatty-acid free bovine scrum albumin (BSA)] and incubated for 30 minutes at 37° C., 5% $CO_2$. Starvation buffer is then aspirated and replaced with 100 μL/well of treatment article in Starvation Buffer. Cells are stimulated with treatment article for 2 hours then medium is removed and frozen at −80° C. Treatment articles include individual amino acids, amino acid blends, nutritive protein digests, and/or full length nutritive proteins.

Determination of Active GLP-1 Concentration from Supernatant.

Supernatant is assayed for the active form of GLP-1 (7-36) NH2 using the AlphaLISA GLP-1 (7-36 amide) Immunoassay Research Kit (PerkinElmer, AL215) in accordance with the manufacturer's instructions. The standard is assayed in Assay Buffer supplemented to an equivalent concentration of Starvation Buffer. Alternatively, the active form of GLP-1 is measured using an enzyme-linked immunosorbent assay (ELISA) as described herein. Luminescence data from the AlphaLISA GLP-1 (7-36 amide) Immunoassay or GLP-1 ELISA is analyzed on Microsoft Excel and GraphPad Prism.

Duplicate sample concentrations are determined by non-linear regression using a 4 parameter logistic model of the standard following an x=log(x) transformation of the active GLP-1 concentration in GraphPad Prism 6. ANOVA and multiple comparison tests are conducted on GraphPad Prism 6.

Comparisons of the GLP-1 content from samples collected after test article treatment to those collected after vehicle control treatment describe the degree of GLP-1 secretion due to a test article over time. Comparison of this difference across treatments describes the differential effects of each amino acid, amino acid blend, nutritive protein digest, and nutritive protein treatment relative to the other, and provides a means of ranking their efficacy.

GLP-1 Secretion by Amino Acids

Figure 6:
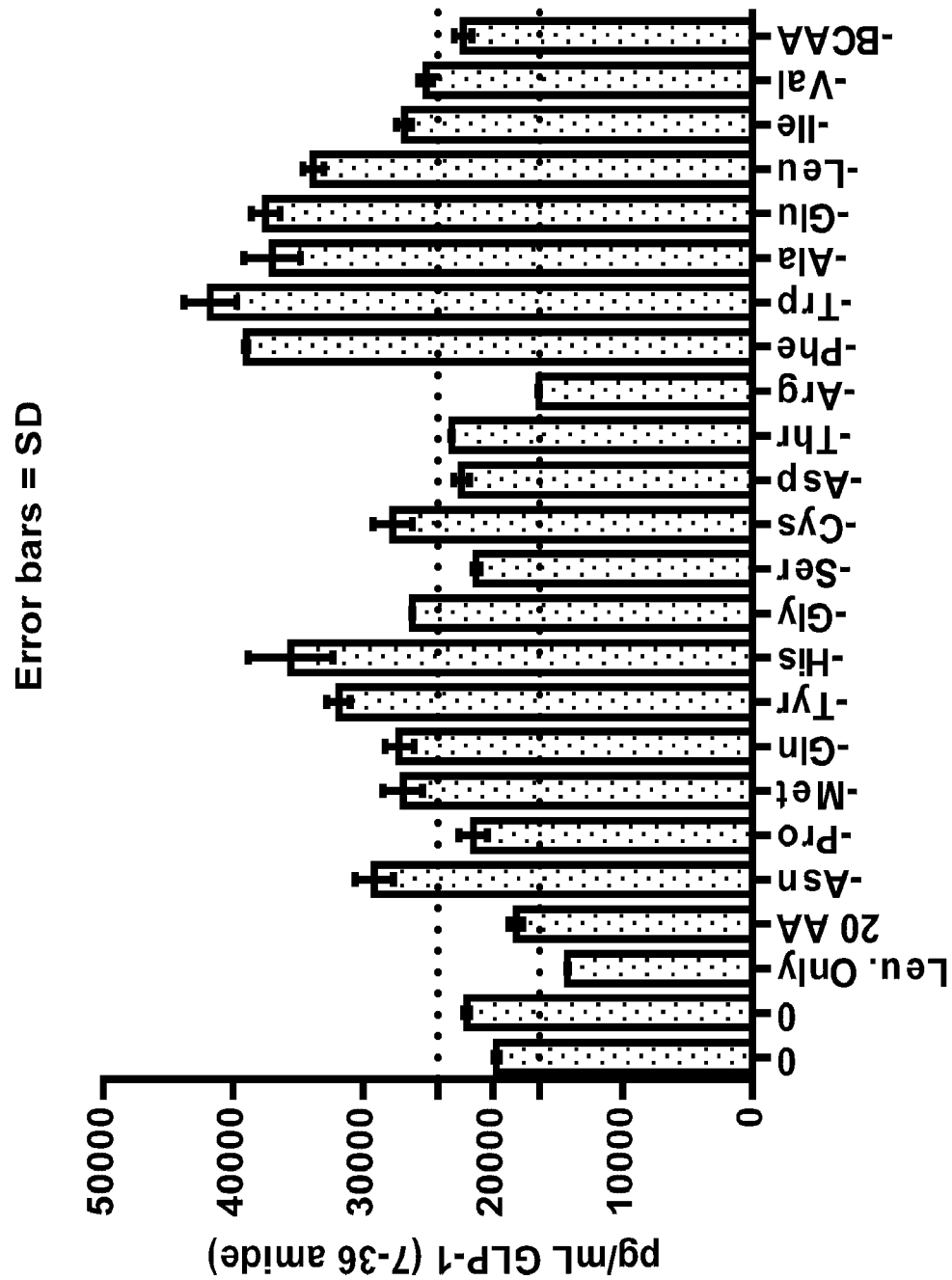
FIG. 6 is a chart demonstrating supernatant concentration of GLP-1 (7-36) detected in the supernatant following stimulation, error bars are the standard deviation of the technical replicates.

Cells were starved of amino acids as described herein and stimulated with stimulation buffer alone, 19 amino acids, 17 amino acids (without leucine, isoleucine or valine), 20 amino acids or leucine alone at their concentration in DME/F12 medium (see Table E20C) for two hours. Supernatant was harvested and frozen at −80° C. GLP-1 (7-36) amide concentration was assayed subsequently. FIG. 6 shows supernatant concentration of GLP-1 (7-36) detected in the supernatant following stimulation, error bars are the standard deviation of the technical replicates. Fourteen compositions increased the concentration of GLP-1 above 10% greater than that observed in the larger buffer only stimulation (those lacking either Asn, Met, Gln, Tyr, His, Gly, Cys, Phe, Trp, Ala, Glu, Leu, Ile and Val). Two compositions, amino acids lacking Arg & Leu only treatment, showed decreased concentration of GLP-1 (7-36) below 10% below the lower buffer only stimulation.

TABLE E20A

| Amino Acids | μM |
|---|---|
| Glycine | 250 |
| L-Alanine | 50 |
| L-Arginine | 700 |
| L-Asparagine | 57 |
| L-Aspartic Acid | 50 |
| L-Cysteine | 100 |
| L-Glutamic Acid | 100 |
| L-Glutamine | 2500 |
| L-Histidine | 150 |
| L-Isoleucine | 416 |
| L-Leucine | 451 |
| L-Lysine | 500 |
| L-Methionine | 116 |
| L-Phenylalanine | 215 |
| L-Proline | 150 |

TABLE E20A-continued

| Amino Acids | μM |
|---|---|
| L-Serine | 250 |
| L-Threonine | 449 |
| L-Tryptophan | 44 |
| L-Tyrosine | 214 |
| L-Valine | 452 |

Example 21

Use of Nutritive Polypeptides to Improve Glycemic Control in Healthy, Fasted Rats Glucose tolerance tests are a common method of measuring glycemic control in both clinical and preclinical settings. During the test, a large dose of glucose is given and blood samples are taken at subsequent time points to determine how quickly blood glucose levels renormalize. In an oral glucose tolerance test (OGTT), a dose of glucose is ingested by mouth. Such tests are clinically used to identify individuals with poor glucose control (Cobelli et al., 2014), and pre-clinically to assess the therapeutic efficacy of anti-diabetes medications (Wagman & Nuss, 2001)(Moller, 2001). Glucose levels are modulated by a number of different gastrointestinal hormones, including insulin, glucagon, somatostatin, glucose-dependent insulinotropic peptide (GIP), and glucagon-like peptide 1 (GLP-1), which both directly and indirectly modulate glucose levels. Combined measurements of glucose and gastrointestinal hormones are used to assess glucose intolerance, insulin resistance, and the severity of metabolic disease (Ferrannini & Mari, 2014).

An OGTT was performed on twenty five healthy, fasted, male Sprague-Dawley rats with indwelling jugular vein catheters (JVC) to assess the acute effects of nutritive polypeptide dosing on glycemic control as well as insulin and GLP-1 levels.

Oral Glucose Tolerance Test.

All rodents were approximately 10-12 weeks old, weighed average of approximately 350 g and acclimated for 4 days prior to testing. Animals were housed singly with bedding and fed a regular rodent chow diet (Lab Diet 5001) prior to the study. Housing temperature was at kept at 22±2° C., humidity at 50±20%, and a 12 hour light/12 hour dark cycle was implemented. Air circulation was ten or more air changes per hour with 100% fresh air. Prior to treatment, all rats were fasted overnight for fourteen hours. Fasted animals were treated with formulations of nutritive polypeptides dissolved in water by oral gavage (sec Table E21A), and fifteen minutes after treatment gavage were then challenged with an oral gavage of glucose (2 g/kg). Blood glucose was measured and blood was collected at seven time points (−15, 0, 15, 30, 60, 90, 120 minutes relative to the glucose challenge). Blood was collected in an EDTA collection tube containing plasma stablizers (a DPP4 inhibitor and a protease cocktail inhibitor). One additional rat was sacrificed at and bled out to provide nave blood for analytical standards. Glucose was measured using small drops of blood collected via the JVC using a glucometer (AlphaTrak 2, Abbott).

TABLE E21A

| Group | Dose (mg/kg) | Conc. (mg/mL) | Dose Volume (mL/kg) | Average BW (kg) | Total Protein (mg) | Glucose Volume (mL/kg) | Glucose Dose (g/kg) | Glucose Conc. (mg/mL) |
|---|---|---|---|---|---|---|---|---|
| Vehicle | NA | NA | 11.4 | 0.35 | NA | 4 | 2 | 500 |
| SEQID-00105 | 2850 | 250 | 11.4 | 0.35 | 5,985 | 4 | 2 | 500 |
| Arginine HCl | 1000 | 87.7 | 11.4 | 0.35 | 2,100 | 4 | 2 | 500 |
| SEQID-00338 | 2850 | 250 | 11.4 | 0.35 | 5,985* | 4 | 2 | 500 |

Approximately 300 µL of blood was collected from the JVC of all rats in Group 1-4 at six time points (−15, 0, 15, 30, 60, and 120 minutes). Glucose gavages and blood collections were timed to take the same amount of time per animal so that sample times were accurate for each animal. All time points were collected within 5% of the target time. Blood was collected into pre-chilled (0-4° C.) K2EDTA blood collection tubes containing Protease Inhibitor Cocktail (Catalog number D8340, Sigma-Aldrich, St. Louis, Mo.) and DPP1V inhibitor (Millipore, Billerica, Mass.) added to the tubes at 1:100 prior to collection. After blood collection, blood samples were maintained chilled (2-6° C.) and centrifuged within 30 minutes. The collected plasma was placed in sample tubes and immediately stored at −80° C.

Prior to immunoassay analysis samples were thawed on ice for 1 hour, mixed thoroughly by pipette, rearrayed to 96 well microplates. Separate aliquots were prepared for insulin immunoassay and GLP-1 immunoassay. Master plate and aliquots were stored frozen at −80° C.

Figure 7:
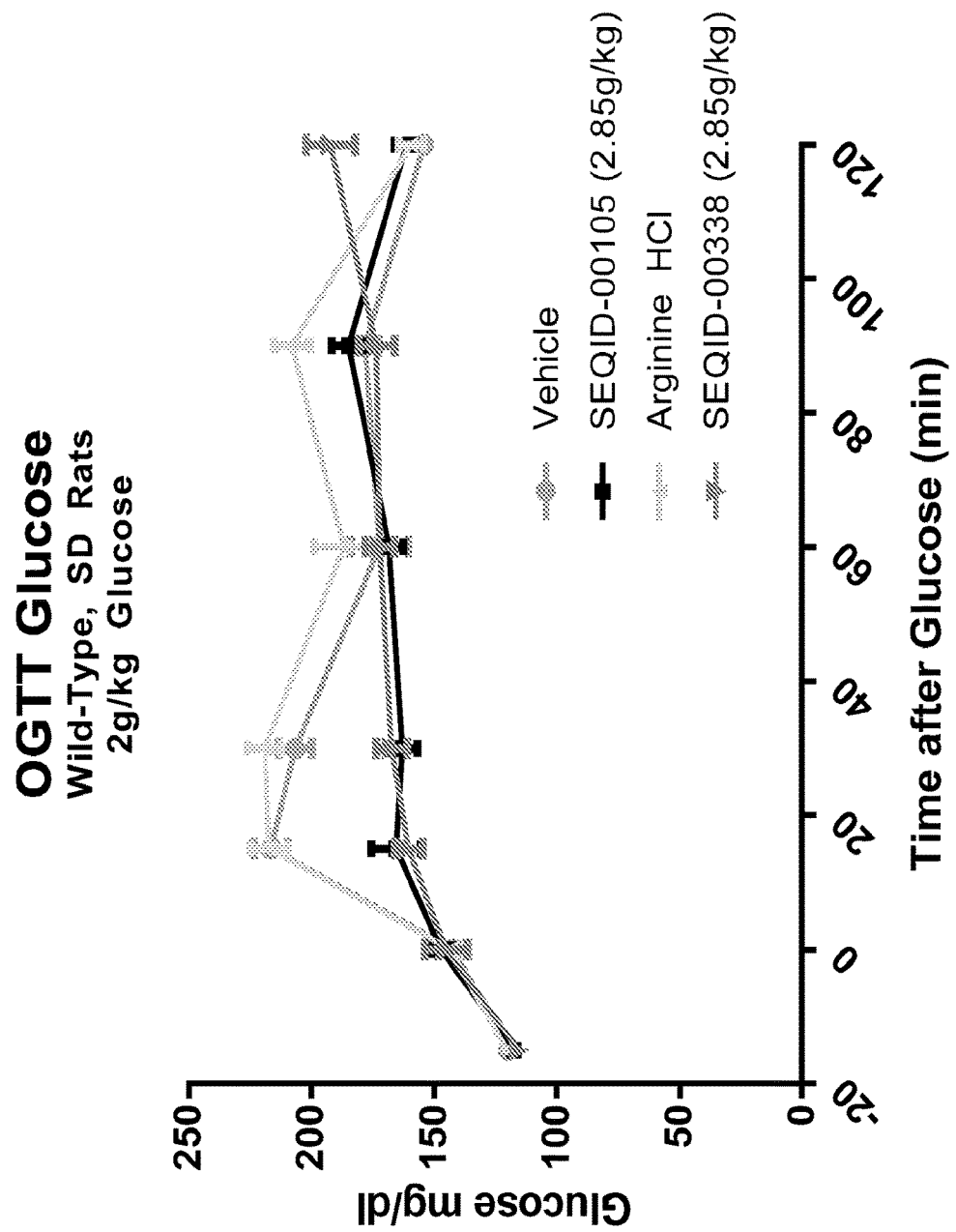
FIG. 7 is a chart demonstrating average blood glucose values over time during OGTT of vehicle, SEQID-00105, Arginine, and SEQID-00338. The error bars shown are the standard errors of the mean.

FIG. 7 shows the average blood glucose values during the OGTT described herein. The error bars shown are the standard errors of the mean. All groups showed significant differences in blood glucose from fasting at times t=15, and t=30 min after the glucose challenge (p<0.05, Dunnett multiple comparison test). The groups that received SEQID-00105 and SEQID-00338 showed a significant difference in blood glucose relative to vehicle at times t=15, and t=30 after the glucose challenge (p<0.05, Tukey-Kramer multiple comparison test, comparing treatment group to each other at each time point). These data indicated that acute ingestion of SEQID-00105 and SEQID-00338 can significantly improve glycemic control after a glucose challenge in outbred male Sprague-Dawley rats.

The area under curve for blood glucose was calculated using the Linear-Log Trapezoidal Method in Microsoft Excel, and statistical analysis was conducted on GraphPad Prism 6.

Figure 8A:
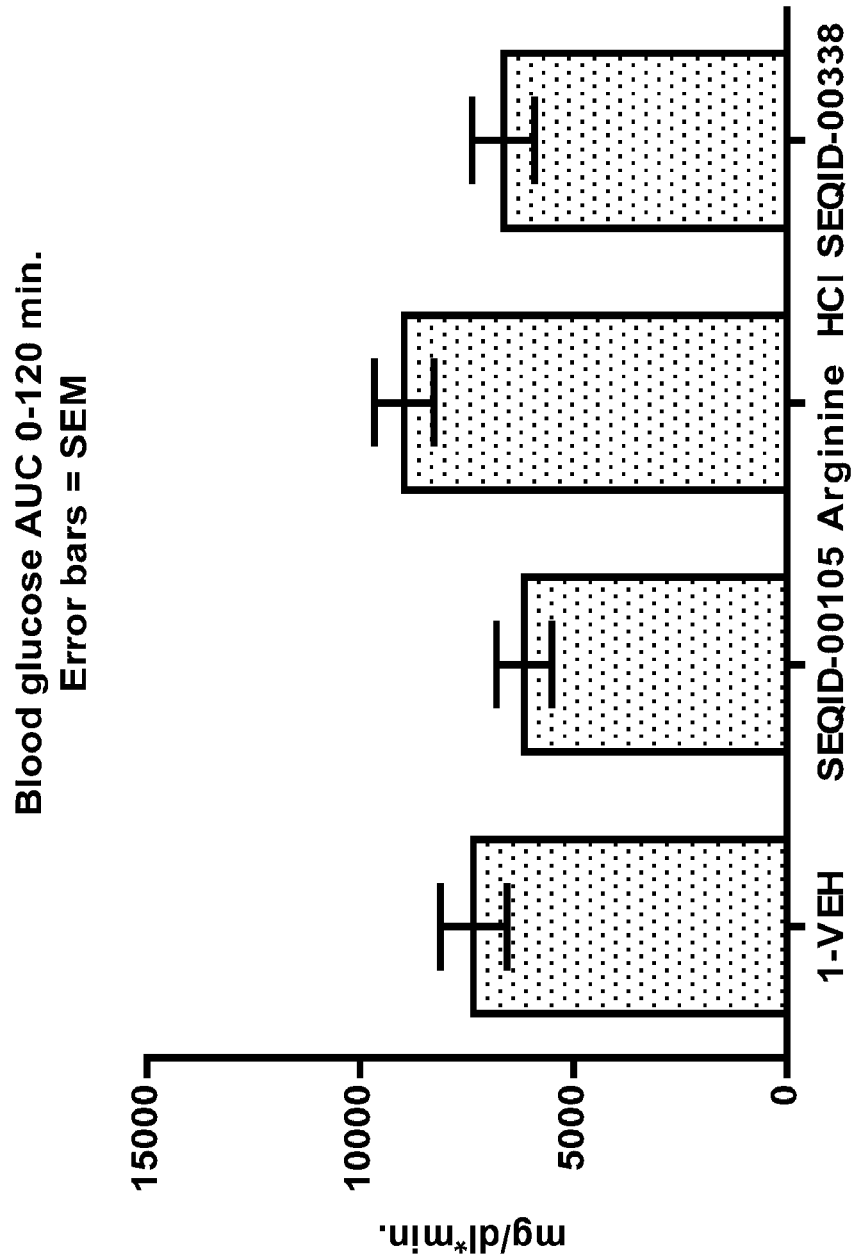
FIG. 8 is a chart demonstrating the area under curve for blood glucose integrated from 0-120 minutes (Left) and from 0-60 minutes (Right) after acute dosing of SEQID-00105, Arginine, and SEQID-00338.
Figure 8B:
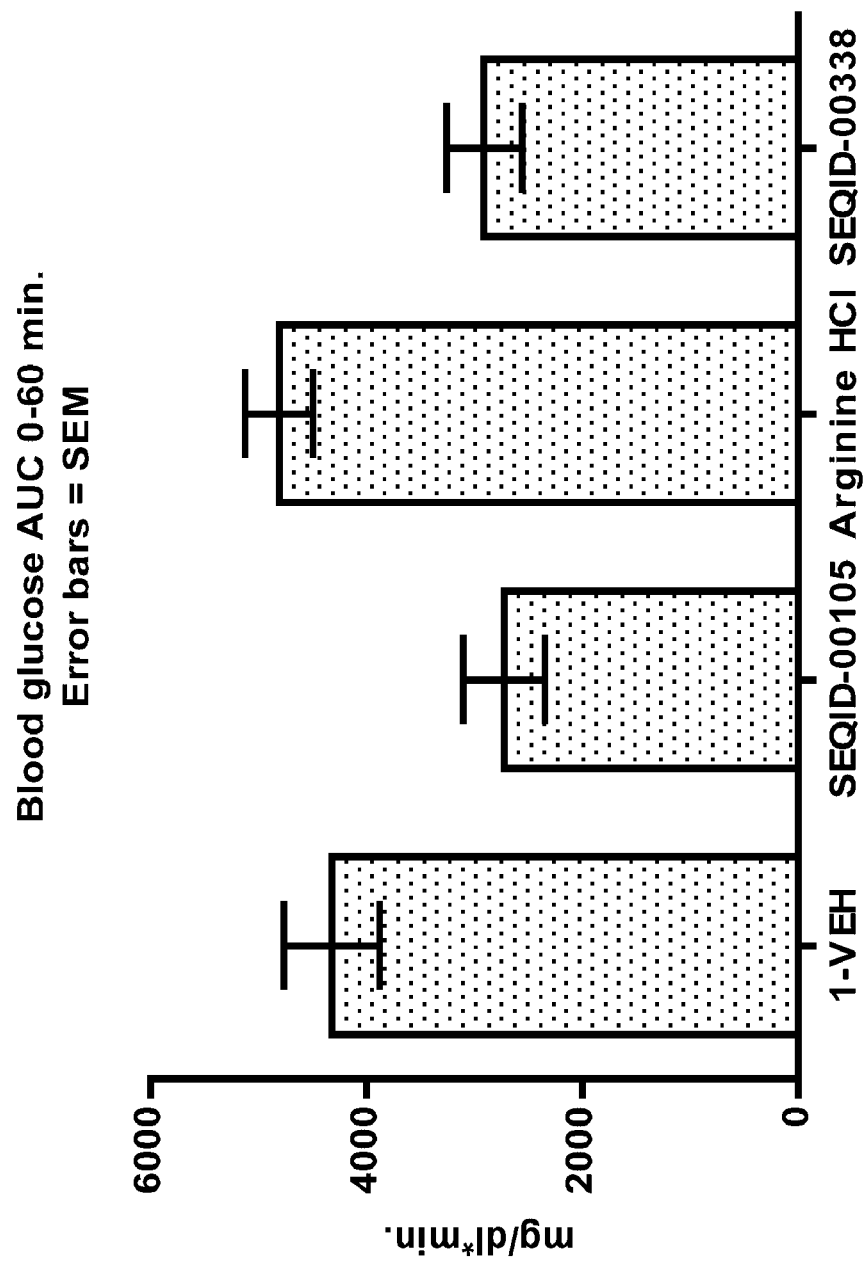

The area under curve for blood glucose integrated from 0-120 minutes and from 0-60 minutes (FIG. 8) show that acute dosing of SEQID-00105 and SEQID-00338 improves blood glucose control by reducing blood glucose excursion in the context of an oral glucose tolerance test. Between 0 and 60 minutes both SEQID-00105 and SEQID-00338 have significantly smaller change in blood glucose in comparison to vehicle (P<0.05, Dunnett's multiple comparisons test).

Rat Insulin Enzyme Linked Immunosorbent Assay (ELISA).

An Ultra-Sensitive Rat Insulin ELISA Kit was obtained from Crystal Chem, Inc. (Catalog number 90060, Downers Grove, Ill.). Plates were washed using a BioTek ELx50 microplate strip washer (BioTek, Winooski, Vt.). Absorbance was read on a Synergy Mx monochromator-based microplate reader (BioTek, Winooski, Vt.). Data was analyzed using Microsoft Excel version 14.0.7128.5000 (Microsoft Corporation, Redmond, Wash.) and GraphPad Prism version 6.03 for Windows (GraphPad Software, La Jolla, Calif.).

The ELISA kit was prewarmed to room temperature for 30 minutes prior to beginning the assay set up. The standard curve dilutions were prepared in accordance with the manufacturer's instructions for running the assay in Wide Range format.

Plasma matrix from the nave group and sample plasma were thawed on ice and then centrifuged at approximately 1000× ref for 10 minutes at 4° C. to pellet any insoluble material.

Matrix Assay Buffer for running the insulin standard was prepared using plasma matrix from the nave group to a concentration of 5.26% in 95 µL. 95 µL of Assay Buffer was added to all sample wells, and 95 µL of Matrix Assay Buffer was added to all standard wells. 5 µL of each sample and standard were added in duplicate. The plates were incubated at 4° C. for 2 hours. The plates were then washed five times with 300 µL/well 1× Wash Buffer. The plates were tapped sharply several times on paper towels to remove any residual wash buffer.

Anti-Insulin Enzyme Conjugate Working Solution was prepared by combining 2 volumes Anti-Insulin Enzyme Conjugate Stock with 1 volume Enyme Conjugate Diluent, and mixing by pipetting up and down and gently vortexing. 100 µL/well of Anti-Insulin Enzyme Conjugate Working Solution was added to all wells. The plates were sealed and incubated at room temperature for 30 minutes and then washed seven times with 300 µL/well 1× Wash Buffer. The plates were tapped sharply several times on paper towels to remove any residual wash buffer. 100 µL/well Enzyme Substrate Solution was then added to each well and incubated in the dark at room temperature for 40 minutes. 100 µL/well Stop Solution was added to all wells.

The absorbance was read on the Synergy Mx plate reader at 450 nm and 630 nm. Final values obtained were the A450 nm-A630 nm values.

The insulin standard curve was corrected for matrix concentration of insulin by subtracting the mean of the 0 ng/mL insulin standard from each of the standard well A450 nm-A630 nm values in Excel. Duplicate sample concentrations were determined by non-linear regression using a 4 parameter logistic model of the background corrected standard following an x=log(x) transformation of insulin concentration in GraphPad Prism 6. ANOVA and multiple comparison tests were conducted on GraphPad Prism 6. The area under curve was integrated using the Linear-Log Trapezoidal Method on Microsoft Excel, with post hoc testing conducted in GraphPad.

Figure 9:
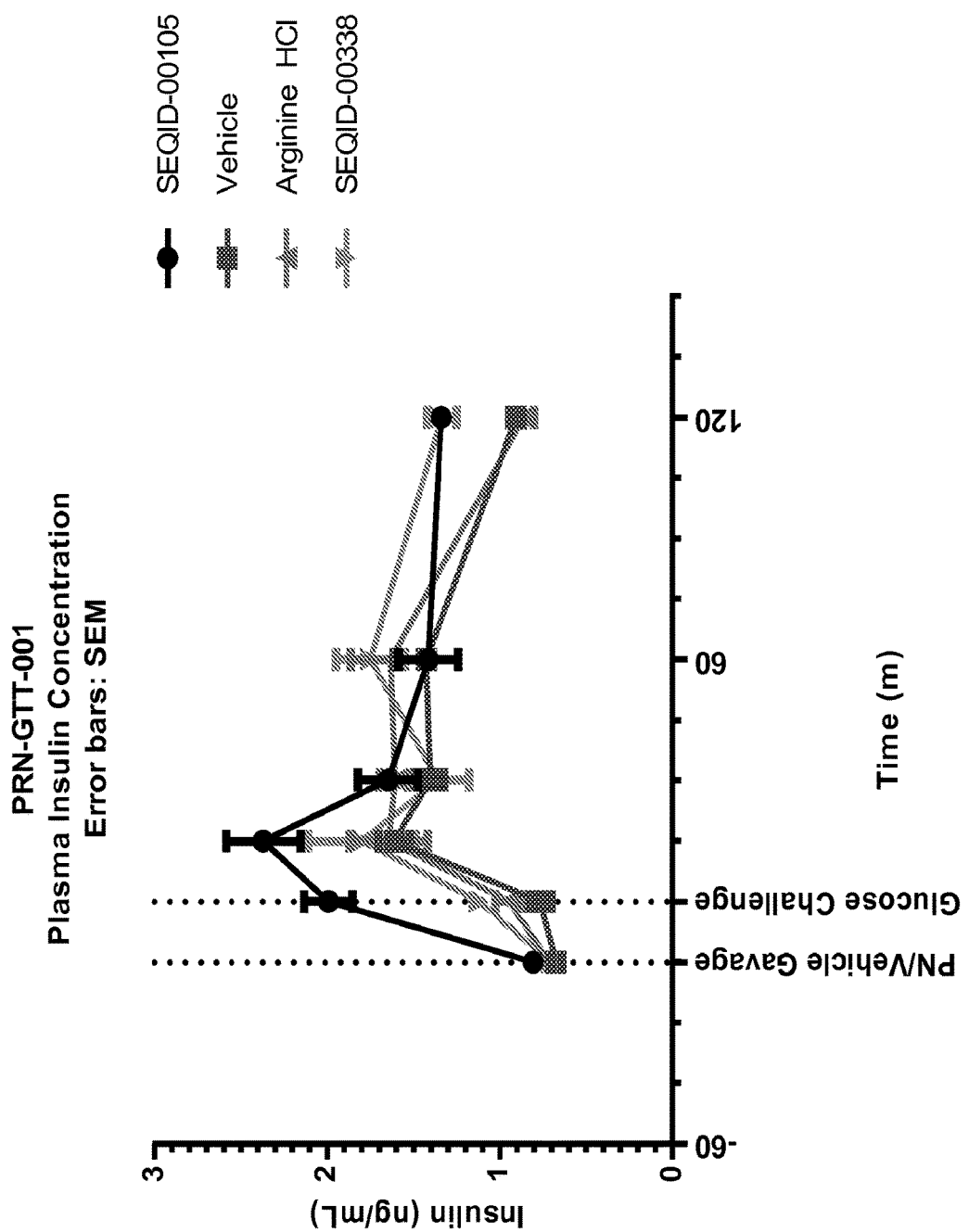
FIG. 9 is a chart demonstrating average plasma insulin concentration for n=6 rats per treatment group over time. The error bars show the standard error of the mean.

FIG. 9 shows the average plasma insulin concentration for n=6 rats per treatment group over the course of the experiment. The error bars show the standard error of the mean. All treatment groups had statistically significant increases in plasma insulin relative to their treatment or vehicle gavage at 15, 30 and 60 minutes following the glucose challenge (Dunnett's multiple comparisons test). Only SEQID-00105 had a statistically significant increase in plasma insulin concentration at the time of the glucose challenge (0) relative to the plasma insulin at the time of the treatment gavage (P<0.0001, Dunnett's multiple comparisons test). Both SEQID-00105 and SEQID-00338 had statistically significant greater insulin concentrations at 120 minutes following the glucose challenge (P<0.05 and P<0.01, respectively; Dunnett's multiple comparisons test).

In comparison to the vehicle, only SEQID-00105 showed a statistically significantly greater increase in plasma insulin concentration at the time of the glucose challenge (P<0.001, Dunnett's multiple comparisons test).

These data indicated that an acute ingestion of SEQID-00105 can stimulate insulin release within 15 minutes of ingestion in outbred male Sprague-Dawley rats.

Figure 10:
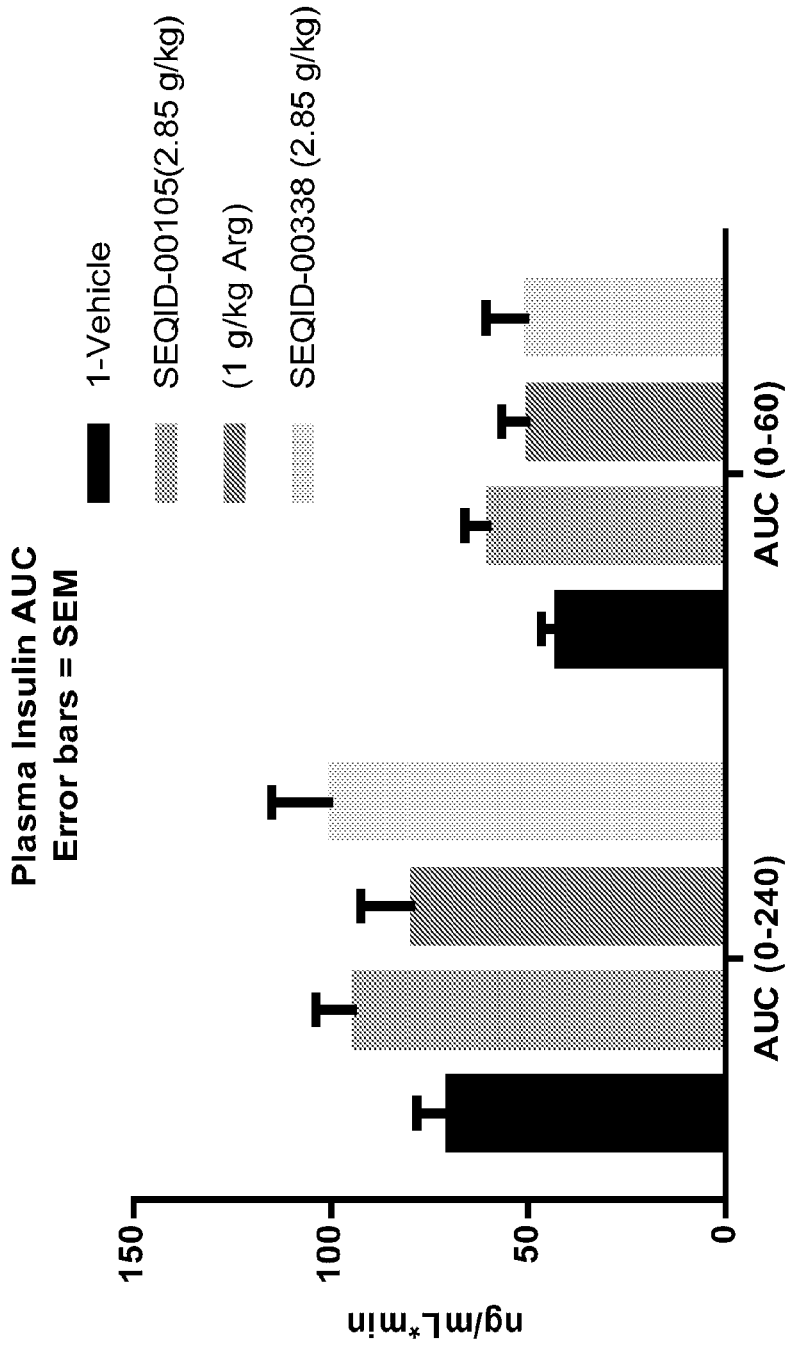
FIG. 10 is a chart demonstrating plasma insulin area under curve integrated between 0-240 and 0-60 minutes for all treatment groups. The error bars show the standard error of the mean.

FIG. 10 shows the area under curve integrated between 0-240 and 0-60 minutes for all treatment groups. No treatment group was statistically significantly greater than vehicle.

Total GLP-1 Enzyme Linked Immunosorbent Assay (ELISA).

A rat GLP-1 ELISA Kit was obtained from Crystal Chem, Inc. (Catalog number 81507, Downers Grove, Ill.). Plates were washed using a BioTek ELx50 microplate strip washer (BioTek, Winooski, Vt.). Absorbance was read on a Synergy Mx monochromator-based microplate reader (BioTek, Winooski, Vt.). Data was analyzed using Microsoft Excel version 14.0.7128.5000 (Microsoft Corporation, Redmond, Wash.) and GraphPad Prism version 6.03 for Windows (GraphPad Software, La Jolla, Calif.).

The ELISA kit was prewarmed to room temperature for 30 minutes prior to beginning the assay set up. The standard curve dilutions were prepared in accordance with the manufacturer's instructions.

Plasma matrix from Group 5 and sample plasma were thawed on ice and then centrifuged at approximately 1000× ref for 10 minutes at 4° C. to pellet any insoluble material.

Matrix Assay Buffer for running the GLP-1 standard was prepared using plasma matrix from the nave group to a concentration of 25% in 100 µL. The ELISA microplates were washed three times with 350 µL/well 1× Wash Buffer and tapped sharply on paper towels to remove residual wash buffer. 100 µL of Assay Buffer was added to all sample wells, and 100 µL of Matrix Assay Buffer was added to all standard wells. 25 µL of each sample and standard were added in duplicate. Wells were mixed by pipetting. The plates were covered with adhesive foil and incubated for 18 hours at room temperature on a horizontal plate shaker at 100 rpm. The plates were then washed three times with 350 µL/well 1× Wash Buffer then tapped sharply several times on paper towels to remove any residual wash buffer. 100 µL/well of Biotin Labeled Antibody Solution was added to all wells. The plates were then sealed and incubated at room temperature for 1 hour on a horizontal plate shaker at 100 rpm. The plates were then washed three times with 350 µL/well 1× Wash Buffer then tapped sharply several times on paper towels to remove any residual wash buffer. 100 µL/well SA-HRP Solution was added to all wells. The plates were then sealed and incubated at room temperature for 30 minutes on a horizontal plate, shaker at 100 rpm. The plates were then washed three times with 350 µL/well 1× Wash Buffer then tapped sharply several times on paper towels to remove any residual wash buffer. 100 µL/well Enzyme Substrate Solution was added to all wells. The plates were then sealed and incubated in the dark, without shaking, for 30 minutes at room temperature. Following substrate incubation, 100 µL Stop Solution was added to all wells.

The absorbance values were read on the Synergy Mx plate reader at 450 nm and 630 nm. Final values obtained were the A450 nm-A630 nm values.

The standard curve was corrected for matrix concentration of total GLP-1 by subtracting the mean of the 0 µM GLP-1 standard from each of the standard well A450 nm-A630 nm values in Excel. Duplicate sample concentrations were determined by non-linear regression using a 4 parameter logistic model of the background corrected standard following an x=log(x) transformation of GLP-1 concentration. ANOVA and multiple comparison tests were conducted using GraphPad Prism 6. The area under curve was integrated using the Linear-Log Trapezoidal Method on Microsoft Excel, with post hoc testing conducted in GraphPad.

Figure 11:
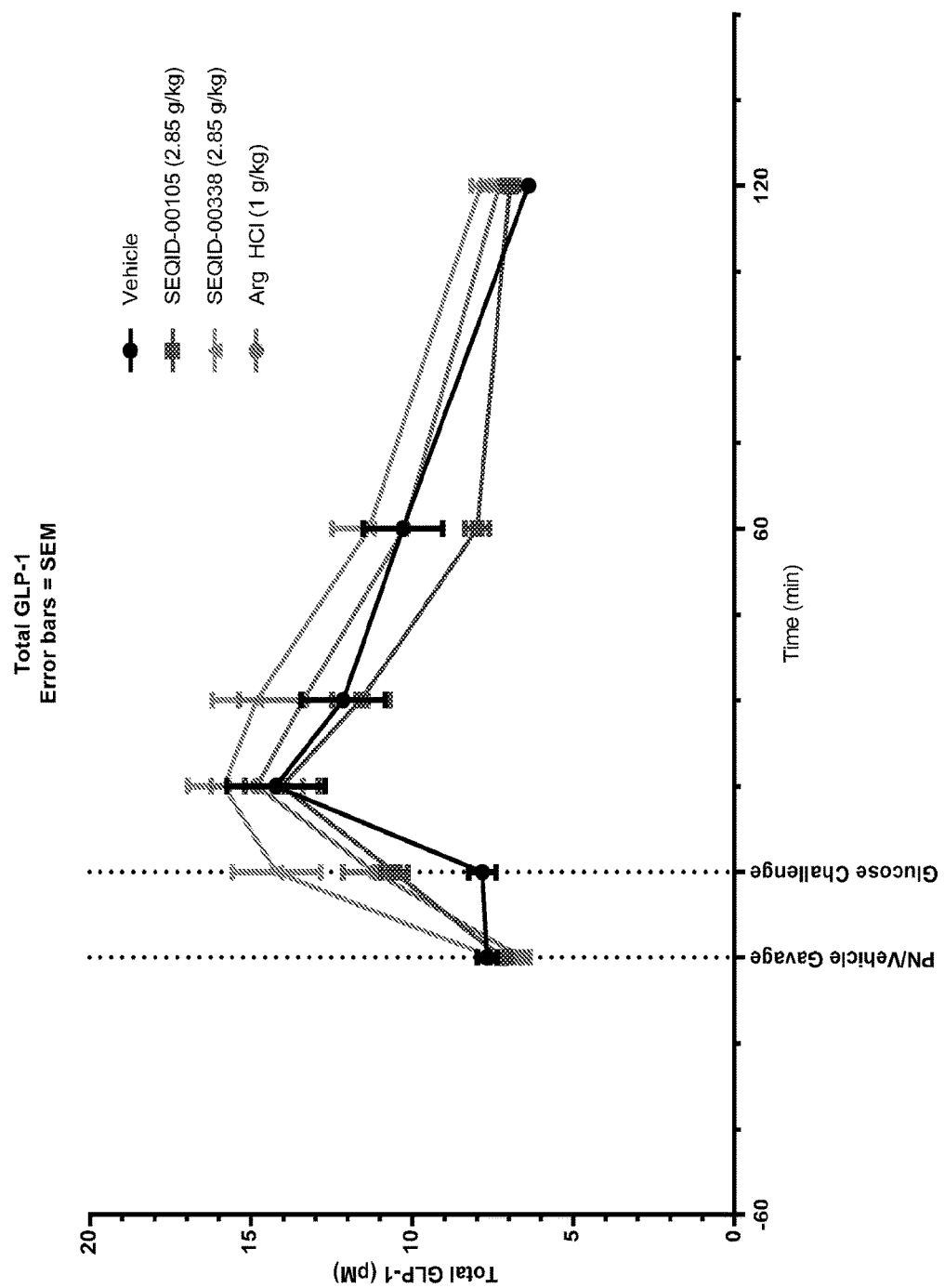
FIG. 11 is a chart demonstrating average plasma GLP-1 concentration for n=6 rats per treatment group over time. The error bars shown here correspond to the standard error of the mean.

FIG. 11 shows average plasma GLP-1 concentration for n=6 rats per treatment group over the course of the experiment. The error bars shown here correspond to the standard error of the mean. The SEQID-00338 treatment group shows a statistically significant greater concentration of GLP-1 at the time of the glucose challenge than vehicle (p<0.0005, Dunnett's multiple comparisons test).

Example 22

Use of Nutritive Polypeptides to Improve Glycemic Control in Zucker Fatty (Fa/Fa) Rats An OGTT was performed in 18, fasted, male Zucker fatty rats with indwelling jugular vein catheters (JVC) to assess the acute effects of nutritive polypeptide dosing on glycemic control as well as insulin and GLP-1 levels.

Oral Glucose Tolerance Test.

All rodents were approximately 10-11 weeks old, weighed average of approximately 450 g and acclimated for 4 days prior to testing. Animals were housed singly with bedding and fed a regular rodent chow diet (Lab Diet 5001) prior to the study. Housing temperature was at kept at 22±2° C., humidity at 50±20%, and a 12 hour light/12 hour dark cycle was implemented. Air circulation was ten or more air changes per hour with 100% fresh air. Prior to treatment, all rats were fasted overnight for fourteen hours. Fasted animals were treated with formulations of nutritive polypeptides dissolved in water by oral gavage (see Table E22A), and fifteen minutes after treatment gavage were then challenged with an oral gavage of glucose (5 g/kg). Blood glucose was measured and blood was collected at seven time points (−15, 0, 15, 30, 60, 90, 120 minutes relative to the glucose challenge). Blood was collected in an EDTA collection tube containing plasma stablizers (a DPP4 inhibitor and a protease cocktail inhibitor). One additional rat was sacrificed at and bled out to provide nave blood for analytical standards. Glucose was measured using small drops of blood collected via the JVC using a glucometer (AlphaTrak 2, Abbott).

TABLE E22A

| | | | Polypeptides | | Glucose |
|---|---|---|---|---|---|
| Group | Body weight (average, g) | SEQID | Dose (mg/kg) | Volume (ml/kg) | Dose (g/kg) |
| 1 | 450 | Vehicle | 0 | 11.4 | 5 |
| 2 | 450 | 00105 | 2850 | 11.4 | 5 |
| 3 | 450 | 00338 | 2850 | 11.4 | 5 |

Approximately 300 µ of blood was collected from the JVC of all rats in Group 1-3 at six time points (-15, 0, 15, 30, 60, 90, and 120 minutes). Glucose gavages and blood collections were timed to take the same amount of time per animal so that sample times were accurate for each animal. All time points were collected within 5% of the target time. Blood was collected into pre-chilled (0-4° C.) K2EDTA blood collection tubes containing Protease Inhibitor Cocktail (Catalog number D8340, Sigma-Aldrich, St. Louis, Mo.) and DPPIV inhibitor (Millipore, Billerica, Mass.) added to the tubes at 1:100 prior to collection. After blood collection, blood samples were maintained chilled (2-6° C.) and centrifuged within 30 minutes. The collected plasma was placed in sample tubes and immediately stored at −80° C.

Prior to immunoassay analysis samples were thawed on ice for 1 hour, mixed thoroughly by pipette, rearrayed to 96 well microplates. Separate aliquots were prepared for insulin immunoassay and GLP-1 immunoassay. Master plate and aliquots were stored frozen at −80° C.

Figure 12:
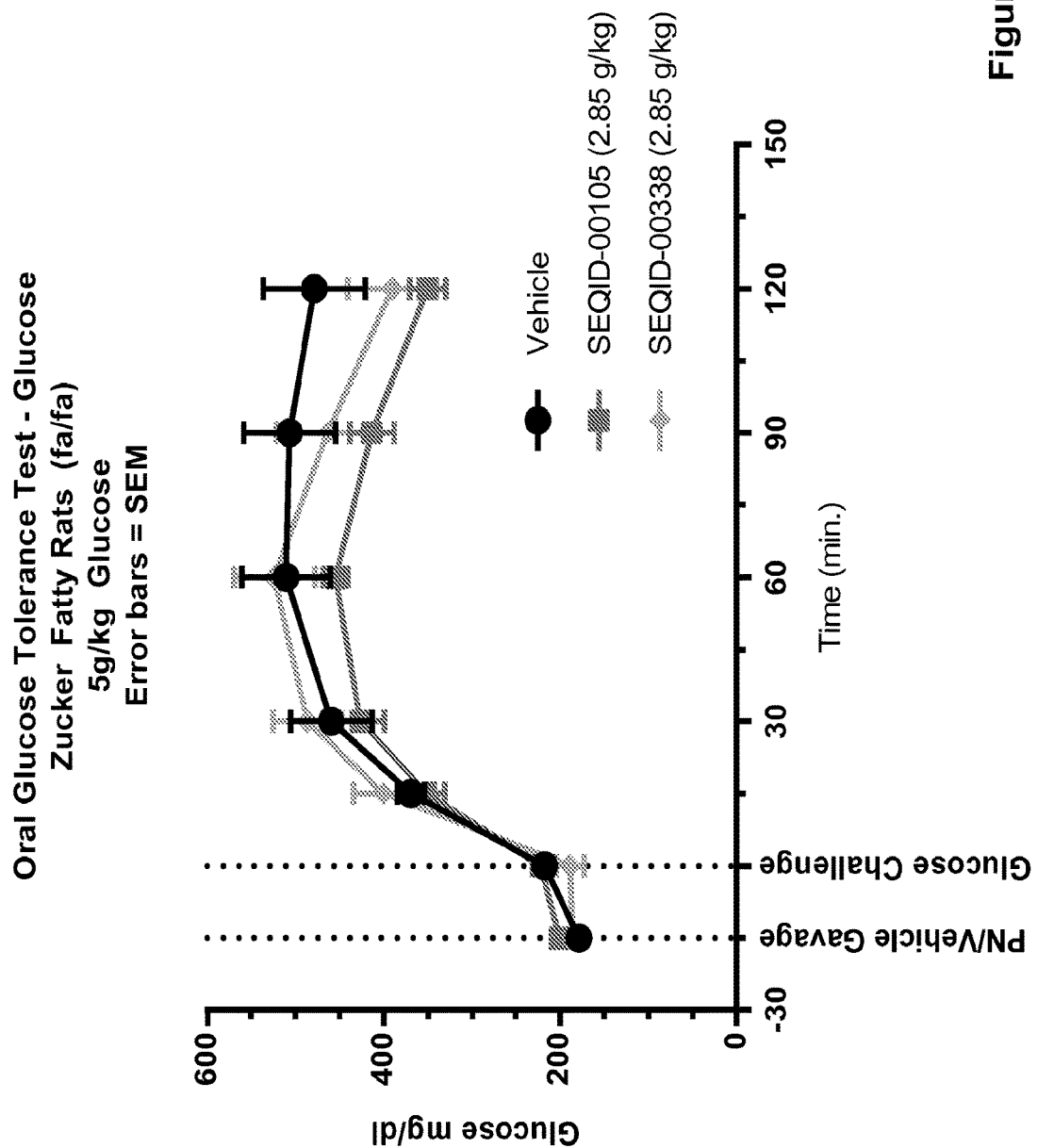
FIG. 12 is a chart demonstrating average blood glucose values over time. The error bars shown are the standard errors of the mean.

FIG. 12 shows the average blood glucose values during the OGTT described herein. The error bars shown are the standard errors of the mean.

The integrated area under curve (AUC) was calculated on Microsoft Excel using the Linear-Log Trapezoidal Method and statistical testing was conducted on GraphPad Prism 6.03.

Figure 13:
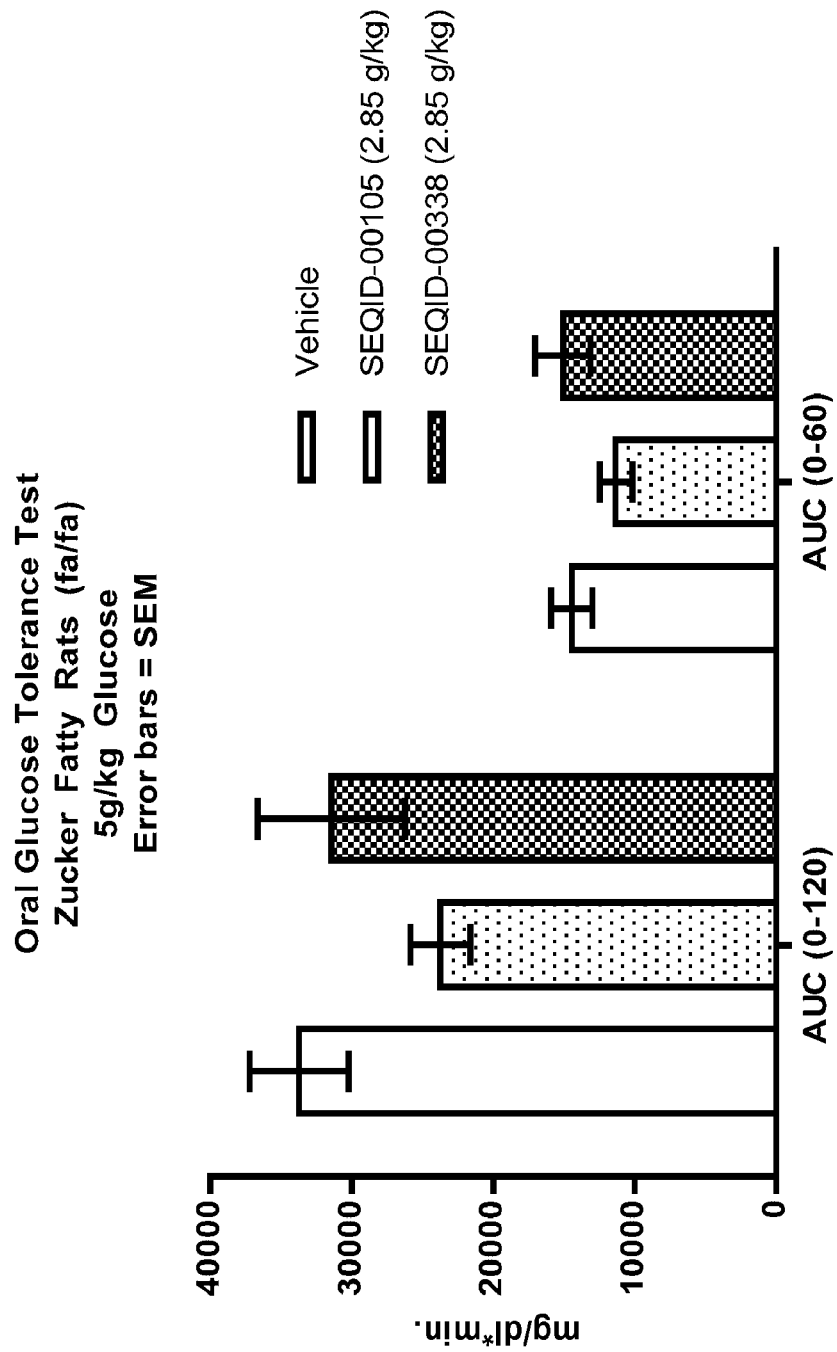
FIG. 13 is a chart demonstrating integrated AUC for each treatment group between the time of glucose challenge (0 min.) and 60 minutes, and between time 0 and 120 minutes. The error bars shown are the standard errors of the mean.

FIG. 13 shows the integrated AUC for each treatment group between the time of glucose challenge (0 min.) and 60 minutes, and between time 0 and 120 minutes. No treatment showed statistically significant difference from vehicle between time 0 and 60 minutes. Between time 0 and 120 minutes SEQID-00105 but not SEQID-00338 shows a statistically significant decrease in integrated area under curve compared to vehicle (P<0.005, Dunnett's multiple comparisons test). These data show that acute dosing of SEQID-00105 can reduce glucose excursion due to an oral glucose challenge in a Zucker Fatty (fa/fa) model rodent model.

Rat Insulin Enzyme Linked Immunosorbent Assay (ELISA).

An Ultra-Sensitive Rat Insulin ELISA Kit was obtained from Crystal Chem, Inc. (Catalog number 90060, Downers Grove, Ill.). Plates were washed using a BioTek ELx50 microplate strip washer (BioTek, Winooski, Vt.). Absorbance was read on a Synergy Mx monochromator-based microplate reader (BioTek, Winooski, Vt.). Data was analyzed using Microsoft Excel version 14.0.7128.5000 (Microsoft Corporation, Redmond, Wash.) and GraphPad Prism version 6.03 for Windows (GraphPad Software, La Jolla, Calif.).

The ELISA kit was prewarmed to room temperature for 30 minutes prior to beginning the assay set up. The standard curve dilutions were prepared in accordance with the manufacturer's instructions for running the assay in Wide Range format.

Plasma matrix from the naïve group and sample plasma were thawed on ice and then centrifuged at approximately 1000×ref for 10 minutes at 4° C. to pellet any insoluble material.

Matrix Assay Buffer for running the insulin standard was prepared using plasma matrix from the nave group to a concentration of 5.26% in 95 µL. 95 µL of Assay Buffer was added to all sample wells, and 95 µL of Matrix Assay Buffer was added to all standard wells. 5 µL of each sample and standard were added in duplicate. The plates were incubated at 4° C. for 2 hours. The plates were then washed five times with 300 µL/well 1× Wash Buffer. The plates were tapped sharply several times on paper towels to remove any residual wash buffer.

Anti-Insulin Enzyme Conjugate Working Solution was prepared by combining 2 volumes Anti-Insulin Enzyme Conjugate Stock with 1 volume Enzyme Conjugate Diluent, and mixing by pipetting up and down and gently vortexing. 100 µL/well of Anti-Insulin Enzyme Conjugate Working Solution was added to all wells. The plates were sealed and incubated at room temperature for 30 minutes and then washed seven times with 300 µL/well 1× Wash Buffer. The plates were tapped sharply several times on paper towels to remove any residual wash buffer. 100 µL/well Enzyme Substrate Solution was then added to each well and incubated in the dark at room temperature for 40 minutes. 100 µL/well Stop Solution was added to all wells.

The absorbance was read on the Synergy Mx plate reader at 450 nm and 630 nm. Final values obtained were the A450 nm-A630 nm values. Samples in which the value exceeded the standard curve were rerun at 1:1 dilution against a 2.5% matrix standard The insulin standard curve was corrected for matrix concentration of insulin by subtracting the mean of the 0 ng/mL insulin standard from each of the standard well A450 nm-A630 nm values in Excel. Duplicate sample concentrations were determined by non-linear regression using a 4 parameter logistic model of the background corrected standard following an x=log(x) transformation of insulin concentration in GraphPad Prism 6. ANOVA and multiple comparison tests were conducted on GraphPad Prism 6. The area under curve was integrated using the Linear-Log Trapezoidal Method on Microsoft Excel, with post hoc testing conducted in GraphPad.

Figure 14:
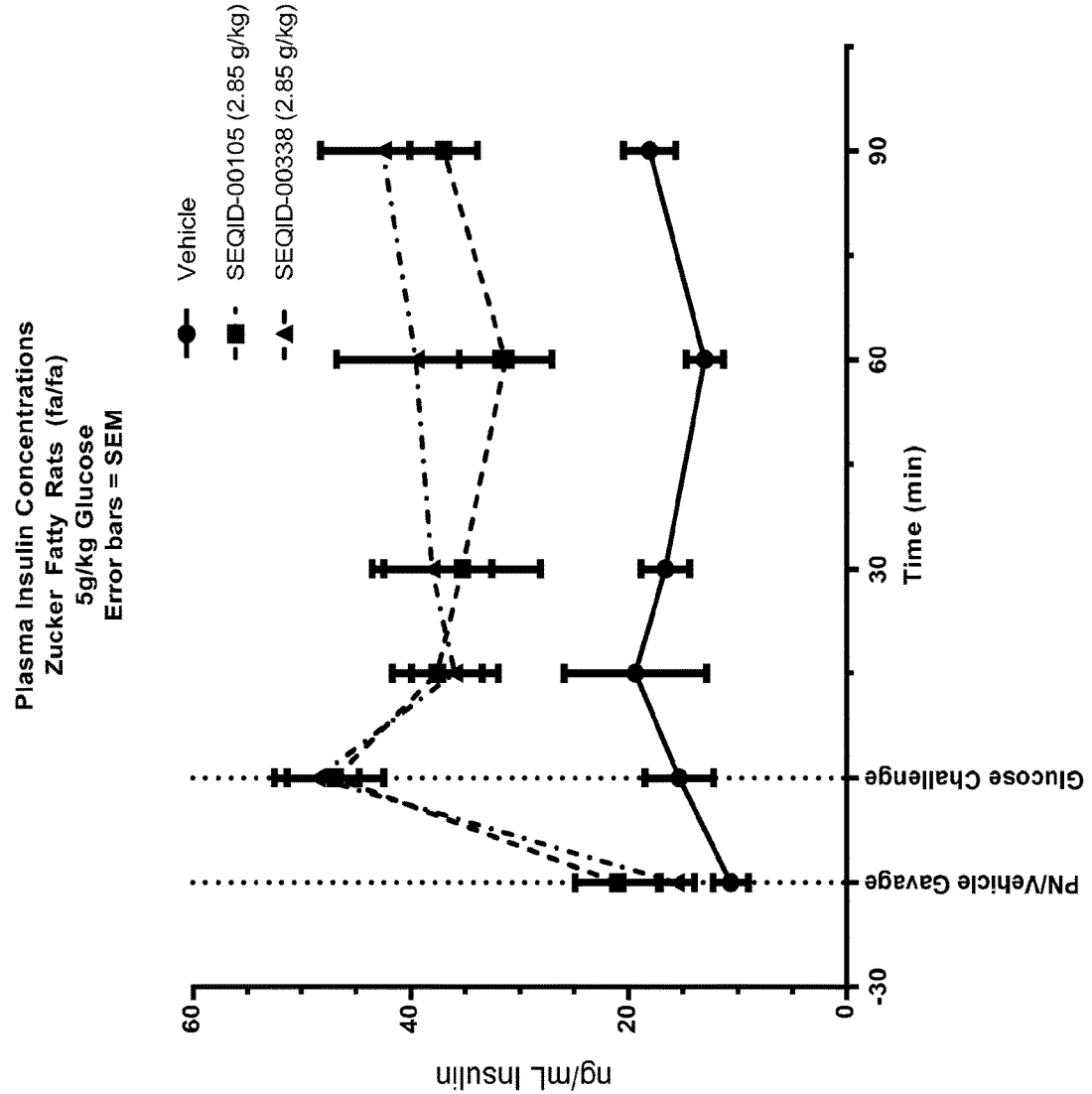
FIG. 14 is a chart demonstrating average plasma insulin concentration for n=6 rats per treatment group in vehicle & SEQID-00105 and n=5 rats per treatment group in the case of SEQID-00338 over the course of the experiment. The error bars shown are the standard errors of the mean.

FIG. 14 shows the average plasma insulin concentration for n=6 rats per treatment group in Vehicle & SEQID-00105 and n=5 rats per treatment group in the case of SEQID-00338 over the course of the experiment. One-way ANOVA with Dunnett's multiple comparisons tests were used to compare within each treatment to time 0 and between treatments at the same time point to vehicle. Vehicle had no statistically significant change in plasma insulin compared to the time of vehicle gavage. SEQID-00105 had statistically significantly greater plasma insulin compared to the time of treatment gavage (time −15) at the time of the glucose challenge (time 0) and at 15 minutes and 90 minutes following glucose challenge (P=0.0002, P<0.05 and P<0.05, respectively). SEQID-00338 had statistically significantly greater plasma insulin concentration compared to the time of treatment gavage at all subsequent sampled time points (P<0.0001, P<0.05, P<0.005, P<0.005, and P=0.0005, respectively).

In comparisons between treatments, neither SEQID-00105 nor SEQID-00338 was significantly different from Vehicle at the time of treatment or vehicle gavage. At the time of the glucose challenges and all subsequent time points sampled (0, 15, 30, 60 and 90 minutes) both SEQID-00105 and SEQID-00338 had a significantly greater plasma insulin concentration than vehicle. This shows that both treatments stimulate insulin secretion in the Zucker Fatty (fa/fa) model.

Figure 15:
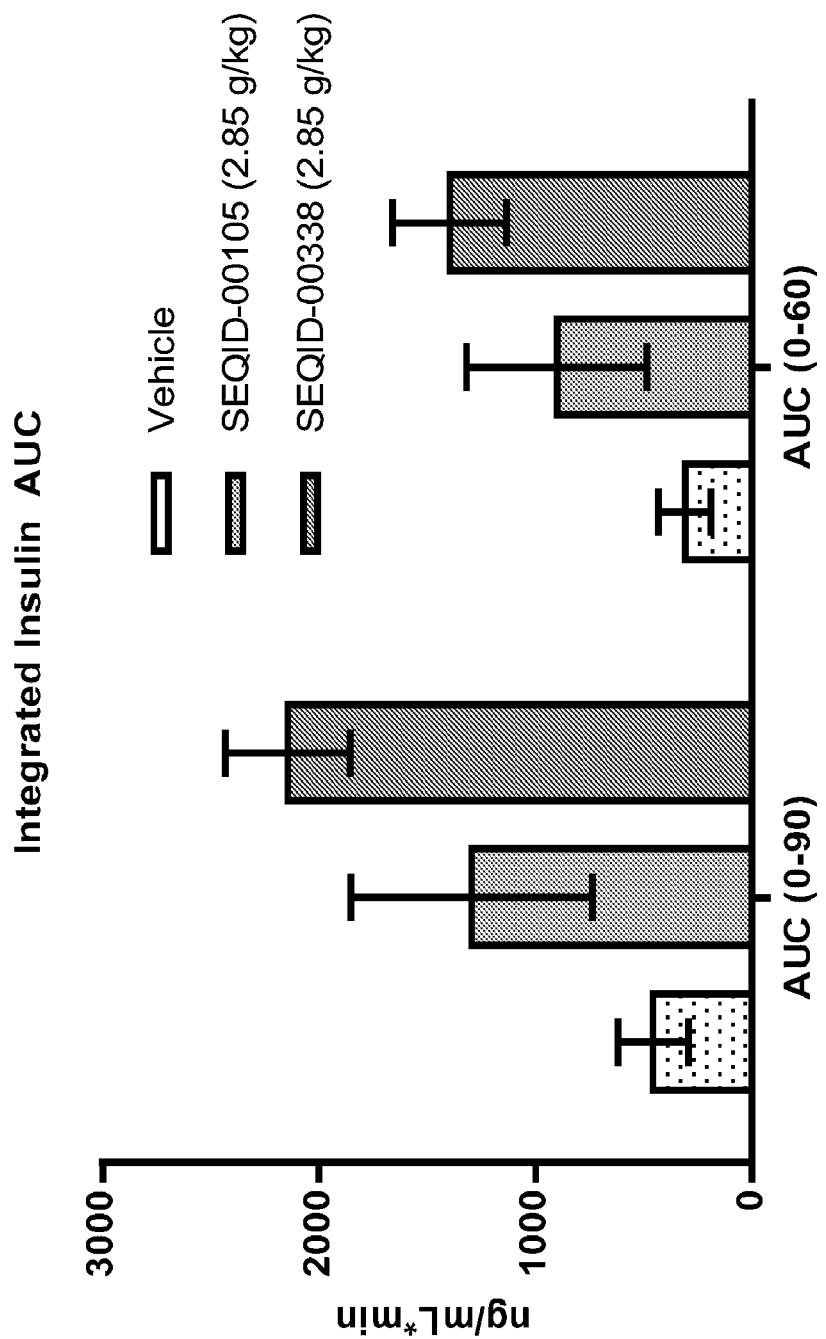
FIG. 15 is a chart demonstrating integrated area under the curve for vehicle, SEQID-00105 and SEQID-00338 between 0 and 90 minutes and between 0 and 60 minutes. Error bars shown here correspond to the standard error of the mean.

FIG. 15 shows the integrated area under the curve for each group. Only SEQID-00338 treatment integrated between 0 and 90 minutes was statistically significantly greater than vehicle (P<0.005).

Active GLP-1 Enzyme Linked Immunosorbent Assay (ELISA).

A rat active GLP-1 ELISA Kit was obtained from Eagle Biosciences (Catalog number GP121-K01, Nashua, N.H.). Plates were washed using a BioTek EL×50 microplate strip washer (BioTek, Winooski, Vt.). Absorbance was read on a Synergy Mx monochromator-based microplate reader (BioTek, Winooski, Vt.). Data was analyzed using Microsoft Excel version. 14.0.7128.5000 (Microsoft Corporation, Redmond, Wash.) and GraphPad Prism version 6.03 for Windows (GraphPad Software, La Jolla, Calif.).

The ELISA kit was prewarmed to room temperature for at least 30 minutes prior to beginning the assay set up. The standard curve dilutions were prepared in accordance with the manufacturer's instructions.

Plasma matrix from Group 5 and sample plasma were thawed on ice and then centrifuged at approximately 1000× ref for 10 minutes at 4° C. to pellet any insoluble material.

Matrix Assay Buffer for running the active GLP-1 standard was prepared using plasma matrix from the nave group to a concentration of 10% in 100 μL for samples tested at 1:1 dilution or 20% in 100 μL for samples tested undiluted. 20 μL of standards and samples were added to the pre-coated microplate and 100 μL appropriate assay buffer added to the standard and sample wells. The plates were covered with adhesive foil and incubated for 24 hours at 4° C. protected from light. The plates were then washed five times with 350 μL/well 1× Wash Buffer then tapped sharply several times on paper towels to remove any residual wash buffer. 100 μL/well of ELISA HRP Substrate was added to all wells. The plates were then sealed and incubated at room temperature for 20 minutes protected from light. 100 μL/well ELISA Stop Solution was added to all wells and gently mixed.

The absorbance values were read on the Synergy Mx plate reader at 450 nm and 620 nm. Final values obtained were the A450 nm-A620 nm values.

The standard curve was corrected for matrix concentration of active GLP-1 by subtracting the mean of the 0 μM GLP-1 standard from each of the standard well A450 nm-A620 nm values in Excel. Duplicate sample concentrations were determined by non-linear regression using a 4 parameter logistic model of the background corrected standard following an x=log(x) transformation of GLP-1 concentration. ANOVA and multiple comparison tests were conducted using GraphPad Prism 6. The area under curve was integrated using the Linear-Log Trapezoidal Method on Microsoft Excel, with post hoc testing conducted in GraphPad.

Figure 16:
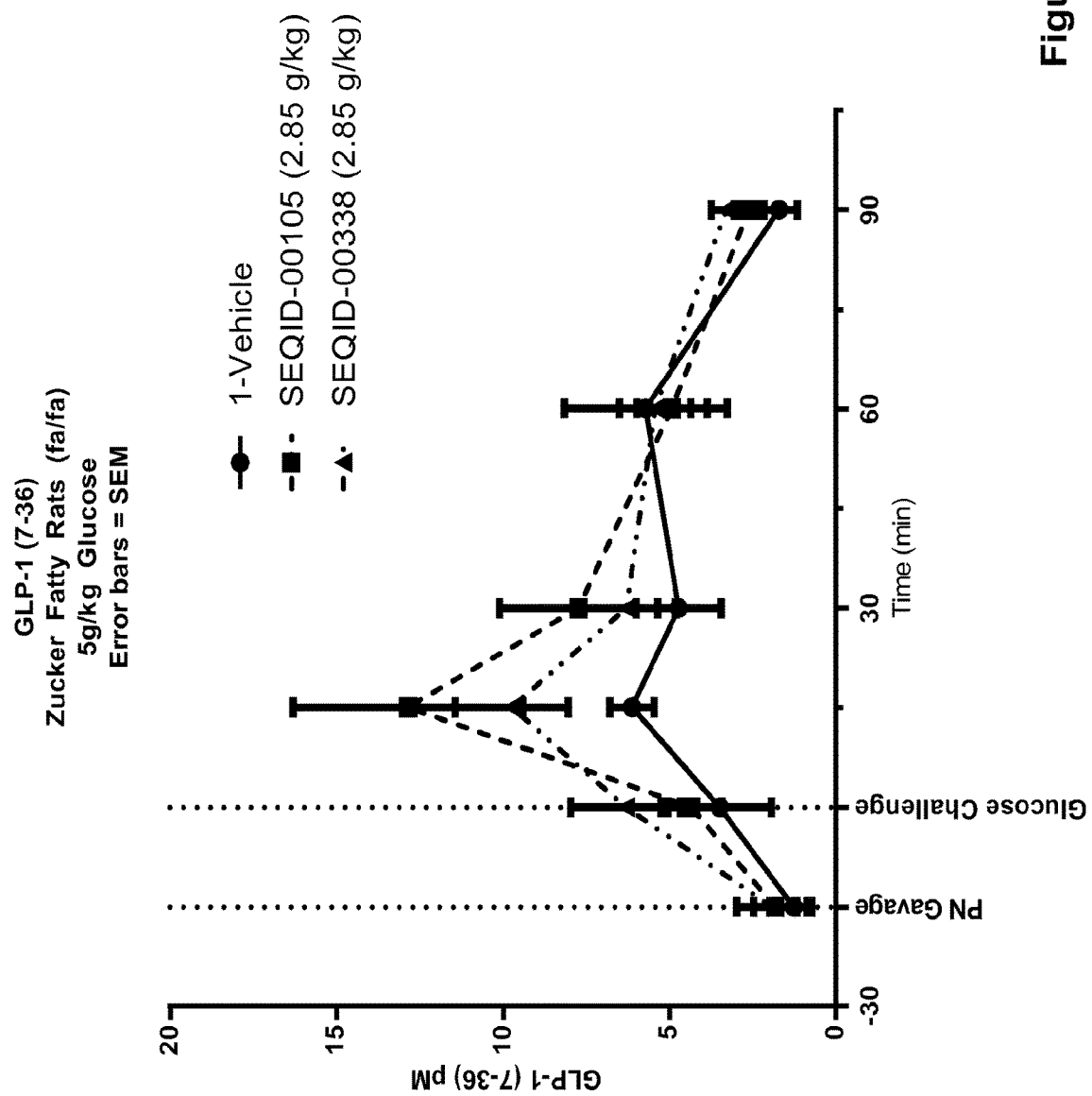
FIG. 16 is a chart demonstrating average plasma GLP-1 concentration for n=6 rats per treatment group for vehicle and SEQID-00105 and n=5 rats for SEQID-00338 over the course of the experiment. Error bars shown here correspond to the standard error of the mean.

FIG. 16 shows average plasma GLP-1 concentration for n=6 rats per vehicle and SEQID-00105, and n=5 rats per SEQID-00338 treatment group, over the course of the experiment. One-way ANOVA with Dunnett's multiple comparisons tests were used to compare within each treatment to time 0 and between treatments at the same time point to vehicle. Vehicle showed no significant difference in GLP-1 (7-36) concentration at any time point after vehicle gavage. SEQID-00105 showed significantly greater GLP-1 (7-36) concentration at 15 minutes and 30 minutes after glucose challenge (P<0.0001 and P<0.05, respectively). SEQID-00338 had a significantly greater GLP-1 concentration at 15 minutes following glucose challenge (P<0.005).

When compared to vehicle at each time point only SEQID-00105 had a significantly greater GLP-1 (7-36) concentration than vehicle at 15 minutes following glucose challenge (P<0.005).

Figure 17:
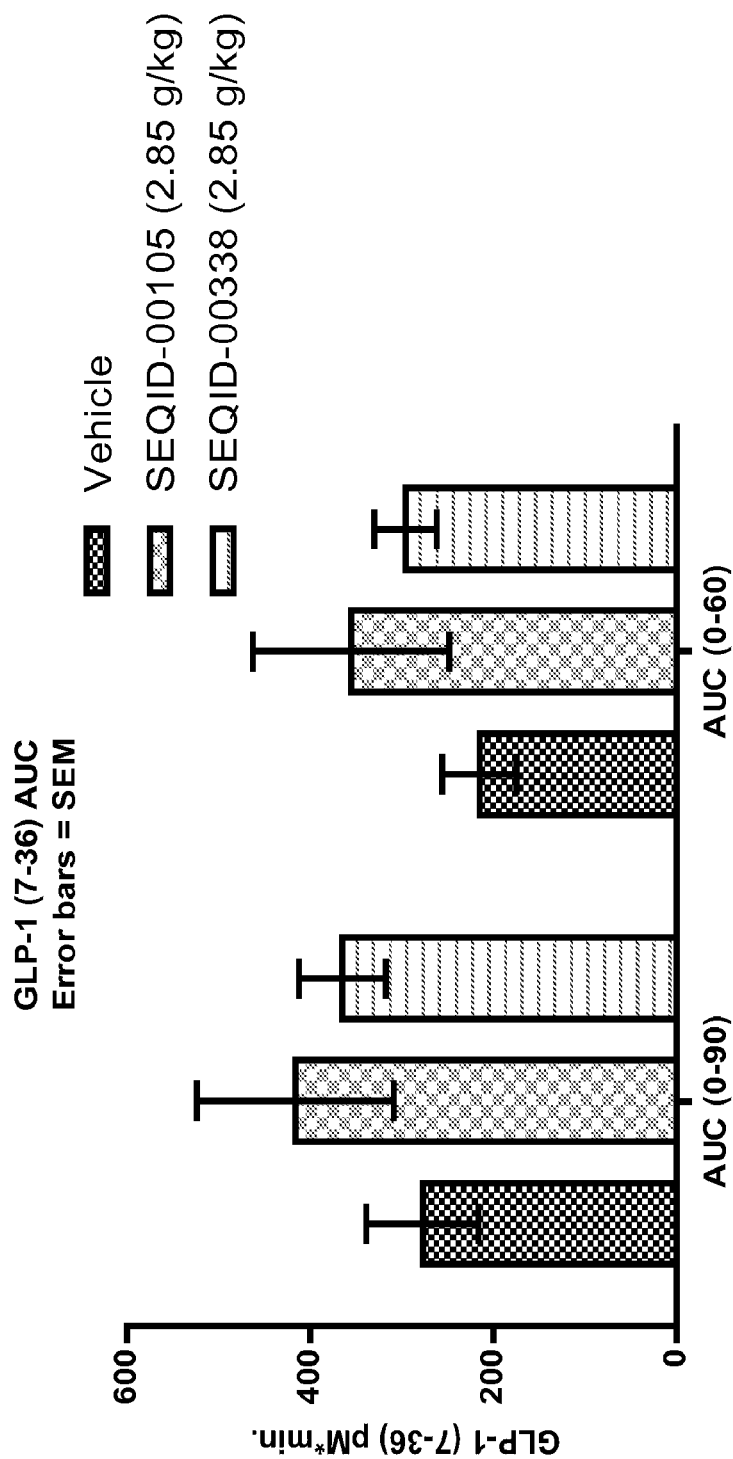
FIG. 17 is a chart demonstrating area under curve for GLP-1 (7-36) for each treatment group integrated to 0-90 and 0-60 minutes. Error bars shown here correspond to the standard error of the mean.

FIG. 17 shows the area under curve for GLP-1 (7-36) for each treatment group integrated to 0-90 and 0-60 minutes. No treatment had a significantly different GLP-1 (7-36) integrated AUC compared to vehicle at either 0-90 or 0-60 minutes.

In another experiment, an OGTT was performed in 24, fasted, male Zucker fatty rats with indwelling jugular vein catheters (JVC) to assess the acute effects of nutritive protein dosing on glycemic control as well as insulin and GLP-1 levels. The capacity of SEQID-00105 to improve glucose control was tested by comparing the blood glucose excursion of SEQID-00105 to alogliptin to SEQID-00105+ alogliptin to vehicle in the context of an oral glucose tolerance test. All rodents were approximately 10-11 weeks old, weighed average of approximately 430 g and acclimated for 4-5 days prior to testing. Prior to treatment, all rats were fasted overnight for fourteen hours. Fasted animals were treated with formulations of nutritive proteins dissolved in water by oral gavage (see table E22B), and fifteen minutes after treatment gavage were then challenged with an oral gavage of glucose (2 g/kg). Blood glucose was measured and blood was collected at nine time points (−15, 0, 15, 30, 60, 90, 120, 180 and 240 minutes relative to the glucose challenge).

TABLE E22B

| Group | Body weight (average, g) | Treatment ID | Polypeptides | | DPP IV Inhibitor Dose (mg/kg) | Glucose Dose (g/kg) |
|---|---|---|---|---|---|---|
| | | | Dose (mg/kg) | Volume (ml/kg) | | |
| 1 | 430.5 | Vehicle | 0 | 11.4 | 0 | 2 |
| 2 | 432.3 | SEQID-00105 | 2850 | 11.4 | 0 | 2 |
| 3 | 431.7 | Alogliptin | 0 | 11.4 | 0.3 | 2 |
| 4 | 435.5 | SEQID-00105 + Alogliptin | 2850 | 11.4 | 0.3 | 2 |

Figure 18:
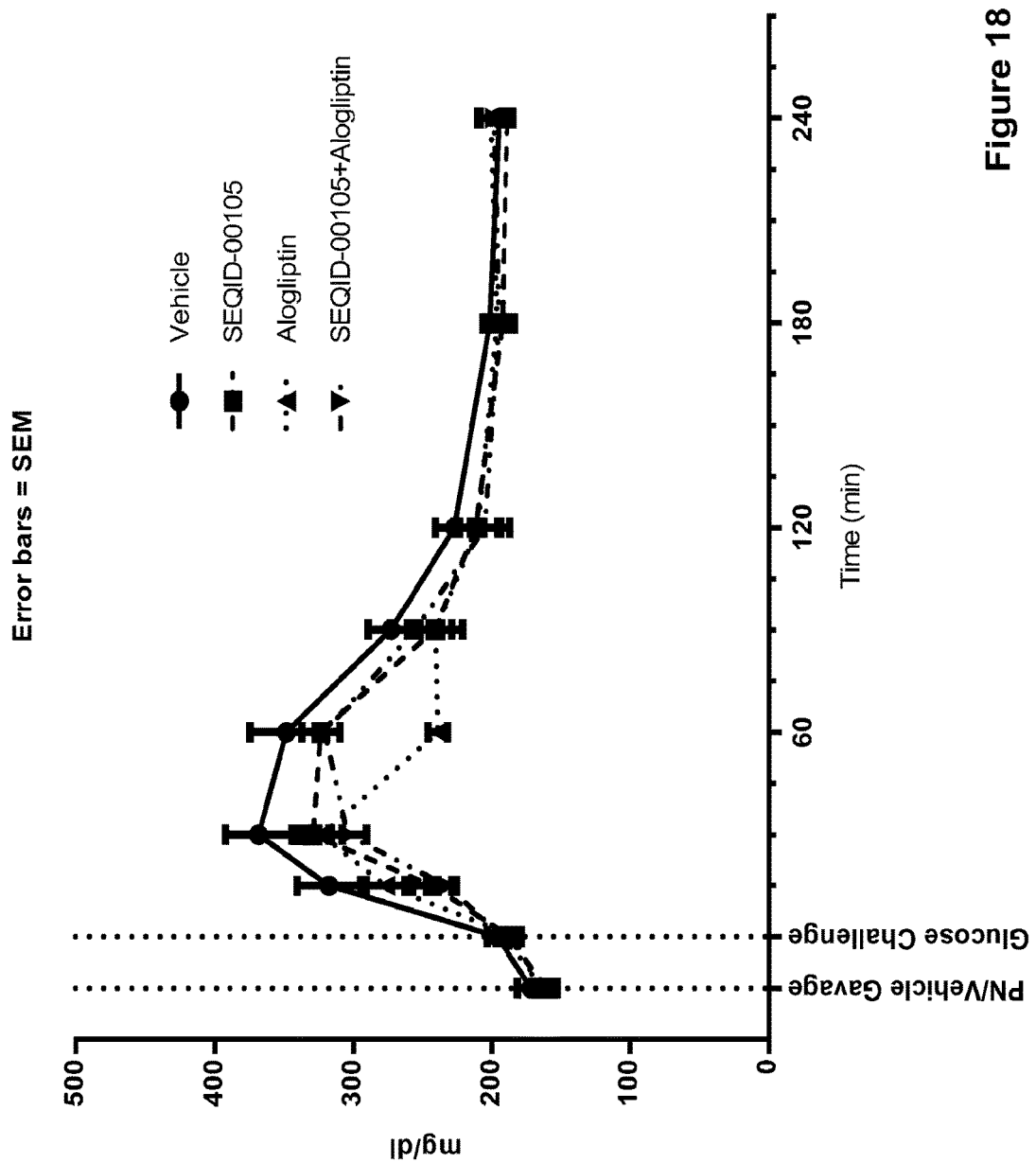
FIG. 18 is a chart demonstrating average blood glucose values during OGTT of vehicle, SEQID-00105, Alogliptin, and the combination for n=6 rats per treatment group. Error bars shown here correspond to the standard error of the mean.

FIG. 18 shows the average blood glucose values during the OGTT described herein. N=6 rats per treatment group. The error bars shown are the standard errors of the mean. Each group was compared post hoc on GraphPad Prism 6, two-way ANOVA, Dunnett's multiple comparisons test first comparing within each group to the fasting glucose concentration, followed by a comparison of each time point to vehicle. No treatment group blood glucose was significantly different from fasting at the time of the glucose challenge.

Fasting glucose and blood glucose at the time of the glucose challenge was not significantly different between each group and vehicle. At 15 minutes following glucose challenge, SEQID-00105 only and SEQID-00105+Alogliptin had significantly lower blood glucose compare to vehicle (P=0.0003 & P<0.0001, respectively). At 30 minutes following the glucose challenge Alogliptin alone and SEQID-00105+Alogliptin had significantly lower blood glucose than vehicle (P=0.0424 & P=0.0021, respectively). At 60 minutes following the glucose challenge, only Alogliptin alone was significantly lower than vehicle (P<0.0001). No group after 60 minutes had significantly different blood glucose than vehicle.

The integrated area under curve (AUC) was calculated on Microsoft Excel using the Linear-Log Trapezoidal Method and two-way ANOVA and Dunnett's multiple comparisons tests was conducted on GraphPad Prism 6.03. No treatment showed statistically significant difference in glucose AUC from vehicle between time 0 and 60 minutes. Between time 0 and 120 minutes and between time 0 and 240 minutes only the alogliptin alone treatment was significantly less than vehicle (P=0.0051 & P=0.0054, respectively).

Example 23

Use of Nutritive Polypeptides to Improve Glycemic Control and Fasting Glucose in Diet Induced Obese Mice The effects of chronic dosing of therapeutic nutritive polypeptides described herein are evaluated by oral glucose tolerance tests in diet induced obese (DIO) mice. In particular, chronic dosing in this animal model of metabolic disease can affect glycemic control, insulin resistance, fasting glucose and insulin levels, and comparison of fasting levels as well as glucose area under the curve (AUC) during an OGTT before and after a period of daily dosing provides a measure of compound efficacy.

Four groups of 10 male C57BL/6 mice are fed a high fat diet ad libitum for 14 weeks to ensure that they develop elevated fasting glucose levels (hyperglycemia), elevated fasting insulin levels (hyperinsulinemia), and impaired glucose control (Xu. H. et al. Chronic inflammation in fat plays a crucial role in the development of obesity-related insulin resistance. J. Clin. Invest. (2003) 112: 1821-1830). A single group of 10 male C57BL/6 mice (group 1) is fed a normal diet for comparison of treatment arms on HFD to normal diet at the same age, handling, and housing conditions. All mice are housed and acclimated for three days prior to the start of the study.

All Mice are fasted overnight for fourteen hours before OGTT treatment, and a blood sample is collected the morning of the study prior to dosing for analysis of fasting glucose and hormone levels. Fasted animals are treated with formulation of provided nutritive polypeptides by oral gavage fifteen minutes before glucose challenge. Glucose (2 g/kg) is orally administered at time zero. Blood glucose is measured at seven time points (−15, 0, 15, 30, 60, 90, 120 minutes). Age-matched normal mice under regular diet are used as an internal standard for the analytics. In groups 2-5, mice receive daily dose of provided therapeutic nutritive polypeptides (2.85 g/kg) (groups 4 and 5) or vehicle control (groups 2 and 3) for 15-30 days via daily gavage or formulation into chow. All blood is collected in an EDTA collection tube containing plasma stabilizers (a DPP4 inhibitor and a protease cocktail inhibitor), processed for plasma, and stored frozen at −80 C.

An OGTT as described above is performed again on the final day of the study with either vehicle (groups 2 and 4) or test article (groups 1, 3, and 5). Prior to the final test article or vehicle dose, a blood sample is collected for analysis of fasting glucose and hormone levels. At the completion of the final OGTT, all mice are sacrificed and entire blood volume is collected via cardiac puncture. Analysis of insulin levels are performed using an ELISA method described herein.

Comparisons of end of study OGTT glucose AUC across groups 2 and 4 describe the effect of chronic test article administration without the acute effects of test article administration on the OGTT. Comparisons of end of study OGTT glucose AUC across groups 3 and 5 describe the effect of chronic test article administration and include the acute effects of test article administration on the OGTT. Comparisons of fasting glucose and insulin levels at the beginning and end of the study within group 4 or within group 5 describe the effect of chronic dosing on fasting glucose and insulin levels.

Example 24

Use of Nutritive Polypeptides to Induce Insulin Secretion in Rodents

Ingested amino acids have been shown to have the capacity to induce insulin secretion (Gannon M. C. and F. Q. 2010. Nuttall. Amino Acid Ingestion and Glucose Metabolism—A Review. IUBMB Life, 62(9): 660-668). Protein ingestion increases plasma insulin significantly in comparison to ingestion of glucose alone (Nuttall, et al. 1984. Effect of protein ingestion on the glucose and insulin response to a standardized oral glucose load. Diabetes Care. 7(5):465-470). Ingested protein increases insulin secretion in part via the action of incretin hormones, i.e., glucagon-like peptide-1 (GLP-1) and glucose-dependent insulinotropic peptide (GIP), which are secreted by endocrine cells upon luminal exposure to nutrients (Baggio L L & D J Drucker. 2007. Biology of incretins: GLP-1 and GIP. *Gastroenterology.* 132:2131-2157). Amino acids such as leucine and arginine have also been shown to directly stimulate insulin release (Newsholme P. et al. New insights into amino acid metabolism, B-cell function and diabetes. *Clin. Sci.* (2005) 108: 185-194). In these studies, the insulin response after acute dosing of various nutritive proteins was measured in rodents.

Animals were treated and acutely dosed with various test articles as part of pharmacokinetic rodent experiments according to methods described herein. Unless otherwise stated all dosing was at 2.85 g/kg body weight. All treatment groups except for SEQID-00240 which had n=5 rats, and SEQID-00587 which had n=3, contained n=4 rats.

Quantification of Plasma Insulin Using AlphaLISA® Insulin Immunoassay

Plasma samples were thawed on ice and centrifuged for 10 minutes at 1109×g to pellet insoluble material. AlphaLISA® Insulin Immunoassay Kit (PerkinElmer, AL204 C) was removed from 4° C. cold room and kept on ice during assay set up. 1× Assay Buffer was prepared by diluting 10× Assay Buffer with milliQ water.

Standard buffer for dilution of insulin was prepared at 25.9% fasted rat plasma in 1× Assay Buffer and used to prepare a 16 point standard curve. Plasma samples were prepared by diluting 7:20 in 1× Assay Buffer in a 96-well PCR microplate.

Acceptor bead mix was prepared by diluting Acceptor Beads and Biotinylated Anti-Insulin Antibody 1/400 in 1× Assay Buffer. Acceptor bead mix was pipetted, 20 μL/well, into a white opaque 384 well microplate (PerkinElmer, OptiPlate-384), to this mixture was added 10 μL/well of insulin standard in fasted rat plasma or sample rat plasma in duplicate. The plate was sealed with a foil plate seal and incubated on a horizontal shaker at ~600 rpm for 60 minutes at room temperature.

It was necessary to protect the Streptavidin Coated Donor Beads from light; as such, in a darkened room, donor bead mix was prepared by diluting the streptavidin coated donor beads 1/125 in 1× Assay Buffer. After the first incubation step, 20 µL/well donor bead mix was added to the standard and samples. The assay plate was sealed and returned to the horizontal shaker at ~600 rpm, for 30 minutes at room temperature. Following the donor bead incubation, luminescence was read on the EnSpire Alpha plate reader.

Data were analyzed with Microsoft Excel version 14.0.7128.5000 (32-bit) and GraphPad Prism version 6.03. A standard curve was generated to log(Insulin (µIU)). Rat plasma insulin concentrations were interpolated using a sigmoidal, four parameter logistic equation. The mean of duplicate concentration of insulin in the technical replicates for each rat were plotted against time. Area under curve was integrated for 0-240 minutes and 0-60 minutes using the Linear-Log Linear Method in Microsoft Excel.

Quantification of Plasma Insulin Using a Rat Insulin Enzyme Linked Immunosorbent Assay (ELISA).

An Ultra-Sensitive Rat Insulin ELISA Kit was obtained from Crystal Chem, Inc. (Catalog number 90060, Downers Grove, Ill.). Plates were washed using a BioTek ELx50 microplate strip washer (BioTek, Winooski, Vt.). Absorbance was read on a Synergy Mx monochromator-based microplate reader (BioTek, Winooski, Vt.). Data was analyzed using Microsoft Excel version 14.0.7128.5000 (Microsoft Corporation, Redmond, Wash.) and GraphPad Prism version 6.03 for Windows (GraphPad Software, La Jolla, Calif.).

The ELISA kit was pre-warmed to room temperature for 30 minutes prior to beginning the assay set up. The standard curve dilutions were prepared in accordance with the manufacturer's instructions for running the assay in Wide Range format.

Plasma matrix from the naïve group and sample plasma were thawed on ice and then centrifuged at approximately 1000×ref for 10 minutes at 4° C. to pellet any insoluble material.

Matrix Assay Buffer for running the insulin standard was prepared using plasma matrix from the nave group to a concentration of 5.26% in 95 µL. 95 µL of Assay Buffer was added to all sample wells, and 95 µL of Matrix Assay Buffer was added to all standard wells. 5 µL of each sample and standard were added in duplicate. The plates were incubated at 4° C. for 2 hours. The plates were then washed five times with 300 µL/well 1× Wash Buffer. The plates were tapped sharply several times on paper towels to remove any residual wash buffer.

Anti-Insulin Enzyme Conjugate Working Solution was prepared by combining 2 volumes Anti-Insulin Enzyme Conjugate Stock with 1 volume Enyme Conjugate Diluent, and mixing by pipetting up and down and gently vortexing. 100 µL/well of Anti-Insulin Enzyme Conjugate Working Solution was added to all wells. The plates were sealed and incubated at room temperature for 30 minutes and then washed seven times with 300 µL/well 1× Wash Buffer. The plates were tapped sharply several times on paper towels to remove any residual wash buffer. 100 µL/well Enzyme Substrate Solution was then added to each well and incubated in the dark at room temperature for 40 minutes. 100 µL/well Stop Solution was added to all wells. The absorbance was read on the Synergy Mx plate reader at 450 nm and 630 nm. Final values obtained were the A450 nm-A630 nm values.

The insulin standard curve was corrected for matrix concentration of insulin by subtracting the mean of the 0 ng/mL insulin standard from each of the standard well $A_{450nm}$-$A_{630nm}$ values in Excel. Duplicate sample concentrations were determined by non-linear regression using a 4 parameter logistic model of the background corrected standard following an x=log(x) transformation of insulin concentration in GraphPad Prism 6. ANOVA and multiple comparison tests were conducted on GraphPad Prism 6. Area under curve was integrated for 0-240 minutes and 0-60 minutes using the Linear-Log Linear Method in Microsoft Excel.

In Vivo Plasma Insulin Concentrations

Figure 19:
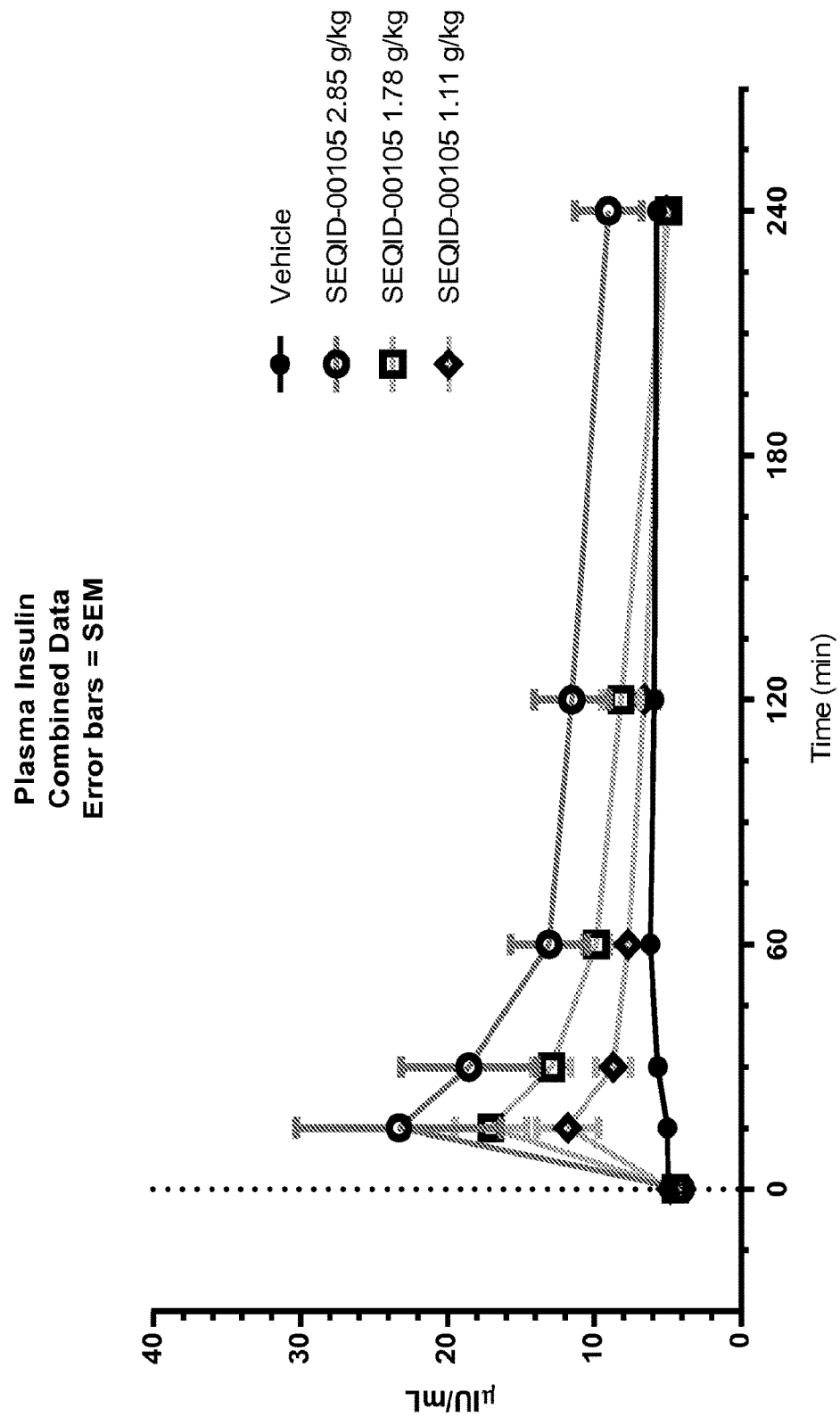
FIG. 19 is a chart demonstrating AlphaLISA plasma insulin over time for vehicle and SEQID-00105 administered at three different doses. Error bars shown here are the standard error of the mean.
Figure 20:
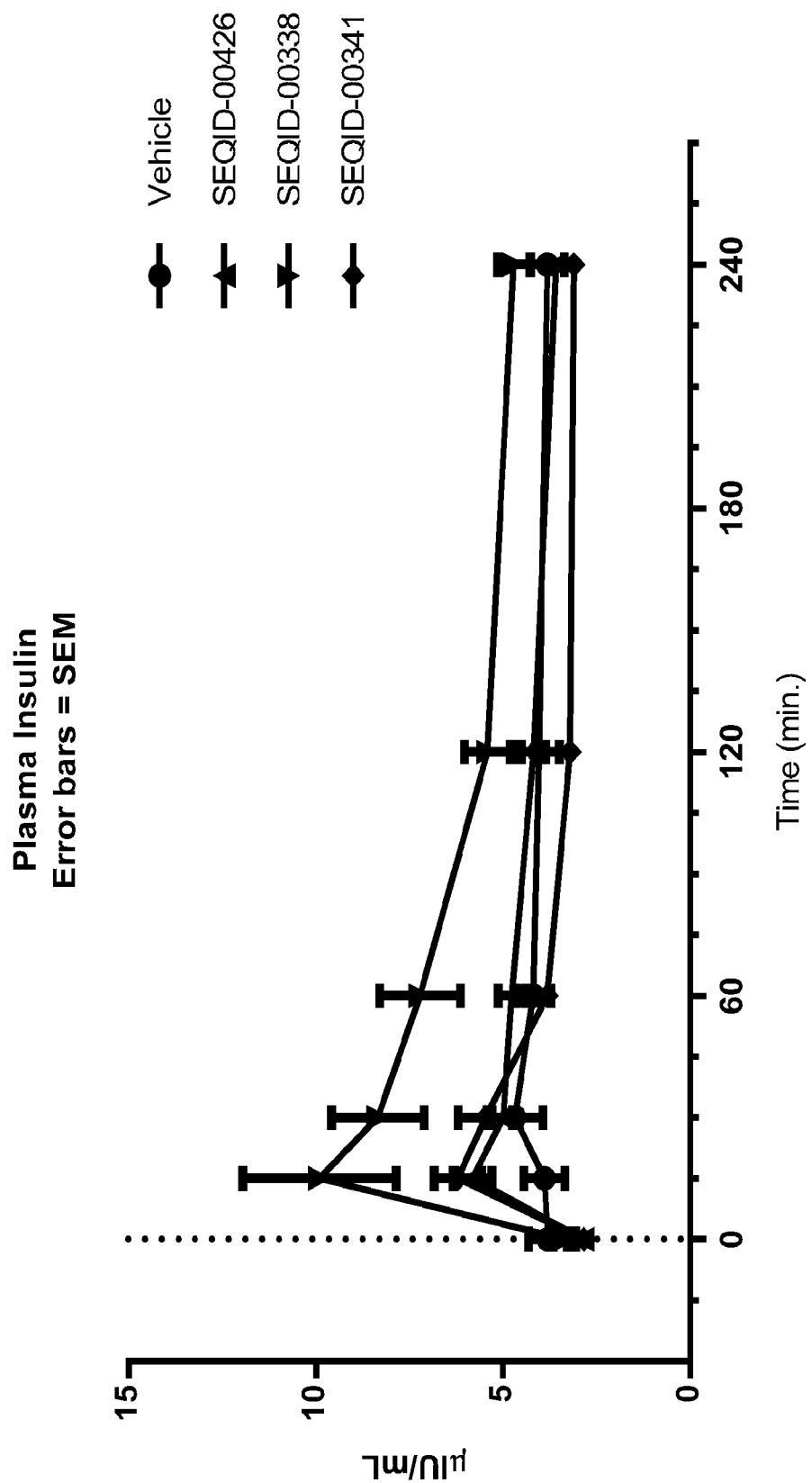
FIG. 20 is a chart demonstrating AlphaLISA plasma insulin over time for vehicle and SEQID-00426, SEQID-00338, SEQID-00341. Error bars shown here are the standard error of the mean.

FIGS. 19 and 20 show the combined biological replicate data for a study of vehicle and SEQID-00105 administered at three different doses and SEQID-00426, SEQID-00338, SEQID-00341 administered at one dose, where plasma insulin was measured using the AlphaLISA Insulin kit. All error bars represent the standard error of the mean. A one-way ANOVA with Dunnett's multiple comparisons tests were used to compare within each treatment to time 0 and between treatments at the same time point to vehicle.

In FIG. 19, SEQID-00105 at 2.85 g/kg had a statistically significant increase in plasma insulin concentration at 15, 30 and 60 minutes following gavage (P<0.0001, P<0.0001, and P<0.05, respectively); SEQID-00105 at 1.78 g/kg had a statistically significant increase in plasma insulin concentration at 15 and 30 minutes following gavage (P=0.0005 and P<0.05, respectively); at the lowest SEQID-00105 dose plasma insulin concentration over the time course was not significantly different from time 0. When compared to the plasma insulin concentration of the vehicle control at each time point, SEQID-00105 at 2.85 g/kg showed statistically significant greater plasma insulin than vehicle at 15 minutes and 30 minutes following oral gavage (P<0.0001 and P<0.001, respectively), SEQID-00105 at 1.78 g/kg showed a statistically significant increase in plasma insulin concentration at 15 minutes following oral gavage (P=0.0005). In FIG. 20, only SEQID-00338 had a statistically significant increase in plasma insulin concentration from 0 at 15 and 0.30 minutes following oral gavage (P=0.005 and P<0.05, respectively). When compared to vehicle plasma insulin concentration at each concentration SEQID-00338 was significantly greater than vehicle at 15 minutes following oral gavage (P<0.01).

Figure 21:
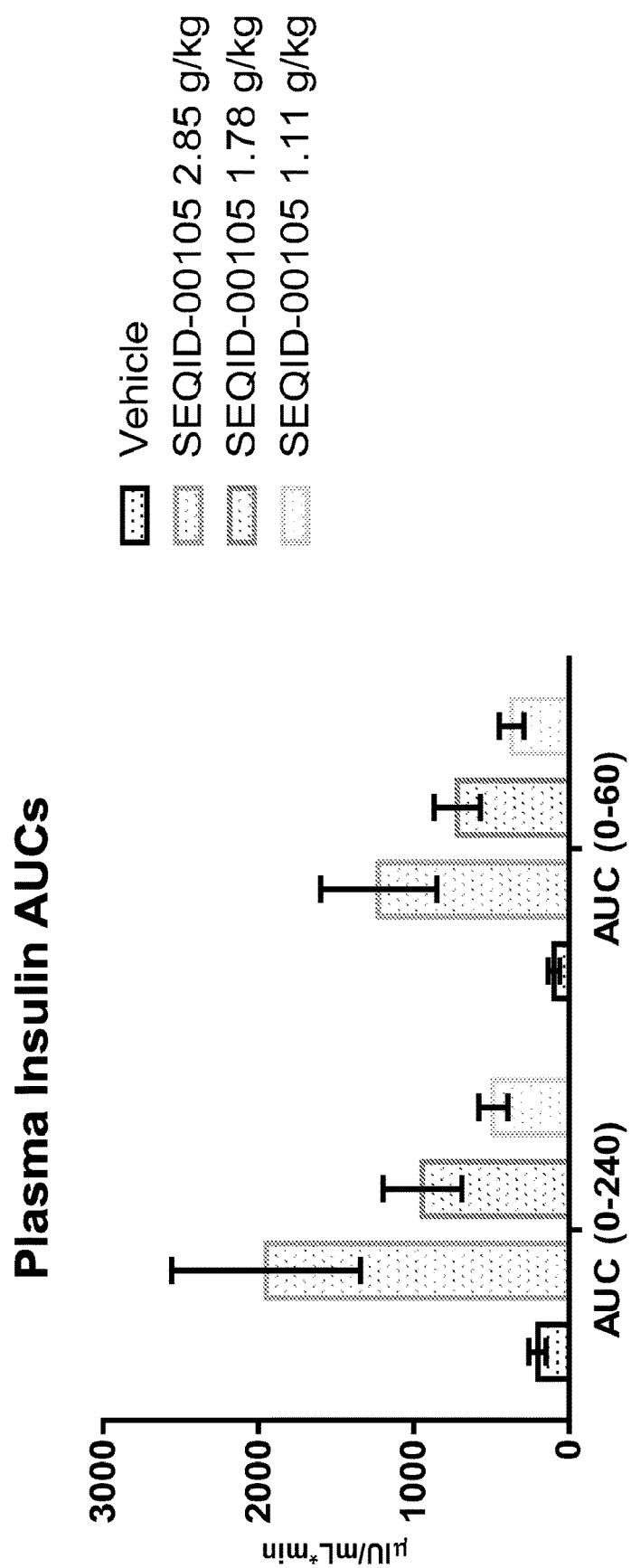
FIG. 21 is a chart demonstrating integrated area under curves for plasma insulin concentrations for SEQID-00105 at three doses between 0 and 240 minutes and between 0 and 60 minutes. Error bars shown here are the standard error of the mean.
Figure 22:
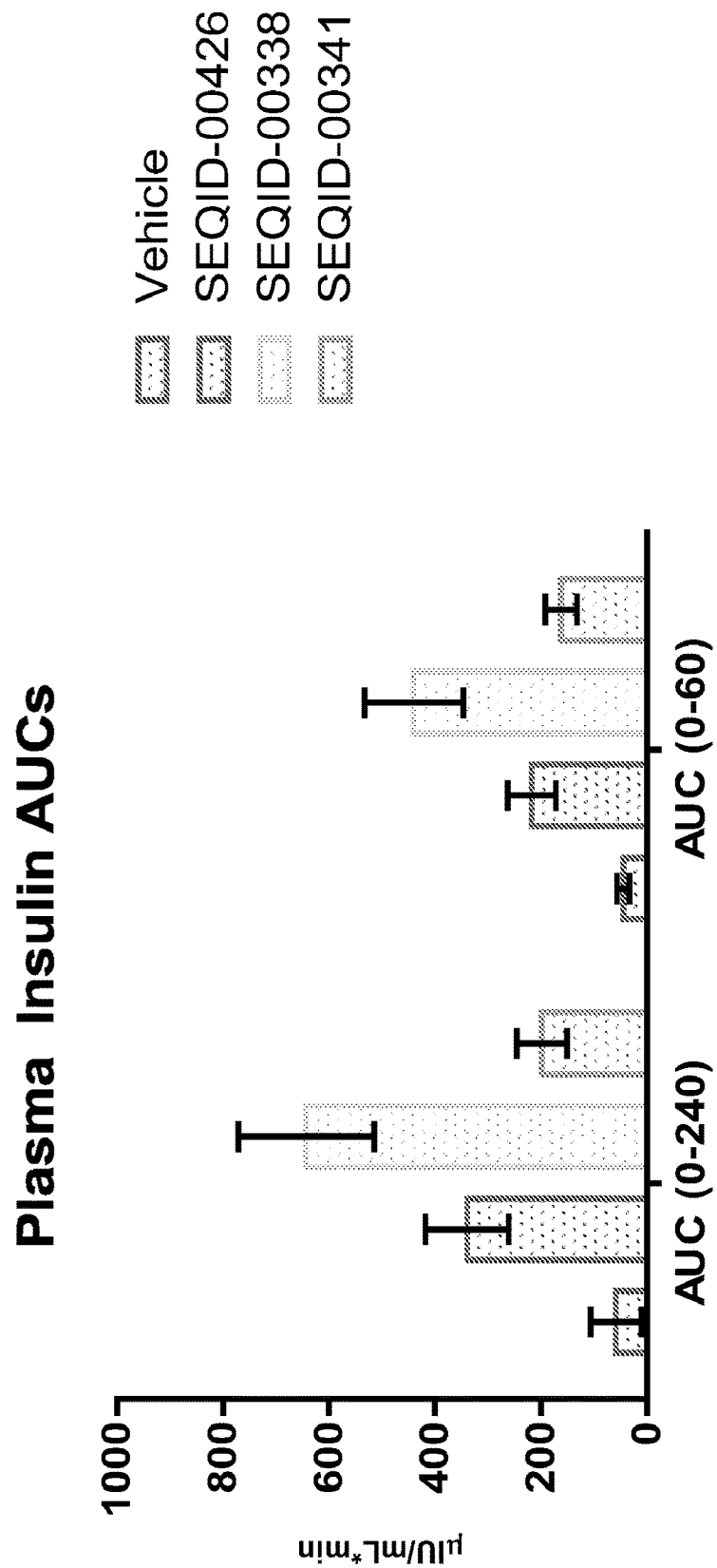
FIG. 22 is a chart demonstrating integrated area under curves for plasma insulin concentrations for vehicle, SEQID-00426, SEQID-00338, and SEQID-00341 between 0 and 240 minutes and between 0 and 60 minutes. Error bars shown here are the standard error of the mean.

FIGS. 21 and 22 show the integrated area under curves for plasma insulin concentrations measured for vehicle of SEQID-00105, SEQID-00426, SEQID-00338, SEQID-00341, error bars are the standard error of the mean. One-way ANOVA with Dunnett's multiple comparisons tests were used to compare the AUCs to vehicle. SEQID-00105 at 2.85 g/kg had a statistically significantly greater plasma insulin AUC than vehicle when integrated from 0-240 minutes and 0-60 minutes (P1.0005 and P<0.05, respectively).

Figure 23:
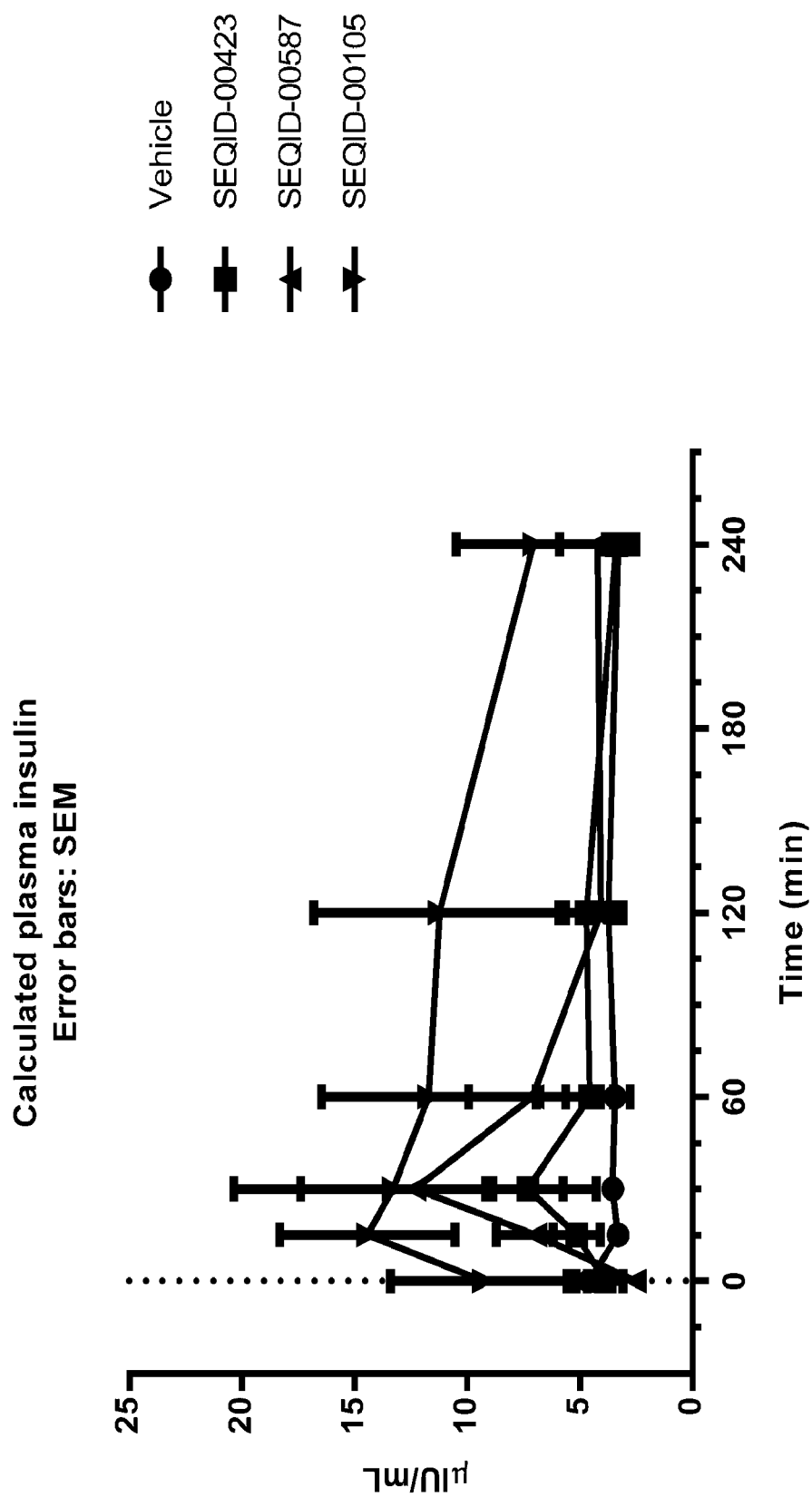
FIG. 23 is a chart demonstrating AlphaLISA plasma insulin over time for SEQID-00423, SEQID-00587, SEQID-00105. Error bars shown here are the standard error of the mean.
Figure 24:
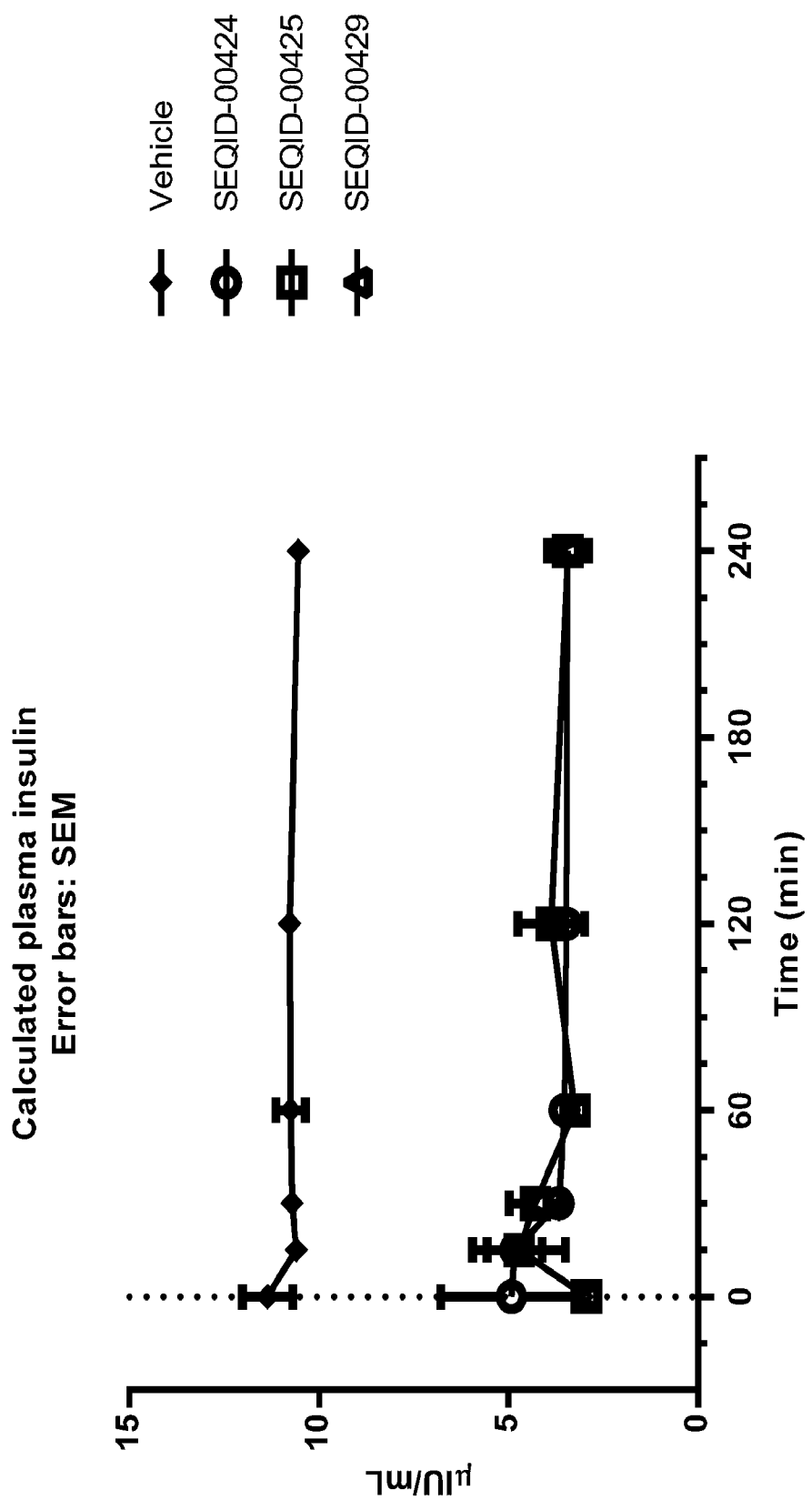
FIG. 24 is a chart demonstrating AlphaLISA plasma insulin over time for vehicle SEQID-00424, SEQID-00425, and SEQID-00429. Error bars shown here are the standard error of the mean.

FIGS. 23 and 24 show the combined biological replicate data for a study of vehicle and SEQID-00423, SEQID-00587, SEQID-00105, SEQID-00424, SEQID-00425, and SEQID-00429, where plasma insulin was measured using the AlphaLISA Insulin kit. All error bars represent the standard error of the mean. One-way ANOVA with Dunnett's multiple comparisons tests were used to compare within each treatment to time 0 and between treatments at the same time point to vehicle.

Figure 25:
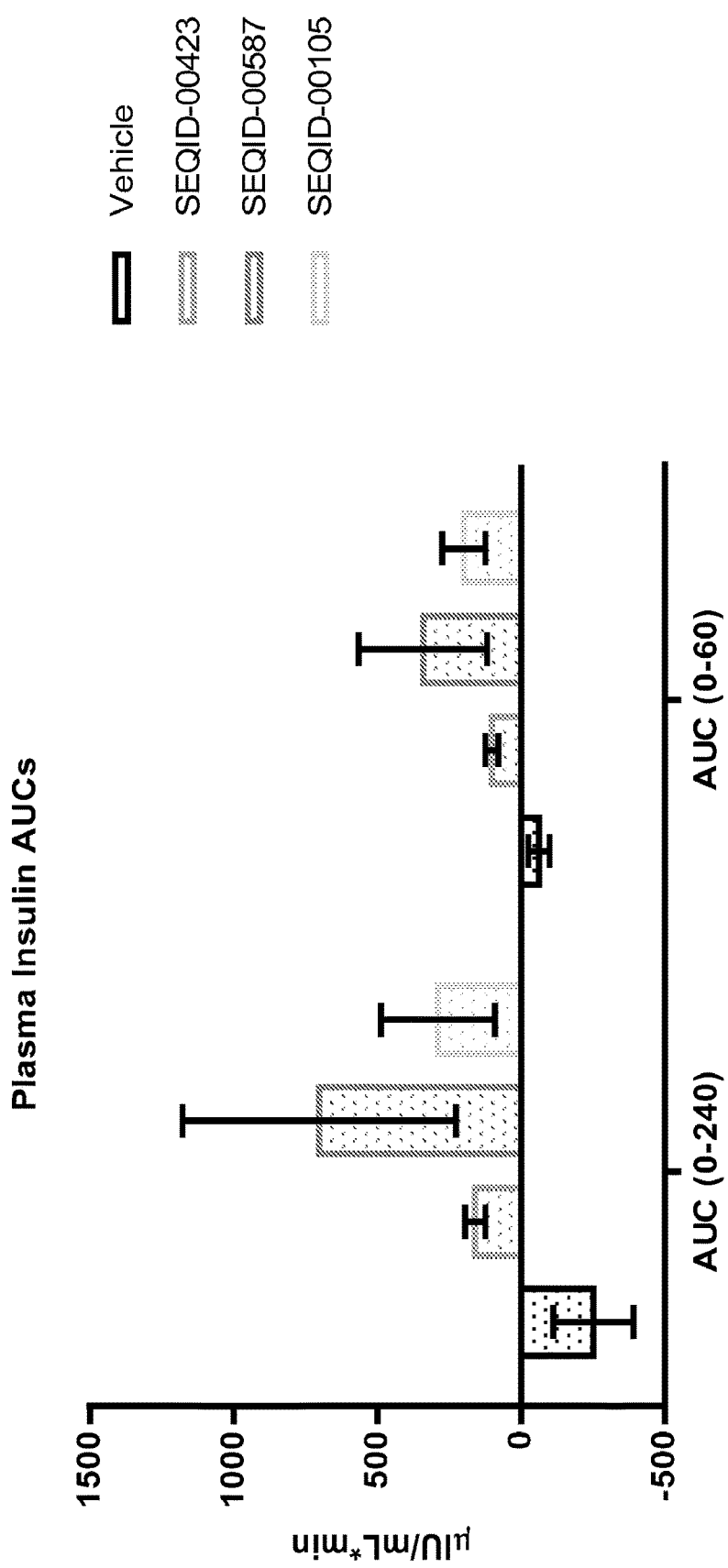
FIG. 25 is a chart demonstrating integrated area under curves for plasma insulin concentrations for vehicle, SEQID-00423, SEQID-00587, and SEQID-00105 between 0 and 240 minutes and between 0 and 60 minutes. Error bars shown here are the standard error of the mean.
Figure 26:
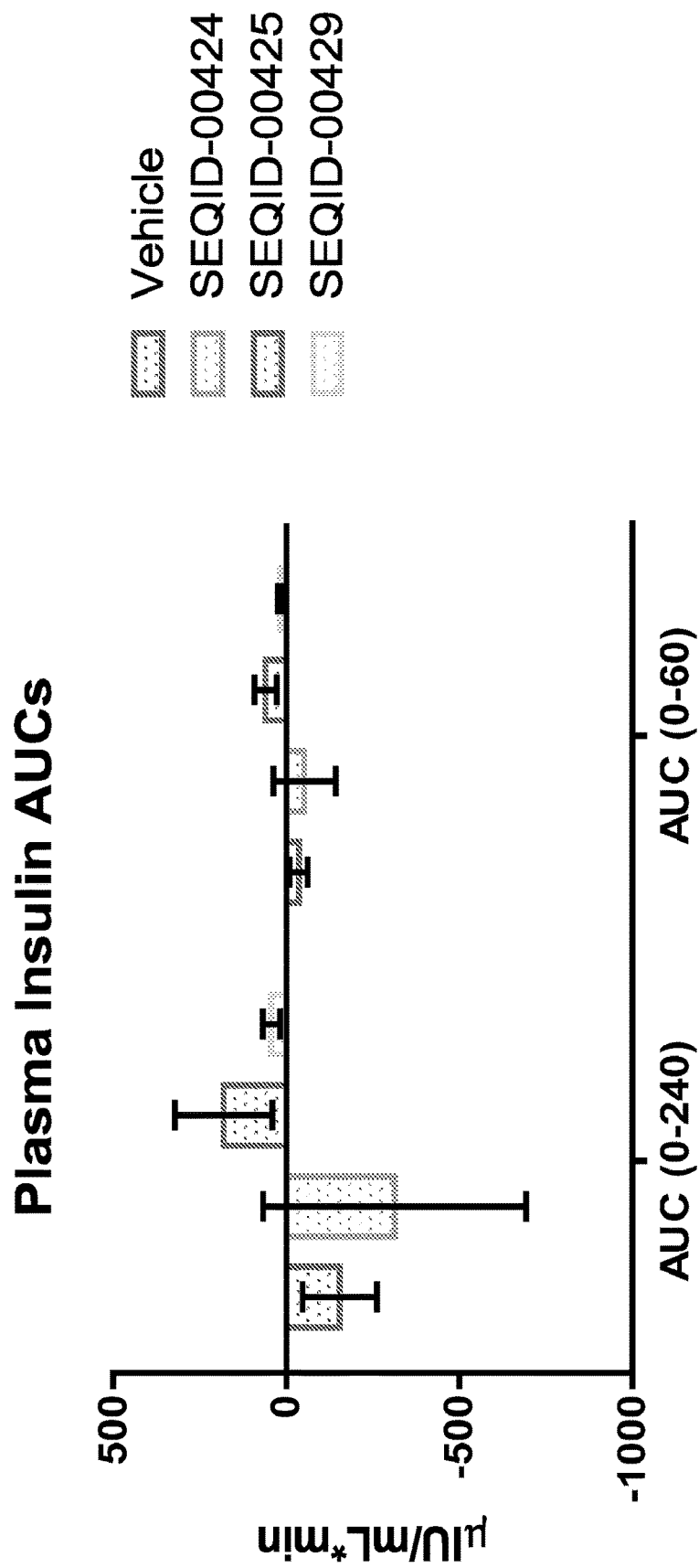
FIG. 26 is a chart demonstrating integrated area under curves for plasma insulin concentrations for vehicle, SEQID-00424, SEQID-00425, and SEQID-00429 between 0 and 240 minutes and between 0 and 60 minutes. Error bars shown here are the standard error of the mean.

FIGS. 25 and 26 shows the integrated area under curves for plasma insulin concentrations shown in FIGS. 23 and 24. One-way ANOVA with Dunnett's multiple comparisons tests were used to compare the AUCs to vehicle. SEQID- 00587 had a significantly greater plasma insulin AUC when integrated at 0-240 minutes (P<0.005).

Figure 27:
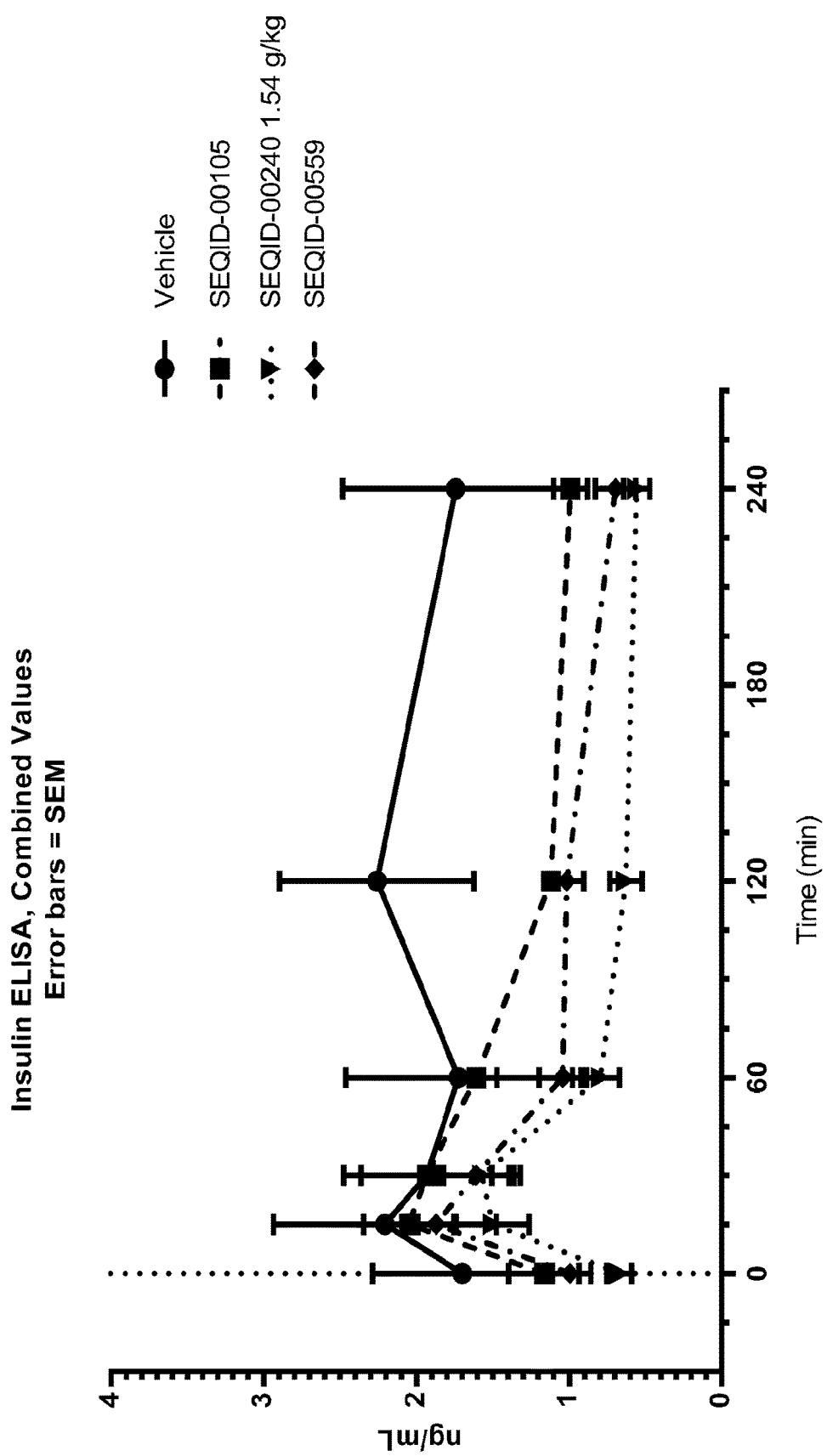
FIG. 27 is a chart demonstrating ELISA plasma insulin over time for vehicle and SEQID-00105, SEQID-00240, and SEQID-00559. Error bars shown here are the standard error of the mean.

FIG. 27 shows the combined biological replicate data for a study of vehicle and SEQID-00105, SEQID-00240, and SEQID-00559, where plasma insulin was measured using the Rat Insulin ELISA kit. All error bars represent the standard error of the mean. One-way ANOVA with Dunnett's multiple comparisons tests were used to compare within each treatment to time 0. SEQID-00105, and SEQID-00559 both had a statistically significant increase in plasma insulin concentration at 15 minutes post gavage compared to time 0 (P<0.05, both). SEQID-00240 had statistically significant increase in plasma insulin at 15 and 30 minutes post gavage compared to time 0 (P<0.05 & P<0.01, respectively). The vehicle had no statistically significant change in plasma insulin concentration compared to time 0.

Figure 28:
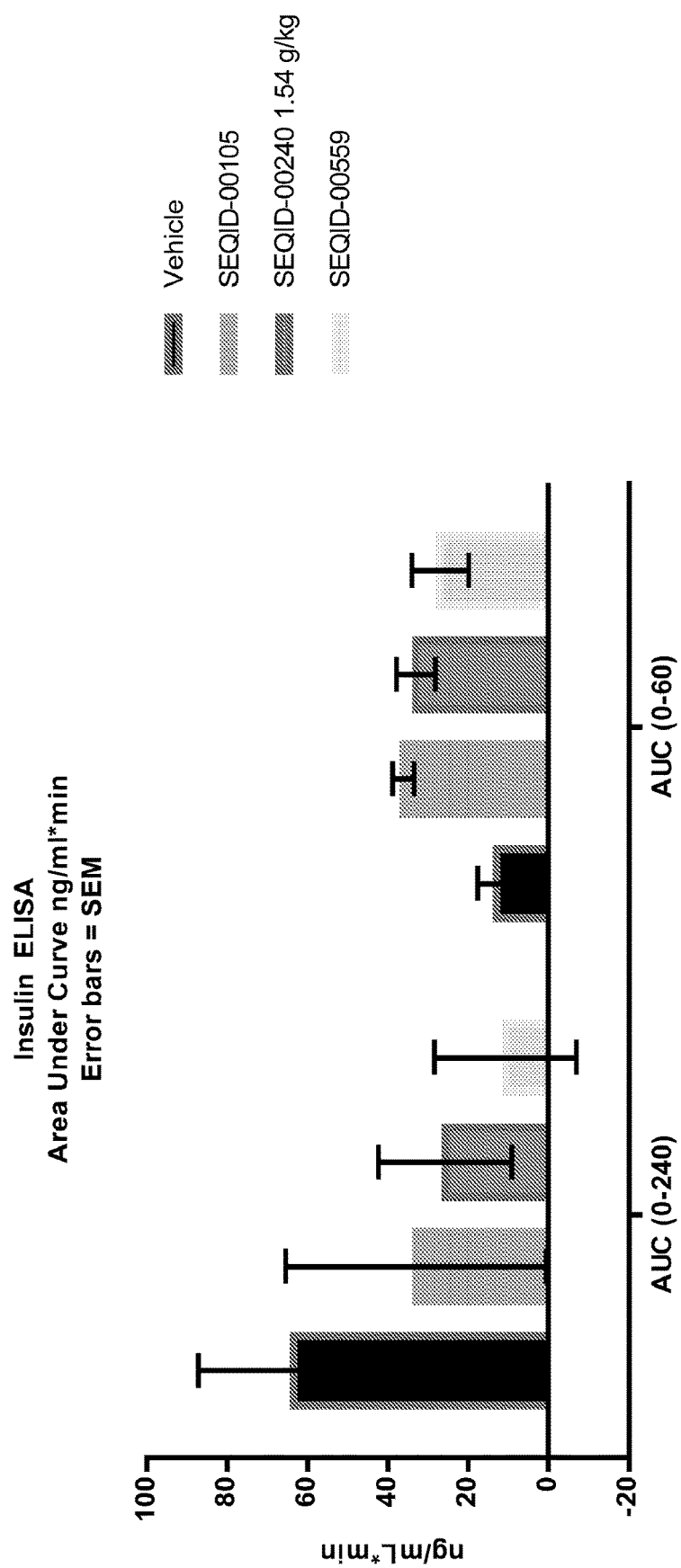
FIG. 28 is a chart demonstrating integrated area under curves for plasma insulin concentrations for vehicle, SEQID-00105, SEQID-00240, and SEQID-00559 between 0 and 240 minutes and 0 and 60 minutes. Error bars shown here are the standard error of the mean.

FIG. 28 shows the integrated area under curve from 0-240 and 0-60 minutes post gavage for each treatment, error bars are the standard error of the mean. No treatment showed a significantly greater AUC compared to vehicle at 0-60 or 0-240 minutes by a Dunnett's multiple comparisons test.

Example 25

Nutritive Polypeptide Stimulation of Glucagon Like Peptide 2 Secretion in Healthy, Fasted Rats Glucagon-like peptide-2 (GLP-2) is a thirty three amino acid peptide produced by the post-translational cleavage of proglucagon. GLP-2 is secreted by the intestinal enteroendocrine L-cells of humans and rodents along with GLP-1 in response to exposure to nutrients in the gut lumen. GLP-2 has been shown previously to improve outcomes in the treatment of short bowel syndrome (Brinkman A S, Murali S G, Hitt S, Solverson P M, Hoist J J, Ney D M. 2012. Enteral nutrients potentiate glucagon-like peptide-2 action and reduce dependence on parenteral nutrition in a rat model of human intestinal failure. Am. J. Physiol. Gastrointest. Liver Physiol. 303(5):G610-G622) by supporting intestinal growth (Liu X, Murali S G, Hoist J J, Ney D M. 2008. Enteral nutrients potentiate the intestinotrophic action of glucagon-like peptide-2 in association with increased insulin-like growth factor-I responses in rats. Am. J. Physiol. Gastrointest. Liver Physiol. 295(6):R1794-R1802).

Animals were treated and acutely dosed with test articles as part of pharmacokinetic rodent experiments according to methods described herein. In this experiment, two test articles were analyzed, vehicle and a nutritive formulation of SEQID-240, dosed at 1.54 g/kg.

Total GLP-2 Enzyme-Linked Immunosorbent Assay (ELISA)

Total GLP-2 was measured with Millipore Total GLP-2 ELISA Kit (Millipore, EZGLP2-37K). The ELISA kit was equilibrated to room temperature for a minimum of 30 minutes prior to running the assay. The kit GLP-2 Standard, Quality Control 1 and Quality Control 2 were reconstituted with 500 µL MilliQ water, inverted 5 times and incubated at room temperature for 5 minutes, then gently vortexed to mix. The standard curve was prepared by diluting the GLP-2 Standard serially 1:1 in kit Assay Buffer to generate an eight point standard curve including 0 ng/mL GLP-2. Plasma samples were thawed on ice and centrifuged for 10 minutes at approximately 1109×ref to pellet insoluble material. Fasted plasma matrix from untreated, fasted rat was prepared for running the standard and quality controls in duplicate at 20% (2×).

1× Wash Buffer was prepared in a clean 500 mL glass bottle by combining 50 mL 10× Wash Buffer with 450 mL MilliQ water. Strips were prepared by washing 3 times with 300 µL 1× Wash Buffer applied with a 30-300 µL 8-channel pipette. Between washes the wash buffer was decanted into a waste receptacle and the plate tapped sharply on a stack of paper towels to remove remaining wash buffer.

Following the first wash, 90 µL of Assay Buffer was added to sample wells, and 50 µL of 20% matrix in Assay Buffer was added to all standard and quality control wells. 10 µL of sample was added to each sample well and 50 µL of standard and quality control were added to matrix containing wells. Samples, standards and quality control wells were run in duplicate, except for 0 ng/mL GLP-2 standard which was run in quadruplicate.

The plate was sealed with a plastic plate seal and incubated at room temperature on a horizontal plate shaker at 450 rpm for 2 hours. Following the first incubation, the plate was washed three times with 1× Wash Buffer, decanting into a waste receptacle and tapping the inverted plate sharply on a stack of paper towels to remove excess wash buffer after each wash.

100 µL, of Detection Antibody was added to each well and the plate was sealed with a plastic plate seal and incubated at room temperature on a horizontal plate shaker at 450 rpm for 1 hour. Following the second incubation, the plate was washed three times with 1× Wash Buffer, decanting into a waste receptacle and tapping the inverted plate sharply on a stack of paper towels to remove excess wash buffer after each wash.

100 µL Enzyme Solution was added to each well and the plate was sealed with a plastic plate seal and incubated at room temperature on a horizontal plate shaker at 450 rpm for 30 minutes. Following the third incubation, the plate was washed three times with 1× Wash Buffer, decanting into a waste receptacle and tapping the inverted plate sharply on a stack of paper towels to remove excess wash buffer after each wash.

100 µL Substrate was added to each well and the plate was sealed with a plastic plate seal and an opaque foil seal and incubated at room temperature on a horizontal plate shaker at 450 rpm for 20 minutes. Following substrate reaction, 100 µL of Stop Solution was added to each well and the plate gently shaken to mix.

Absorbance was measured on a SynergyMX Plate Reader at 450 nm and 590 nm. Measured values were the difference between 450 nm and 590 nm absorbance values.

Data were analyzed with GraphPad Prism 6.03. A standard curve was generated to log(Total GLP-2 (ng/mL)) after subtracting the 0 ng/mL background value. Rat plasma GLP-2 concentrations were interpolated using a sigmoidal, four parameter logistic equation. The mean of duplicate concentration of GLP-2 in the technical replicates for each rat were plotted against time. The integrated area under curve was calculated on Microsoft Excel where the area between each time point was calculated for each biological replicate as the sum of the areas using the Linear-Log Trapezoidal Method.

Figure 29:
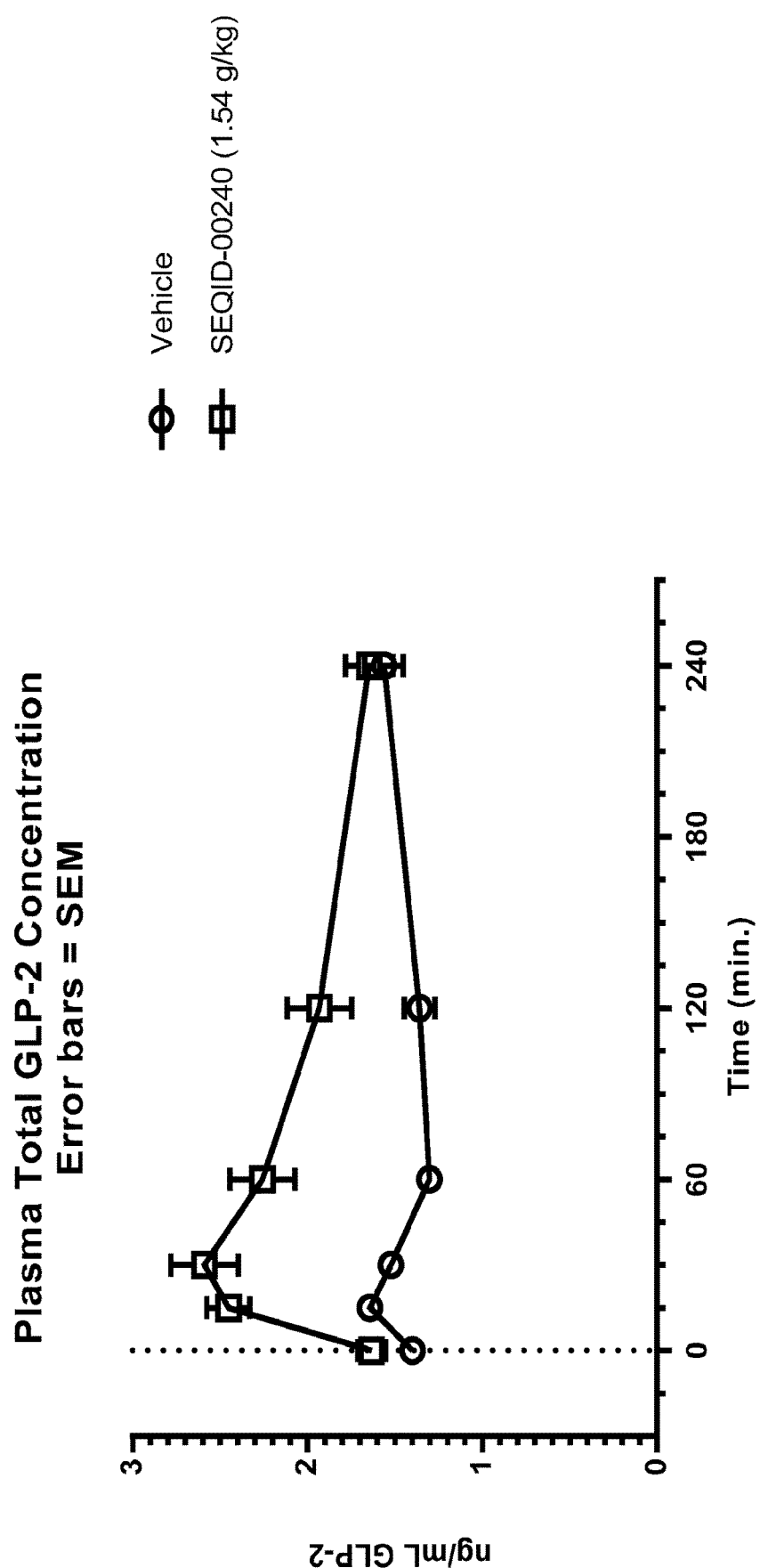
FIG. 29 is a chart demonstrating GLP-2 concentration over a 4 hour time course for vehicle and SEQID-00240, n=4 and n=5 rats, respectively. Error bars shown are the standard error of the mean.

FIG. 29 shows the calculated total GLP-2 concentration over a 4 hour time course for SEQID-00240 and vehicle control. Vehicle GLP-2 concentration did not change significantly at any of the time points sampled compared to time 0, whereas SEQID-00240 showed a statistically significant increase in GLP-2 concentration relative to time 0 at 15 (P<0.00), 30 (P<0.0001) and 60 minutes (P<0.01) following SEQID-00240 gavage (Dunnett's multiple comparison test). SEQID-00240 was compared to vehicle at each time point by ordinary One-Way ANOVA with a Dunnett's multiple comparisons test post hoc analysis. GLP-2 concentration was not significantly different between treatments at time 0. GLP-2 concentrations were statistically significantly greater than vehicle at 15 (P<0.001), 30 (P<0.0001), 60 (P<0.0001) and 120 minutes (P<0.05) following treatment. These data show that an acute dose of SEQID-00240 but not vehicle induces secretion of GLP-2 in healthy fasted rodents.

Figure 30:
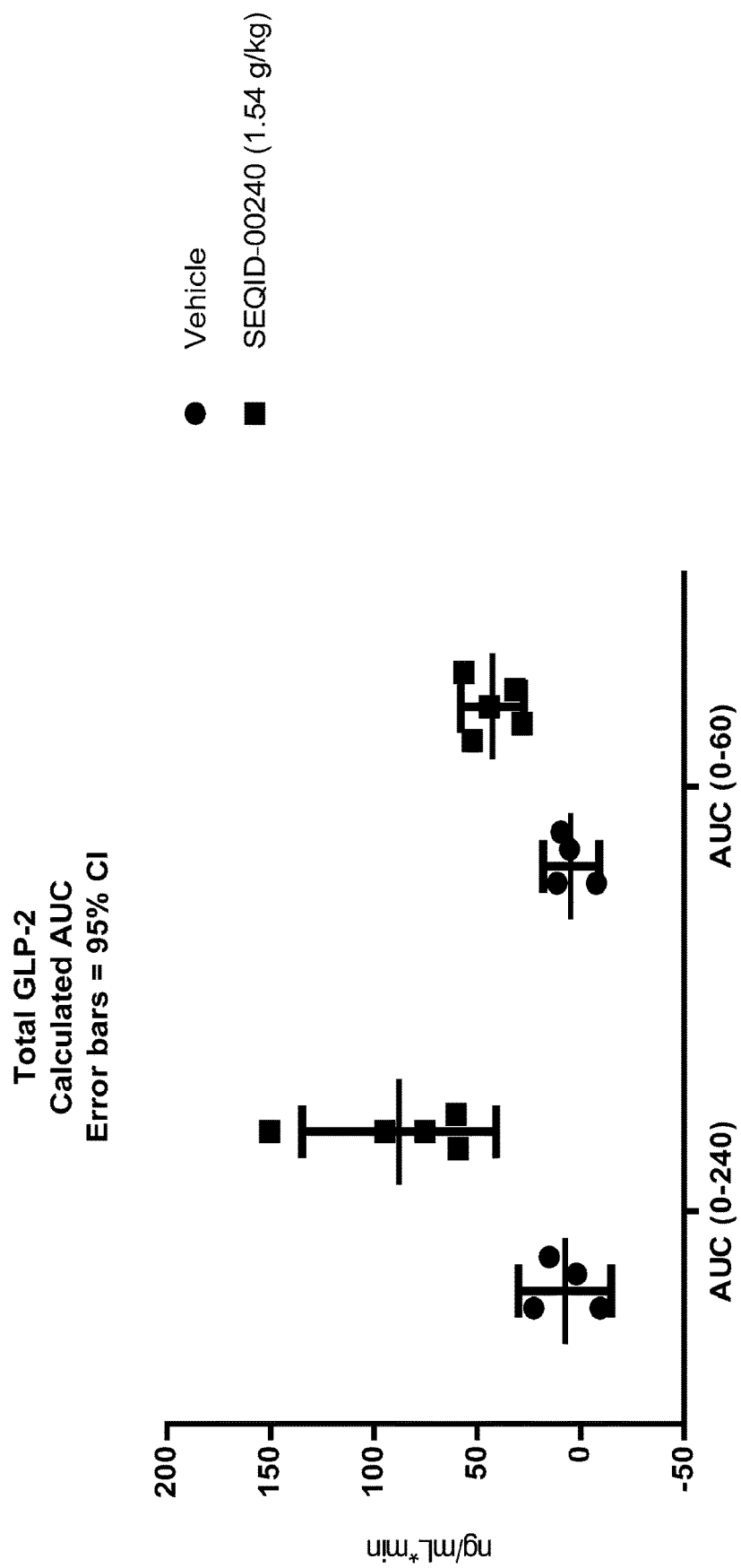
FIG. 30 is a chart demonstrating integrated GLP-2 area under the curve over the first hour and the full 4 hours. Error bars shown are the 95% confidence interval.

FIG. 30 shows the integrated GLP-2 area under the curve over the first hour and the full 4 hours. The area under curve for GLP-2 was significantly greater in the SEQID-00240 treatment compared to vehicle when integrated over 0-60 minutes and over 0-240 minutes (P<0.005 & P<0.01, respectively, unpaired 2-tailed Student's t-test). This data indicated that acute dosing of SEQID-00240 significantly stimulated GLP-2 secretion in comparison to vehicle within the first hour of acute dosing in healthy fasted rodents.

Example 26

Figure 31:
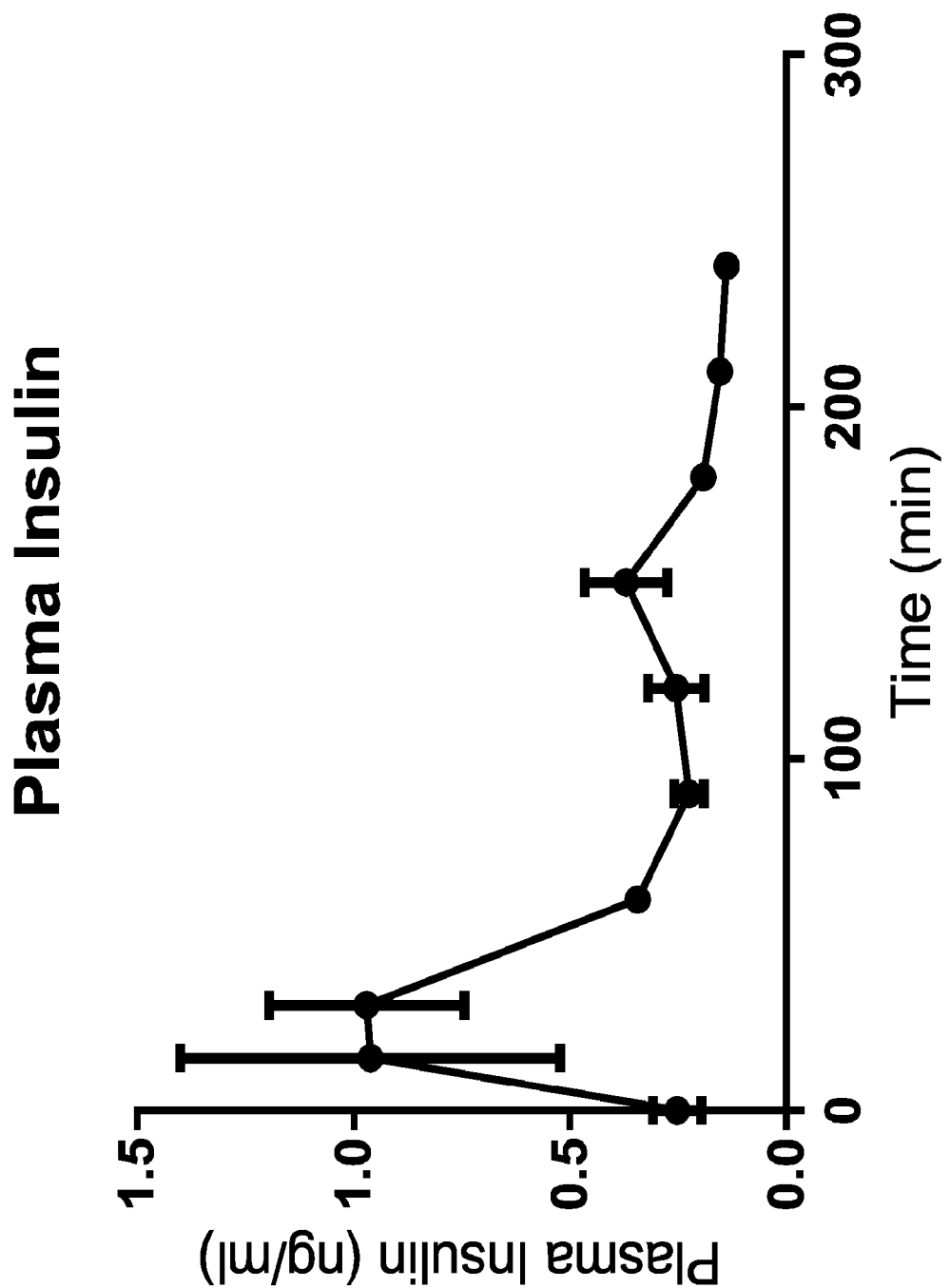
FIG. 31 is a chart demonstrating average plasma insulin response to SEQID-00105 of all subjects over time.
Figure 32:
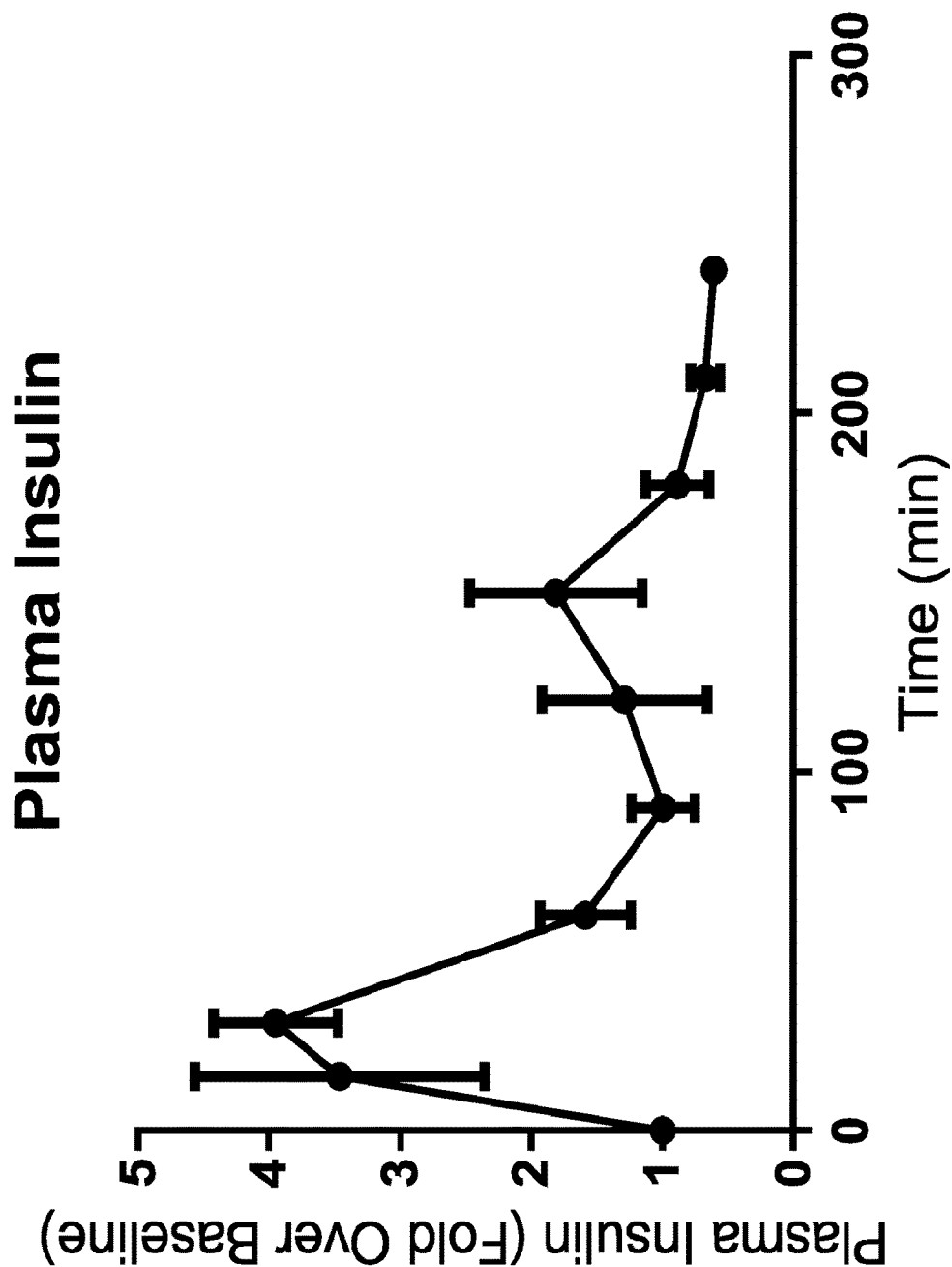
FIG. 32 is a chart demonstrating average plasma insulin fold response to SEQID-00105 over baseline.

Effect of Orally Delivered Nutritive Polypeptides on Plasma Insulin and Incretin Levels in Humans The insulin and incretin response to protein ingestion is predicated on the delivery of amino acids. The purpose of this study was to examine the changes in plasma insulin concentrations in response to SEQID-00426 and SEQID-00105 over a period of 240 minutes. Two groups of four apparently healthy subjects between the ages of 18 and 50 received 20 grams of the nutritive polypeptide formulations orally. All subjects were fasted overnight (>8 hrs) before starting the study. Venous blood samples were collected at specified time points (i.e. 0, 15, 30, 60, 90, 120, 150, 180, 210 and 240 minutes) following the oral ingestion of nutritive polypeptide to assess changes in plasma insulin and incretin concentrations. FIG. 31 shows the average insulin response of all subjects to SEQID-00105, and FIG. 32 shows the average fold response over baseline (time 0 min), measured as described herein. The error bars on all figures correspond to the standard error of the mean. The first phase insulin response occurs between time 0 min and 90 min. The second phase insulin response occurs between 90 min and 210 min. A 1-way ANOVA comparison across time indicates that there is a significant change in plasma insulin over time (p=0.003). A Dunnett multicomparison test indicates that the insulin values at 15 and 30 min time points are significantly different from that at time 0 min (p<0.05).

Figure 33:
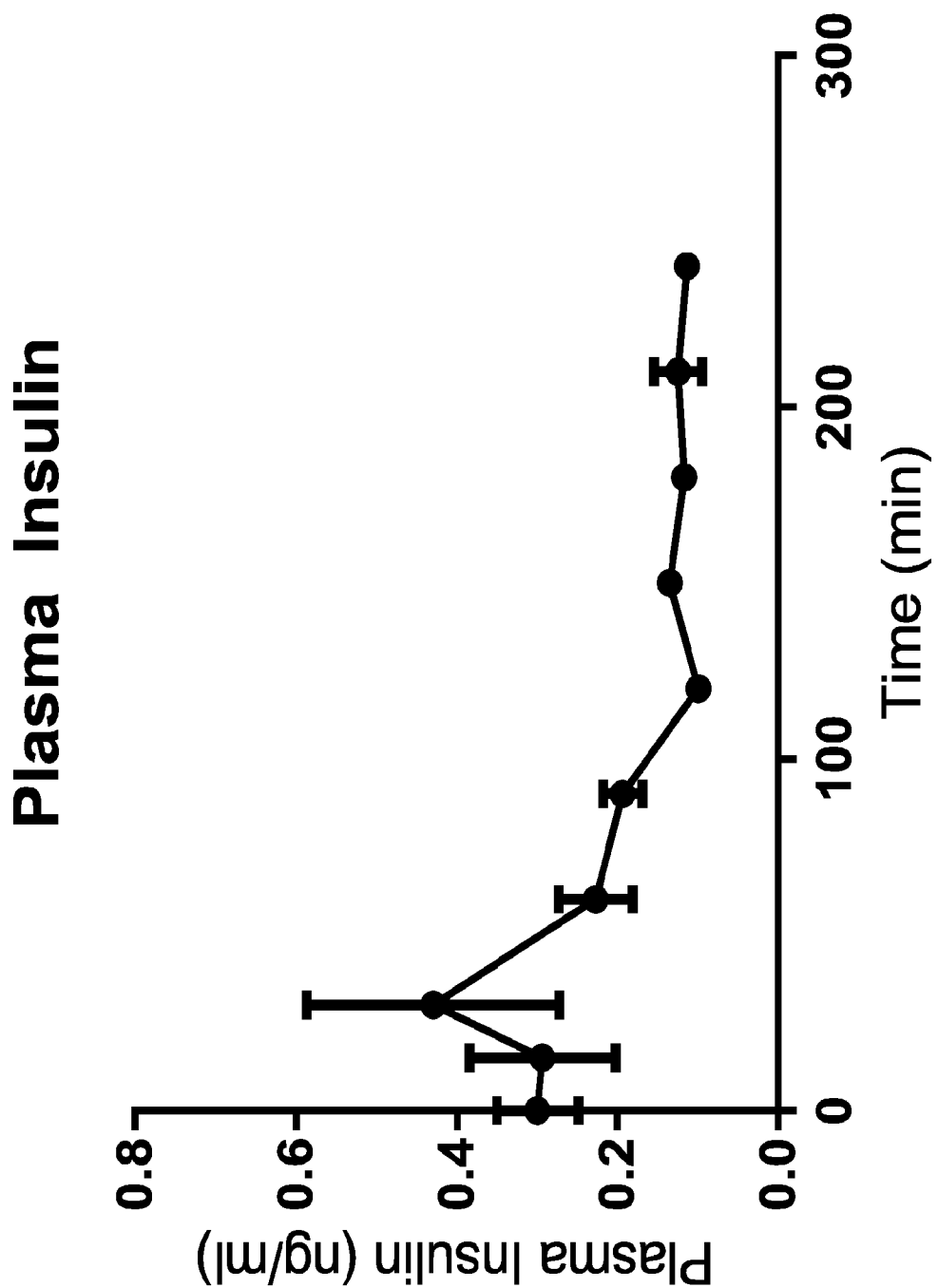
FIG. 33 is a chart demonstrating average plasma insulin response to SEQID-00426 of all subjects over time.
Figure 34:
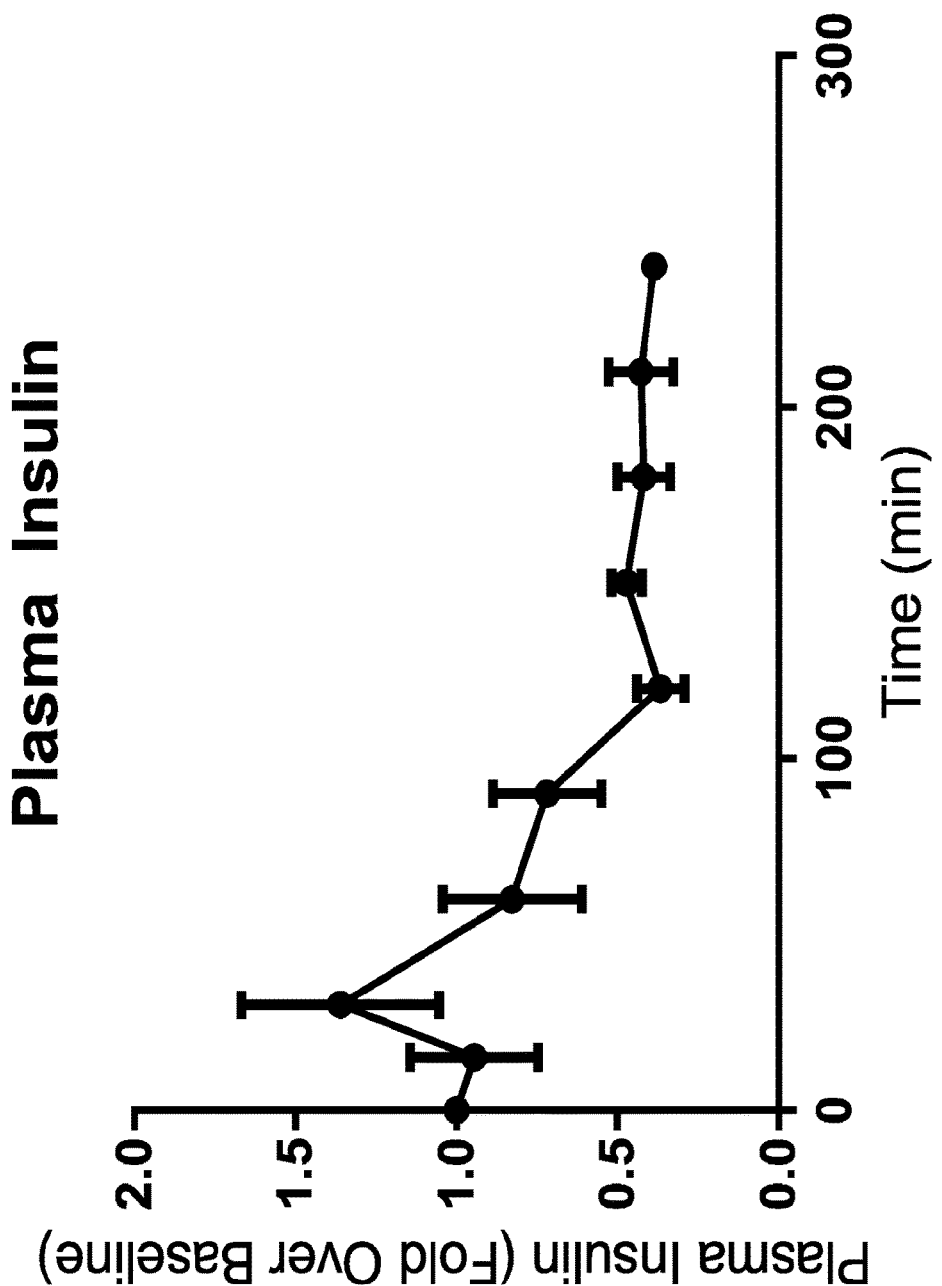
FIG. 34 is a chart demonstrating average plasma insulin fold response to SEQID-00426 over baseline.

FIG. 33 shows the average insulin response of all patients to SEQID-00426, and FIG. 34 shows the average fold response over baseline (time 0 min), measured as described herein. The error bars on all figures correspond to the standard error of the mean.

Figure 35:
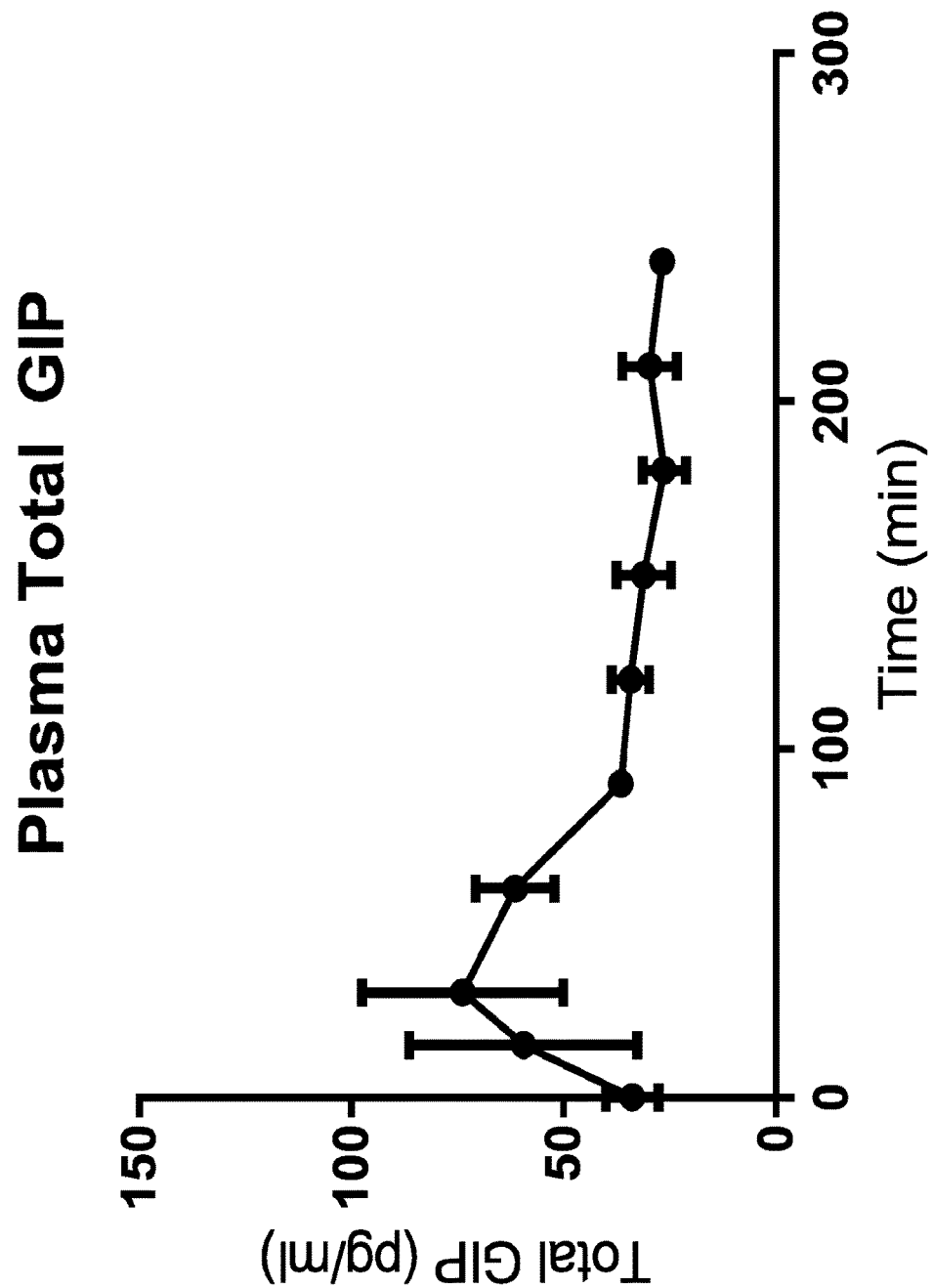
FIG. 35 is a chart demonstrating average total Gastric Inhibitory Polypeptide (GIP) response of all patients to SEQID-00426.
Figure 36:
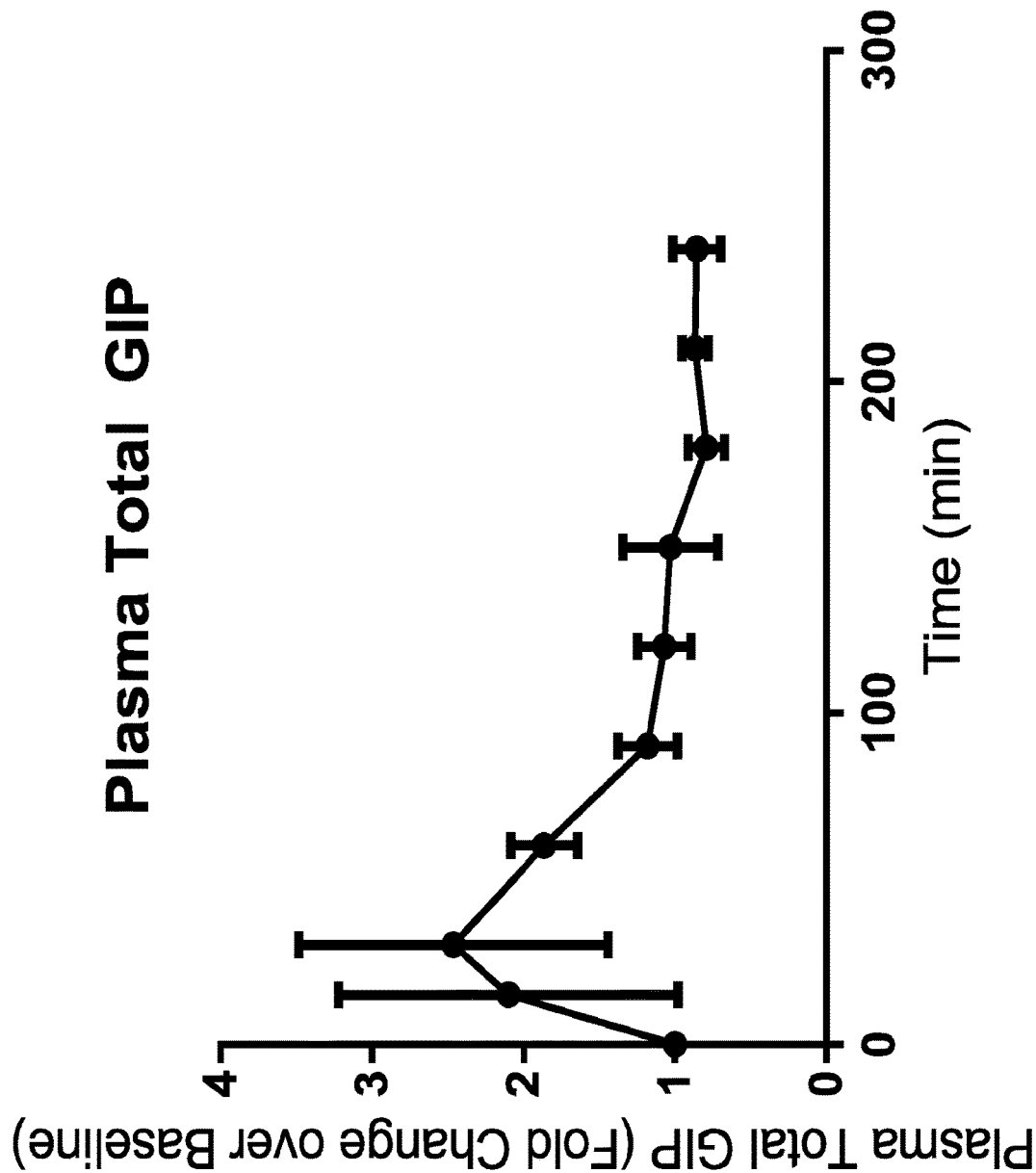
FIG. 36 is a chart demonstrating a Gastric Inhibitory Polypeptide (GIP) fold response of all patients to SEQID-00426.

FIG. 35 shows the average total Gastric Inhibitory Polypeptide (GIP) response of all patients to SEQID-00426, and FIG. 36 shows the average fold response over baseline (time 0 min), measured as described herein. The error bars on all figures correspond to the standard error of the mean.

Example 27

In Vitro Demonstration of Skeletal Muscle Cell Growth and Signaling Using Nutritive Polypeptide Amino Acid Compositions Containing Tyrosine, Arginine, and/or Leucine The mammalian target of rapamycin (mTOR) is a protein kinase an a key regulator of cell growth, notably via protein synthesis. mTOR acts as a master regulator of cellular metabolism that nucleates two complexes; mTORC1 and mTORC2 that have different kinase specificity and distinct protein partners (citations from ESS-020).

mTOR drives protein synthesis across tissues. mTORC1 mediated response to growth signaling is gated by amino acids. The localization of the response to lysosomes couples mTOR activation to muscle protein catabolism. mTORC1 can be gated by essential amino acids (EAAs), leucine, and glutamine. Amino acids must be present for any upstream signal, including growth factors, to activate mTORC1 (citations from ESS-020).

These experiments demonstrated the capacity of arginine, tyrosine as well as leucine to modulate mTORC1 activation by measuring downstream phosphorylation of the ribosomal protein S6 (rps6) in response to stimulation by single amino acids in vitro.

Primary Rat Skeletal Muscle Cell (RSKMC) culture medium was purchased from Cell Applications (Catalog number: R150-500, San Diego, Calif.). Starvation medium DMEM/F12 was bought from Sigma (Catalog number: D9785, St. Louis, Mo.). Customized starvation medium Mod.4 was purchased from Life Technologies (Catalog number: 12500062, Grand Island, N.Y.), which does not contain any amino acids, phenol red, or glucose. Fetal bovine serum (FBS) and other growth factors were obtained from Cell Applications (Catalog number: R151-GS, San Diego, Calif.). Tissue culture flasks and clear bottom 96-well tissue culture plates were purchased from Corning Incorporated (Catalog number: 430641 and 353072, respectively, Corning, N.Y.). Trypsin/EDTA was obtained from Life Technology (Catalog number: 25200, Grand Island, N.Y.). DPBS and HBSS were also purchased from Life Technologies (Catalog number: 14190, 14175, respectively). AlphaScreen® SureFire® Ribosomal Protein S6 Assay Kits was obtained from Perkin Elmer (Catalog number: TGRS6P2S10K).

Primary Rat Skeletal Muscle Cell (RSKMC) culture. RSKMC were isolated using protocol described herein and cryopreserved in liquid nitrogen. The cells were also maintained in RSKMC medium (Cell Applications) in T75 tissue flask in a 37° C., 5% CO2 tissue culture incubator (Model 3110, Thermo Fisher Scientific). The cells were split every three day when they reached 90% confluency. RSKMC cells were cultured in RSKMC medium in T75 tissue flask to 100% confluency. The culture medium was aspirated from the culture flask and rinsed once with 10 ml of DPBS, and then 1.5 ml of 0.25% trypsin/EDTA was added to the cells. After the cells were detached from the flask, 10 ml of culture medium were added. The medium was pipetted up and down with a 10 ml pipet to detach the cells from the flask. The cells were then seeded into clear bottom 96-well tissue culture plates at a density of 50,000 cells per well. Following overnight culture in a 37° C., 5% CO2 incubator, the cells were starved over a period of 4 hours with starvation DME/F12 medium without FBS and leucine in a 37° C., 5% CO2 tissue culture incubator, then starved for another hour incubation with Hank's Buffered Salt Solution (HBSS). The cells were stimulated with different concentrations of leucine in starvation medium for 15 and 30 minutes. The cells were also treated with 5 nM of Rapamycin (R0395, Sigma) or 100 nM of Insulin (19278, Sigma) for 15 and 30 minutes. The cells were lysed in 20 µL of Lysis Buffer (Perkin Elmer) for 10 minutes at room temperature with shaking at 725 rpm. The cell lysates were stored at 80° C. and AlphaScreen® assay was performed the next day. AlphaScreen® SureFire® Ribosomal Protein S6 Assay was performed according to manufacturer's manual.

Figure 37:
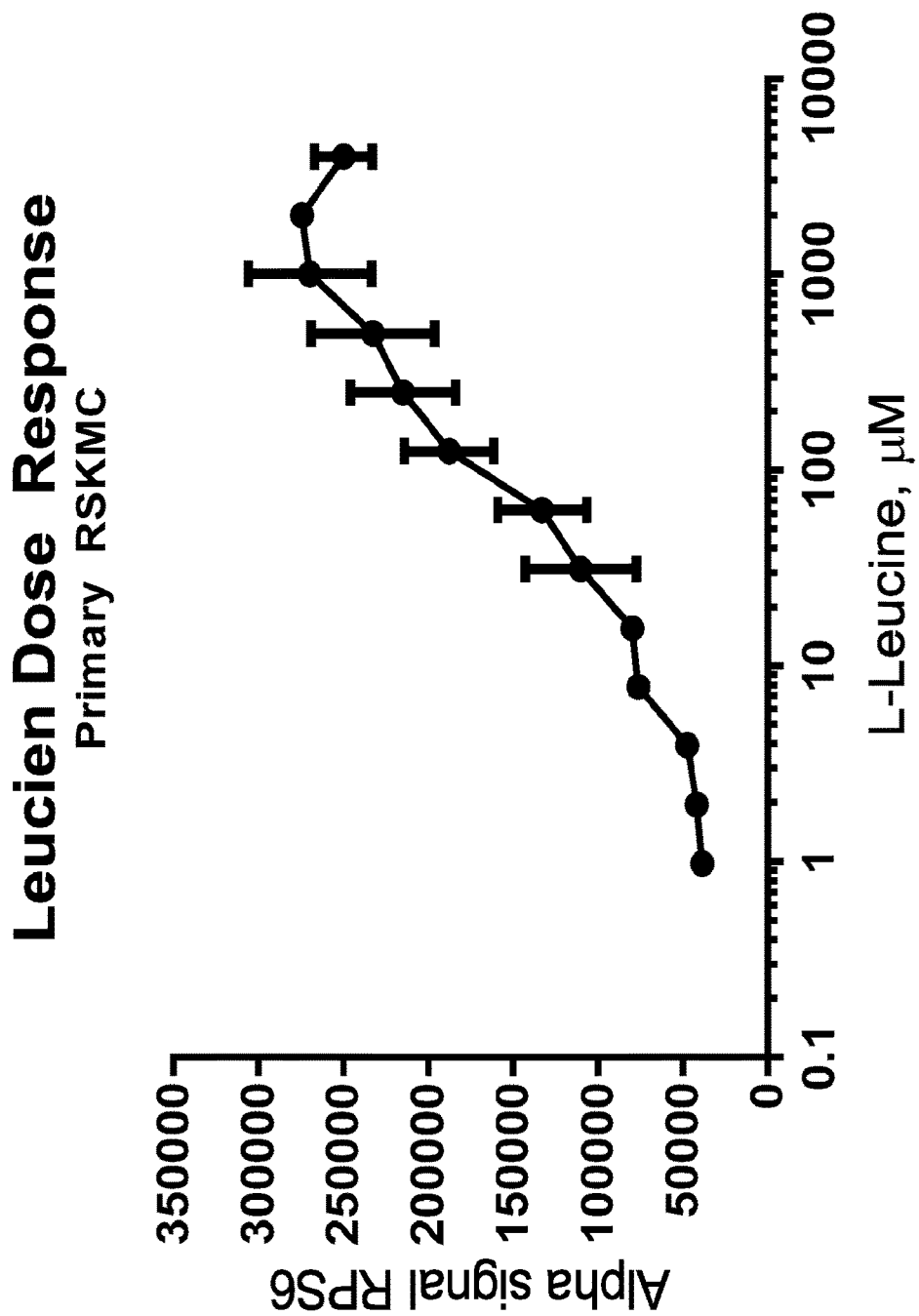
FIG. 37 is a chart demonstrating alphascreen signal (y-axis) measured at different Leucine concentrations. Error bars shown are the standard deviation of replicates.

FIG. 37 shows the relative alphascreen signal (y-axis) measured at different Leucine concentrations, demonstrating that leucine stimulates phorphorylation of rps6 in primary RSkMC in a dose-dependent manner. This stimulation was inhibited in a dose dependent manner by the mTOR inhibitor, rapamycin.

Figure 38:
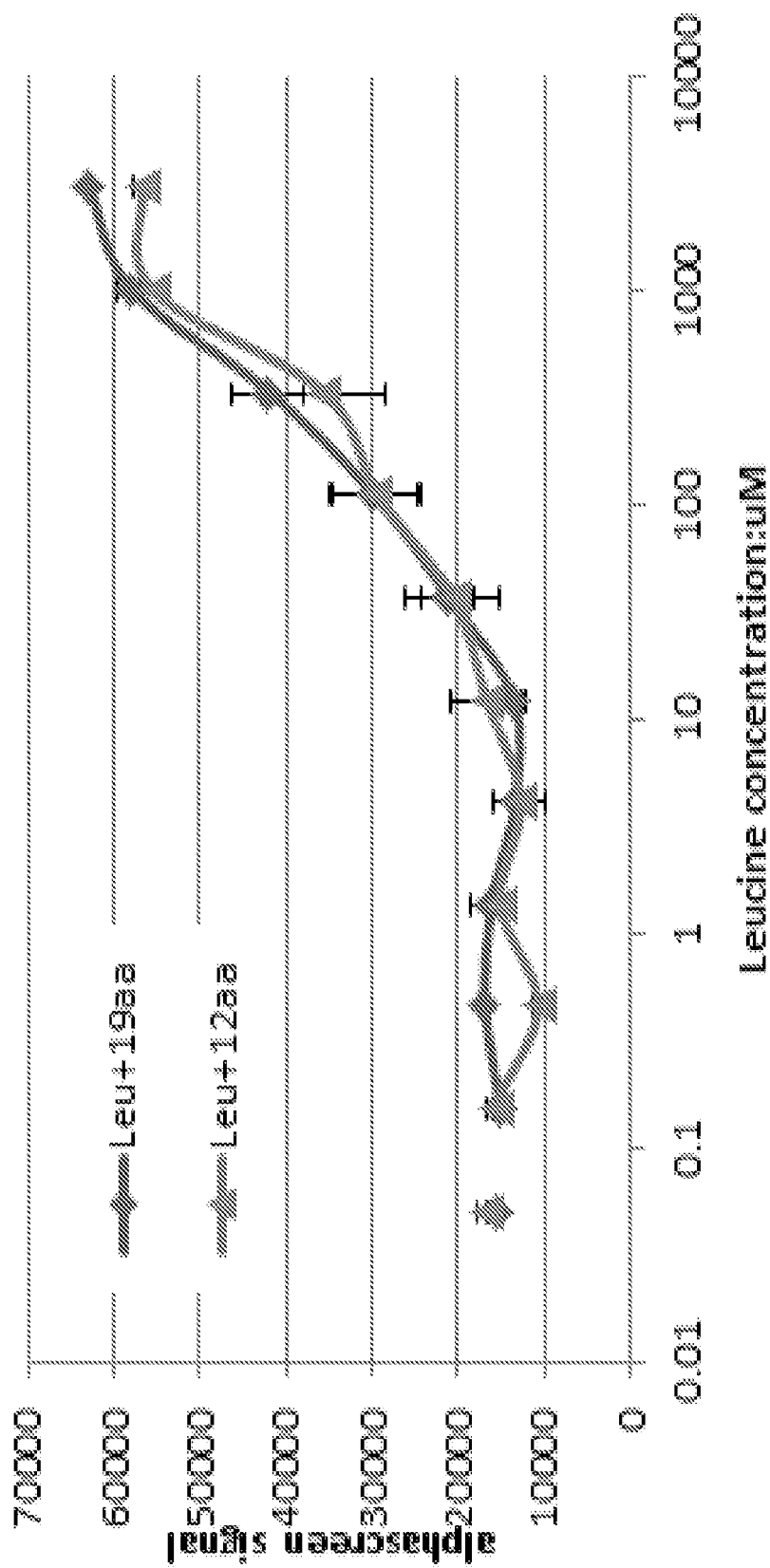
FIG. 38 is a chart demonstrating Leucine Dose Response in Minimal Amino Acid Media in Primary RSKMC. Error bars shown are the standard deviation.

FIG. 38 shows that leucine stimulates phosphorylation of rps6 in primary RSkMC in a dose-dependent manner in both a complete amino acid medium (Arg, His, Lys, Asp, Glu, Scr, Thr, Asn, Gln, Cys, Gly, Pro, Ala Val, Ile, Met, Phe, Tyr, Trp), as well as a minimal 12 amino acid mixture containing only (Arg, His, Lys, Thr, Gln, Cys, Val, Ile, Met, Phe, Tyr, and Trp) at their DME/F12 concentrations (see table E27B).

Figure 39:
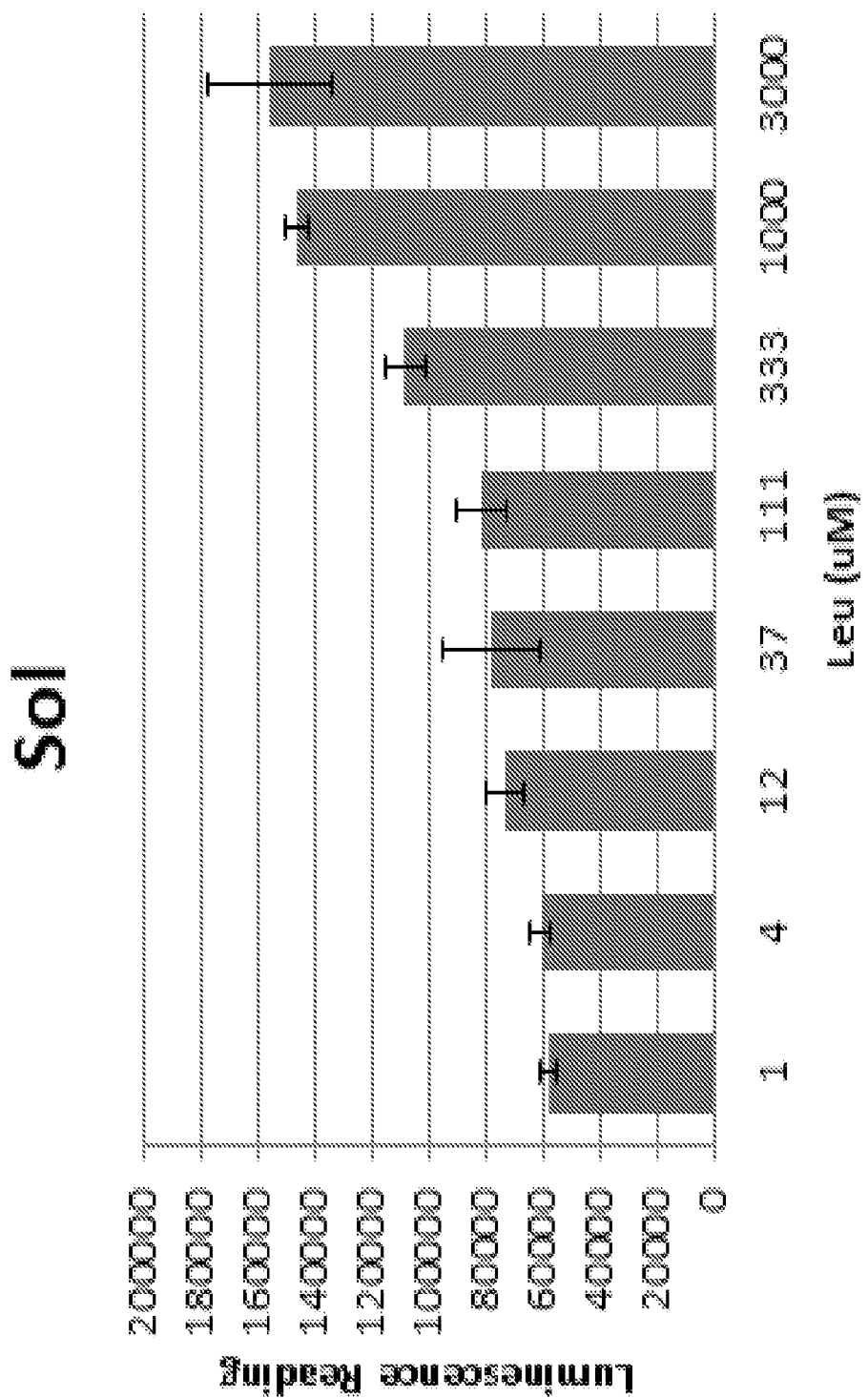
FIG. 39 is a chart demonstrating In vitro Leucine Dose Response of rps6 Phosphorylation in Isolate Soleus Muscle. Error bars shown are the standard deviation.
Figure 40:
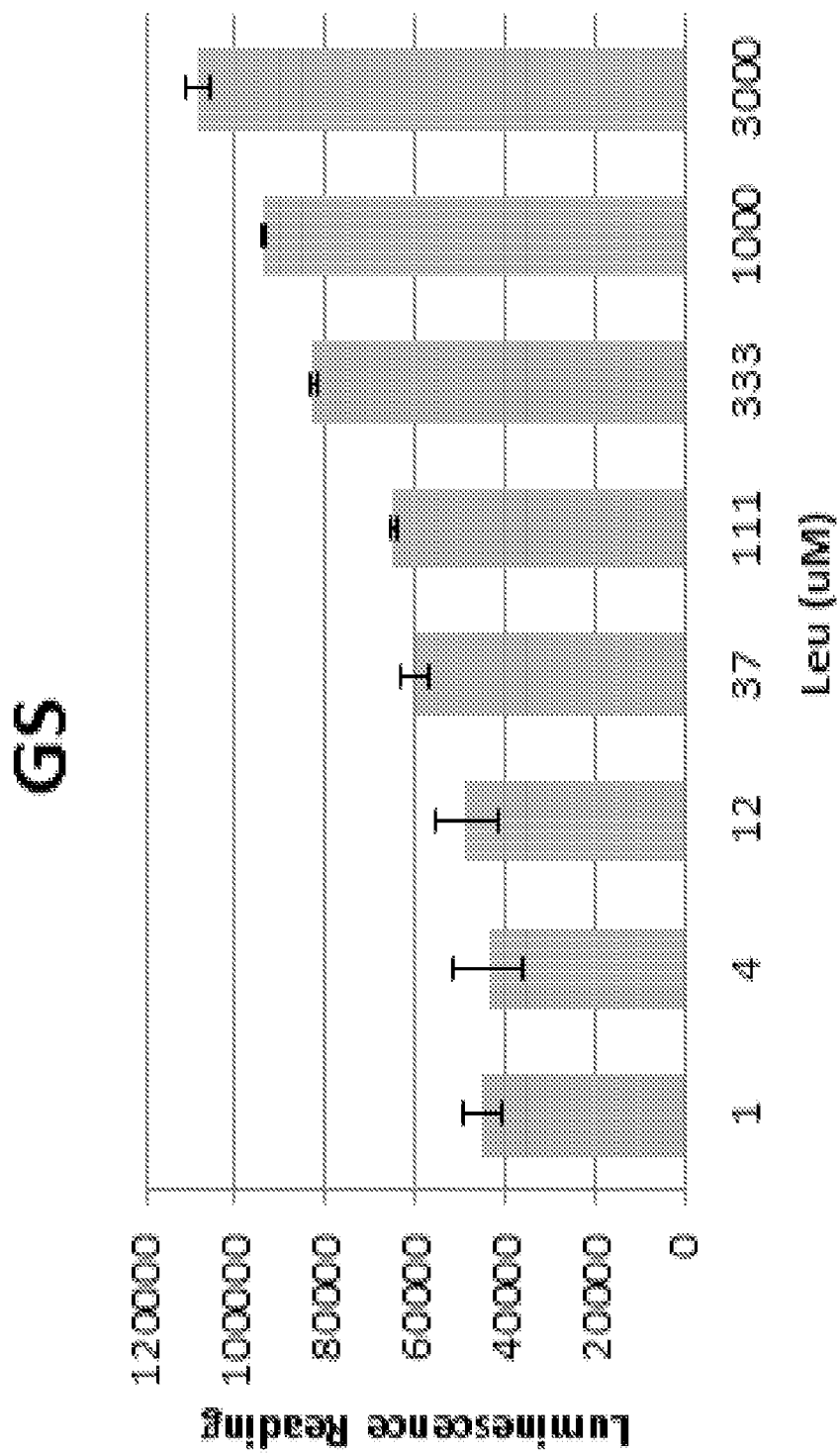
FIG. 40 is a chart demonstrating In vitro Leucine Dose Response of rps6 Phosphorylation in Isolated Gastrocnemius Muscle. Error bars shown are the standard deviation.
Figure 41:
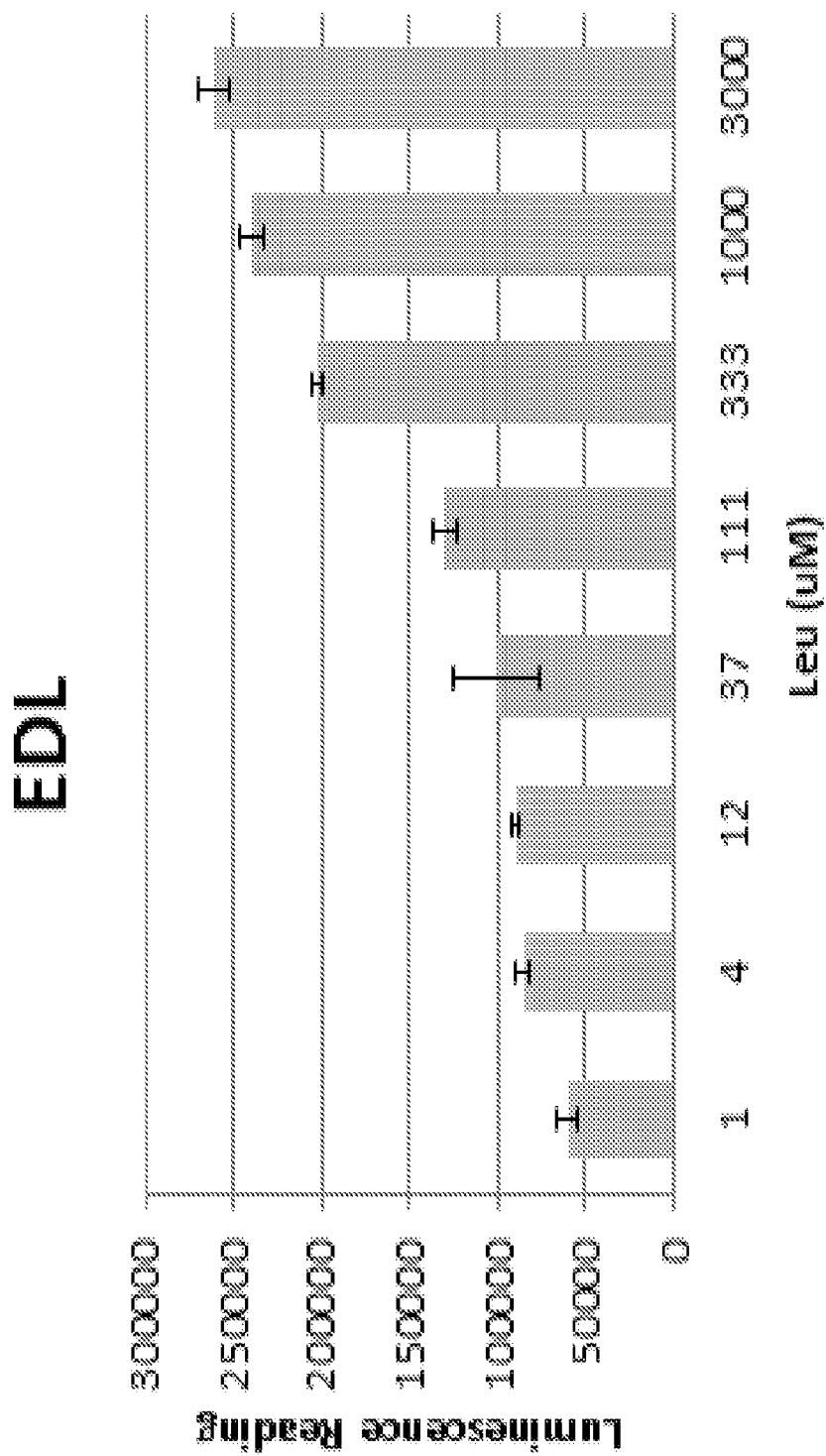
FIG. 41 is a chart demonstrating In vitro Leucine Dose Response of rps6 Phosphorylation in Isolate Extensor Digitorum Longus Muscle. Error bars shown are the standard deviation.

Primary skeletal muscle cells obtained from the Soleus (Sol), gastrocnemius (GS) and extensor digitorum longus (EDL) of two Sprague-Dawley rats. FIGS. 39, 40, and 41 shows that leucine stimulates mTOR RPS6 pathway using isolated primary cells in a dose dependent manner.

Arginine, tyrosine and leucine are required to fully stimulate the mTOR pathway. Cells were starved as described above in Mod.4 medium without fetal bovine serum and then stimulated in Mod.4 medium lacking each of the respective single amino acids (see table E27A and E27B for composition of Mod.4 medium and DME/F12 amino acid levels, respectively).

TABLE E27A

| Vitamins | μM | Other | mM | Inorganic Salts | mM |
| --- | --- | --- | --- | --- | --- |
| Choline chloride | 64.1 | D-Glucose (Dextrose) | 17.5 | Calcium chloride, anhydrous | 1.05 |
| D-Calcium pantothenate | 4.7 | Sodium Pyruvate | 0.5 | Copper (II) Sulfate Pentahydrate | 5.21E−06 |
| Folic Acid | 6.01 | HEPES | 15 | Magnesium Sulfate (anhyd.) | 0.407 |
| Niacinamide | 16.56 | Hypoxanthine | 0.018 | Magnesium Chloride | 0.301 |
| Pyrodoxine hydrochloride | 9.88 | Linoleic Acid | 1.50E−04 | Potassium Chloride | 4.157 |
| Riboflavin | 0.58 | Putrescine Hydrochloride | 5.03E−04 | Sodium Bicarbonate | 0.014 |
| Thiamine hydrochloride | 6.44 | Thioctic Acid | 5.10E−04 | Sodium Chloride | 120.6 |
| i-inositol | 70 | Thymidine | 1.51E−03 | Sodium Phosphate Monobasic | 0.521 |
| D-biotin | 1.43E−02 | Phenol Red | $5.00 \times 10^{-4}$ (%) | Sodium Phosphate Dibasic | 0.5 |
| Vitamin B-12 | 0.5 | | | Iron (III) Nitrate Nonahydrate | 1.24E−04 |
| | | | | Iron (II) Sulfate Heptahydrate | 1.50E−03 |
| | | | | Zinc Sulfate heptahydrate | 1.50E−03 |

TABLE E27B

| Amino Acids | μM |
| --- | --- |
| Glycine | 250 |
| L-Alanine | 50 |
| L-Arginine | 700 |
| L-Asparagine | 57 |
| L-Aspartic Acid | 50 |
| L-Cysteine | 100 |
| L-Glutamic Acid | 100 |
| L-Glutamine | 2500 |
| L-Histidine | 150 |
| L-Isoleucine | 416 |
| L-Leucine | 451 |
| L-Lysine | 500 |
| L-Methionine | 116 |
| L-Phenylalanine | 215 |
| L-Proline | 150 |
| L-Serine | 250 |
| L-Threonine | 449 |
| L-Tryptophan | 44 |
| L-Tyrosine | 214 |
| L-Valine | 452 |

Figure 42:
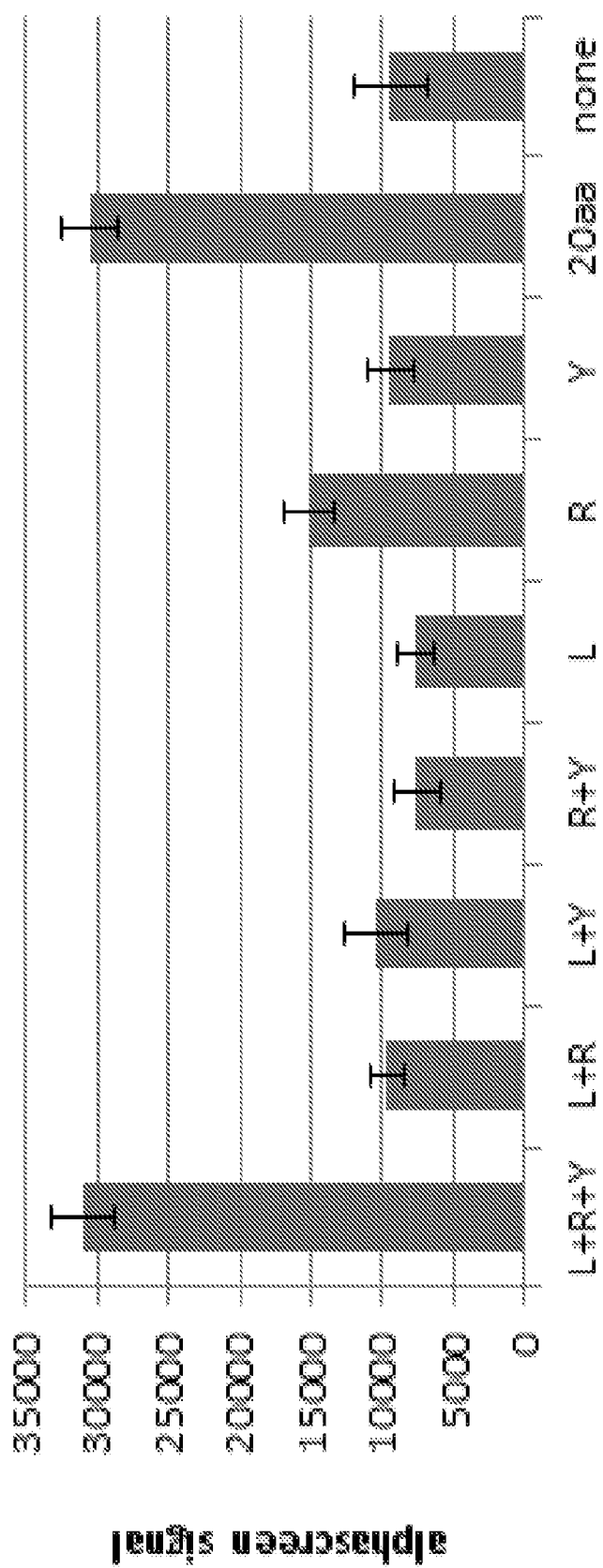
FIG. 42 is a chart demonstrating Combined Activity of Leu/Tyr/Arg on RPS6 Phosphorylation. Error bars shown are the standard deviation.

Primary muscle cells were starved for 2 hours, and then stimulated with 0 μM or 500 μM single amino acid in 37 C, 5% CO2 tissue culture incubator for 30 minutes. The treatment was performed in triplicate. FIG. 42 demonstrates that the combination of leucine, arginine, and tyrosine are necessary and sufficient to activate the mTOR pathway in RMSKC to the same degree as a full complement of all 20 amino acids at their DME/F12 concentrations, and that none of the individual or paired treatments of Leu, Arg, or Tyr were capable of a similar response.

Figure 43:
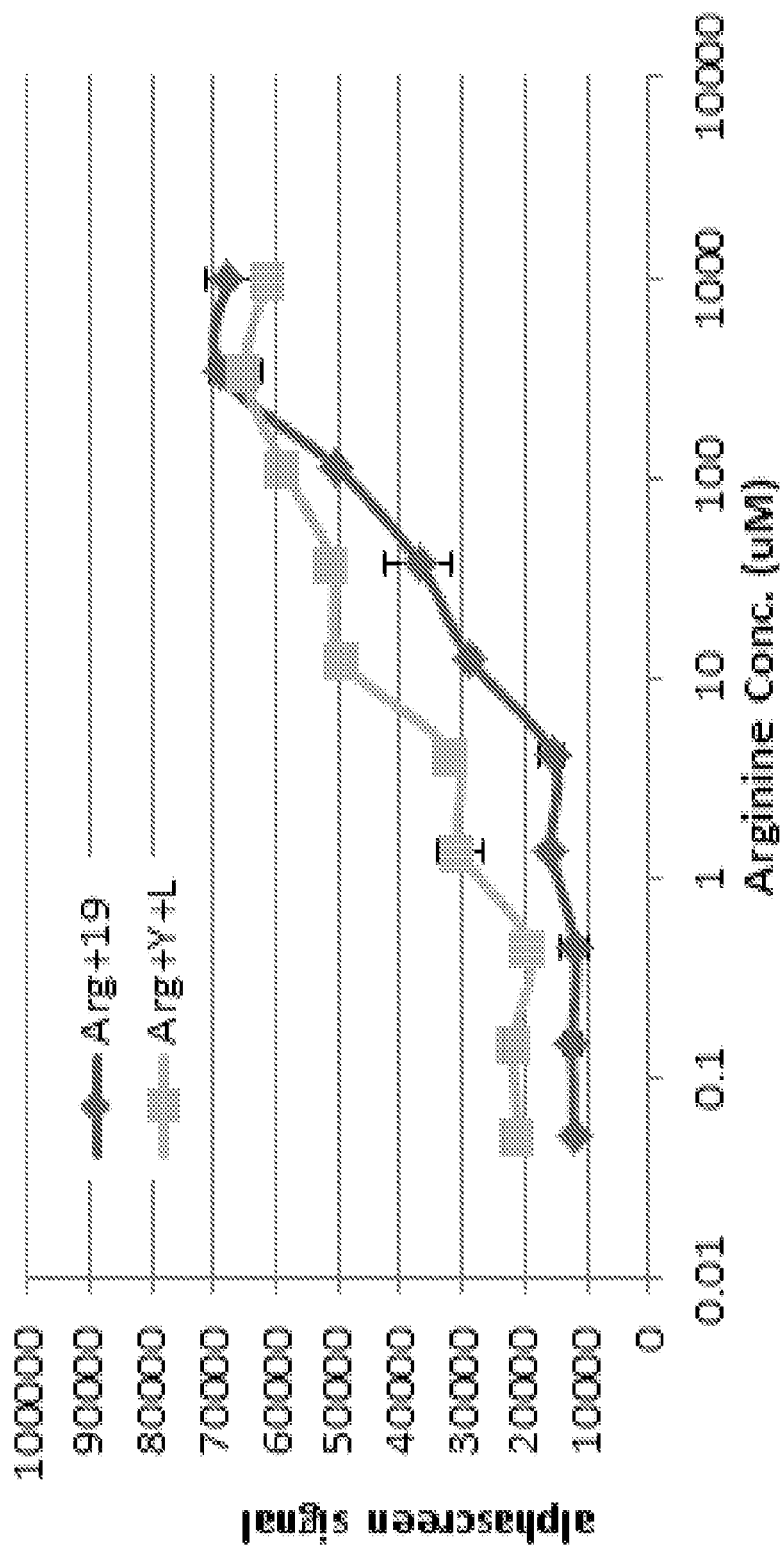
FIG. 43 is a chart demonstrating Arginine Stimulation of RPS6 in Leu/Tyr Background. Error bars shown are the standard deviation.
Figure 44:
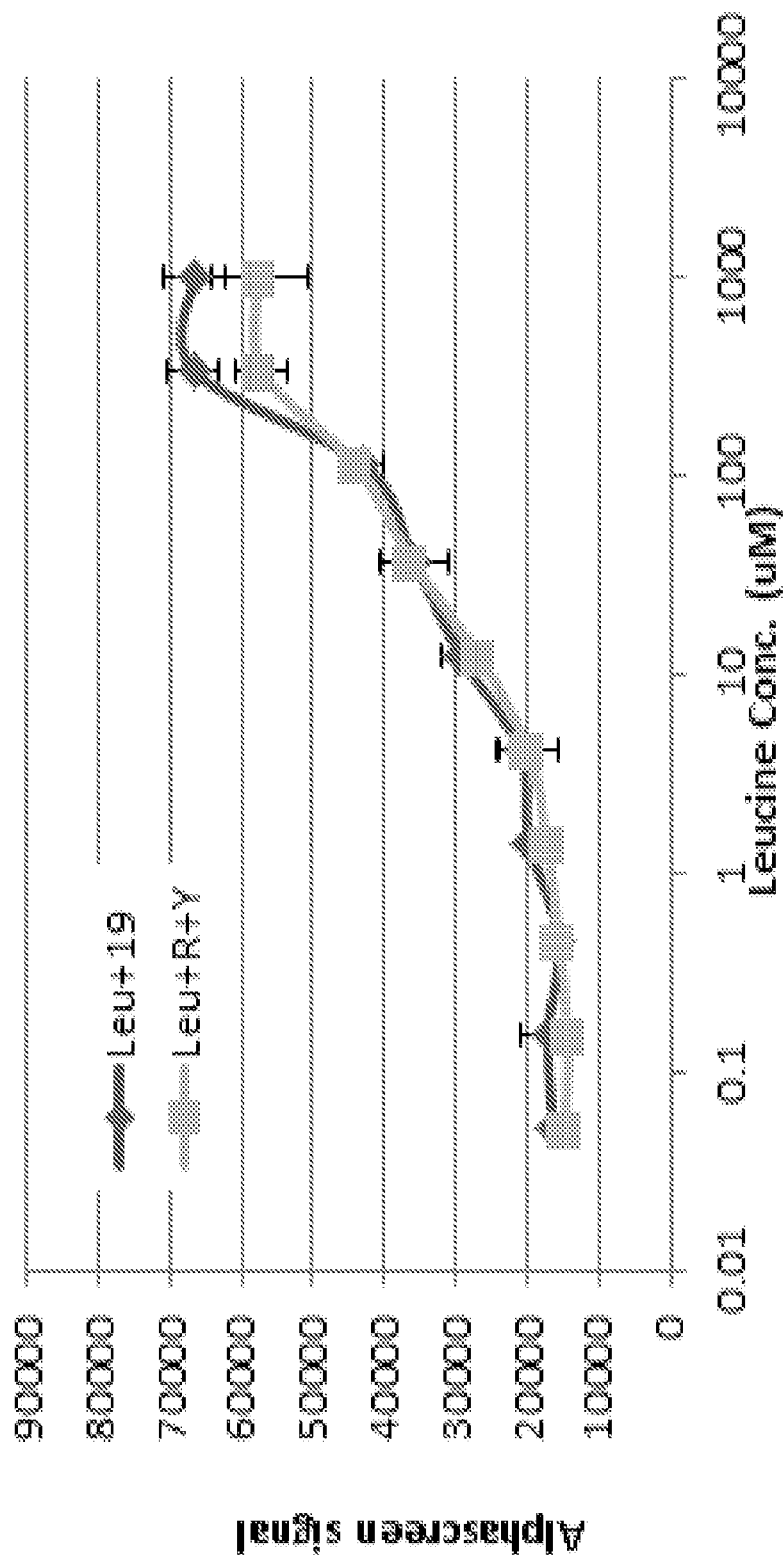
FIG. 44 is a chart demonstrating Leucine Stimulation of RPS6 in Arg/Tyr Background. Error bars shown are the standard deviation.
Figure 45:
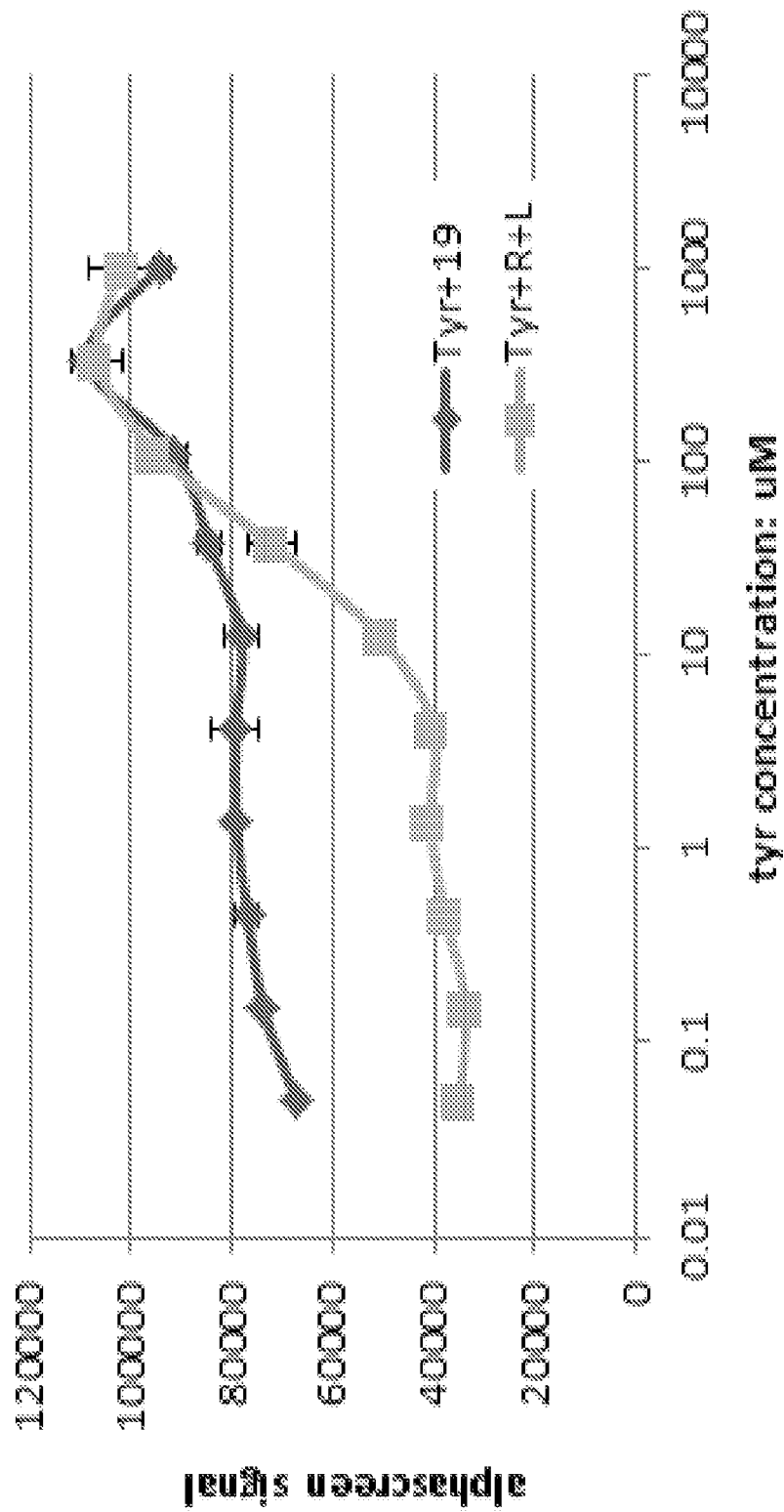
FIG. 45 is a chart demonstrating Tyrosine Stimulation of RPS6 in Arg/Leu Background. Error bars shown are the standard deviation.

FIGS. 43, 44, and 45 show the effect of a dose response of each amino acid (Leu, Arg, Tyr) in the background of all other 19 amino acids vs the other 2 amino acids (e.g. dose response of Arg in a background of Tyr and Leu) on rps6 phosphorylation. These data indicate the synergy between Leu, Arg, and Tyr is dose dependent. Comparing the 20 amino acids response at low doses of Arg to that in a comparable high Leu and Tyr background, there is a reduction in the degree of stimulation caused by the other 17 amino acids. At high doses of Arg, the response in both backgrounds equalizes. Comparing the 20 amino acids response at low doses of Leu to that in a comparable high Arg and Tyr background, there is no difference in rps6 phosphorylation response. Comparing the 20 amino acid response at low doses of Tyr to that in a comparable high Leu and Arg background, the other 17 amino acids can further potentiate the mTOR response.

Example 28

Determination of Safety and Lack of Toxicity of Leucine-Enriched Nutritive Polypeptides Following Oral Consumption by Rodents An acute toxicology study was completed to confirm the expected safety of nutritive polypeptides SEQID-00105, SEQID-00363, and SEQID-00426 in rodents.

Each study group contained 5 male rats and 5 female rats (10 Wistar, 6-7 weeks old, Males 220-250 g, Females 180-200 g). Test formulations were 350 g/L nutritive polypeptide and aqueous buffer as a control. Animals were acclimated for 1 week upon arrival and given a diet of regular chow always available. Before dosing, animals were weighed and pre-bleeds were taken. Single dosage of 10 ml/kg was completed via oral gavage. On days 2, 6 and 7, body and food weights were taken. On day 6 animals were bled in EDTA and Sodium Heparin tubes. On day 7 weights were taken and animals were euthanized followed by immediate necropsies. Eight organs (heart, liver, lung, spleen, kidney, brain, bladder, and small intestine) were removed, weighed and stored in 10% formaldehyde. During the study clinical observations for signs of stress, pain, and abnormal activity were performed daily.

For all three tested nutritive polypeptides the protein and buffer were well tolerated as no abnormalities were seen in the animals. All activity from the animals was normal and no other signs of pain or distress were observed.

Example 29

Analytical Demonstration of Nutritive Polypeptide Digestibility

The digestion of nutritive polypeptides was analyzed via in vitro simulated digestion assays. In vitro digestion systems are used to simulate the breakdown of polypeptides into bioaccessible peptides and amino acids, as occurs in vivo while passing through the stomach and intestine (Kopf-Bolanz, K. A. et al., The Journal of nutrition 2012; 142: 245-250, Hur, S. J. et al., Food Chemistry 2011; 125: 1-12). Simulated gastrointestinal digestion is also predictive of potential protein allergenicity, since digestion-resistant polypeptides may be absorbed and cause sensitization (Astwood et al., Nature Biotechnology 1996; 14: 1269-1273).

Nutritive Polypeptide Half-Life During Simulated Digestion.

One metric for quantifying the breakdown of polypeptides from an intact form to smaller peptides is the intact half-life. In this experiment the nutritive polypeptide was exposed to a series of proteases that are active in the stomach (pepsin) and intestine (trypsin and chymotrypsin), and the presence of intact protein was measured over time. Specifically, the nutritive polypeptide was first treated at a concentration of 2 g/L with simulated gastric fluid (SGF) (0.03 M NaCl, titrated with HCl to pH 1.5 with a final pepsin:polypeptide ratio of 1:20 w/w) at 37° C. Time points were sampled from the reaction and quenched by addition of 0.2 M Na2CO3. After 120 min in SGF, the remaining reaction was mixed 50:50 with simulated intestinal fluid (SIF) (18.4 mM CaCl2, 50 mM MES pH 6.5 with a final trypsin:chymotrypsin:substrate ratio of 1:4:400 w/w) and neutralized with NaOH to pH 6.5. Time points were sampled from the reaction and quenched by addition of Trypsin/Chymotrypsin Inhibitor (Sigma) solution until 240 min.

Time point samples were analyzed for intact protein by chip electrophoresis, polyacrylamide gel electrophoresis, or western blot. For chip electrophoresis (Labchip GX II), samples were analyzed using a HT Low MW Protein Express LabChip® Kit (following the manufacturer's protocol). A protein ladder was loaded every 12 samples for molecular weight determination (kDa) and quantification. For polyacrylamide gel electrophoresis, samples (1 μg) were separated on a NuPAGE® Novex® Bis-Tris Precast gel (Life Technologies) according to the manufacturer's protocol. The gel was stained using SimplyBlue™ SafeStain (Invitrogen) and imaged using a Chemidoc XRS+ (BioRad) or transferred onto nitrocellulose membranes using the iBlot® Dry Blotting System (Life Technologies) and iBlot® Western Detection Kit (Life Technologies) according to the manufacturer's protocol. Proteins were detected by blotting with Anti-His [C-term]-HRP antibody diluted 3:5000 in Blok™-PO Blocking Buffer using the SNAP i.d.® Protein Detection System (Millipore) according to the manufacturer's protocol. Blots were treated with Luminata Classico Western HRP Substrate (Millipore) according to the manufacturer's protocol and imaged using chemiluminescent detection on the Molecular Imager® Gel Doc™ XR+ System (Bio-Rad). Quantification of intact protein was determined by densitometry using ImageLab (BioRad). For all analysis methods the relative concentration of the polypeptide at each time point (if detected) was plotted overtime and fit to an exponential curve to calculate the intact half-life.

Alternatively, samples were analyzed by determining the percentage of intact protein remaining at a single time point (eg. half-life less than 2 min). Specifically, the t=0 (enzyme-free control) and t=2 min samples from the SGF digest were analyzed for intact protein as described by chip electrophoresis, SDS-PAGE, western blot, and/or LC-MS/MS. Relative quantities of polypeptides at each time point were determined and the percentage of intact protein remaining at t=2 was determined. Intact half-life values determined using this method are reported as greater or less than 2 min to indicate more or less than 50% of the protein remained intact at t=2 min, respectively. Results for intact SGF half-life determined by either method are reported in Table E29A.

TABLE E29A

Intact half-lives calculated from in vitro intact protein detection during SGF treatment. All proteins were produced in E. coli, unless otherwise noted.

| | SGF Half-life (t½) in min |
|---|---|
| SEQID-00001 | 5 |
| SEQID-00001 (HEK293) | 8.6 |
| SEQID-00008 | 0.9 |
| SEQID-00009 | 3 |
| SEQID-00076 | 0.3 |
| SEQID-00085 | 0.9 |
| SEQID-00087 | 0.3 |
| SEQID-00098 | 0.4 |
| SEQID-00099 | 1 |
| SEQID-00100 | 2 |
| SEQID-00102 | 0.6 |
| SEQID-00103 | 0.3 |
| SEQID-00103 (HEK293) | <2 |
| SEQID-00104 | 0.3 |
| SEQID-00105 | 0.2 |
| SEQID-00105 (BS) | 0.5 |
| SEQID-00105 (HEK293) | <2 |
| SEQID-00143 | 0.3 |
| SEQID-00212 | 0.3 |
| SEQID-00215 | 2 |
| SEQID-00218 | 6 |
| SEQID-00220 | 0.5 |

TABLE E29A-continued

Intact half-lives calculated from in vitro intact protein detection during SGF treatment. All proteins were produced in E. coli, unless otherwise noted.
SGF Half-life (t½) in min

| SEQID | t½ |
|---|---|
| SEQID-00226 | 0.7 |
| SEQID-00236 | 10 |
| SEQID-00237 | 0.6 |
| SEQID-00240 | 0.7 |
| SEQID-00241 | 0.3 |
| SEQID-00265 | 29 |
| SEQID-00269 | 41 |
| SEQID-00284 | 1 |
| SEQID-00287 | 3 |
| SEQID-00298 (AN) | 0.3 |
| SEQID-00298 (BS) | 0.1 |
| SEQID-00302 | 0.2 |
| SEQID-00305 | 0.2 |
| SEQID-00338 | 0.2 |
| SEQID-00338 (BS) | 0.2 |
| SEQID-00341 | 0.2 |
| SEQID-00343 | 0.3 |
| SEQID-00345 | 0.8 |
| SEQID-00346 | 0.2 |
| SEQID-00352 | 0.2 |
| SEQID-00354 | 0.2 |
| SEQID-00356 | 0.2 |
| SEQID-00357 | 0.2 |
| SEQID-00359 | 0.2 |
| SEQID-00363 | 20 |
| SEQID-00363 (E. coli) | <10 |
| SEQID-00407 (BS) | 0.2 |
| SEQID-00417 | 0.2 |
| SEQID-00418 | 0.2 |
| SEQID-00418 (E. coli) | 0.5 |
| SEQID-00420 | 1.2 |
| SEQID-00423 (BA) | 0.3 |
| SEQID-00423 (BA) | 3 |
| SEQID-00424 (AO) | 0.2 |
| SEQID -00424 (AO) | 0.6 |
| SEQID -00425 (KL) | 0.3 |
| SEQID -00426 (TL) | 0.3 |
| SEQID -00429 (BL) | 5 |
| SEQID-00485 | 0.5 |
| SEQID-00502 | 0.6 |
| SEQID-00510 | 0.3 |
| SEQID-00511 | 0.3 |
| SEQID-00546 | <10 |
| SEQID-00559 | 0.5 |
| SEQID-00587 | 2.4 |
| SEQID-00598 | 0.5 |
| SEQID-00601 | 0.2 |
| SEQID-00605 | 0.2 |
| SEQID-00606 | 0.3 |
| SEQID-00610 | 0.4 |
| SEQID-00622 | 6.6 |
| SEQID-00647 | 0.2 |
| SEQID-00672 (BS) | 0.3 |
| SEQID-00678 (BS) | 0.2 |
| SEQID-00690 (BS) | 4.4 |

(AN) = *Aspergillus niger*, (AO) = *Aspergillus oryzae*, (BS) = *Bacillus subtilis*, (BA) = *Bacillus amyloliquefaciens*, (KL) = *Kluyveromyces lactis*, (TL) = *Thermomyces lanuginosus*, (BL) = *Bacillus licheniformis*.
Alpha-mannosidase-treated SEQID-00363 and protein proteins originating from AO, BA, KL, TL, and BL were produced as described herein.

Nutritive Polypeptide Release of Amino Acids During Simulated Digestion.

An additional method of quantifying polypeptide digestion is to measure the amount of free amino acids present after exposure to a simulated digestive system. In this method, pancreatin, a mixture of enzymes, is used to simulate intestinal proteases. Specifically, the digestion of polypeptides into amino acids was analyzed by an in vitro Pancreatin-based digestion assay followed by free amino acid analysis using reversed phase HPLC (RP-HPLC). The nutritive polypeptide was added to SGF (0.92 g/L Pepsin (Sigma), 0.03 M NaCl titrated with HCl to pH 1.5) at a final concentration of 4 g/L and incubated at 37° C. for 120 min. After 120 min, Na2CO3 was added to a final concentration of 16 mM to quench the pepsin reaction. The resulting reaction was mixed 50:50 with 2× concentrated SIF (0.78 mg/ml Porcine Pancreatin (Sigma), 18.4 mM CaCl2, 50 mM MES pH 6.5) and incubated for 240 min. Time points were sampled from the reaction and quenched by heating to 95° C. for 5 min. Control samples were protease-free.

Figure 46:
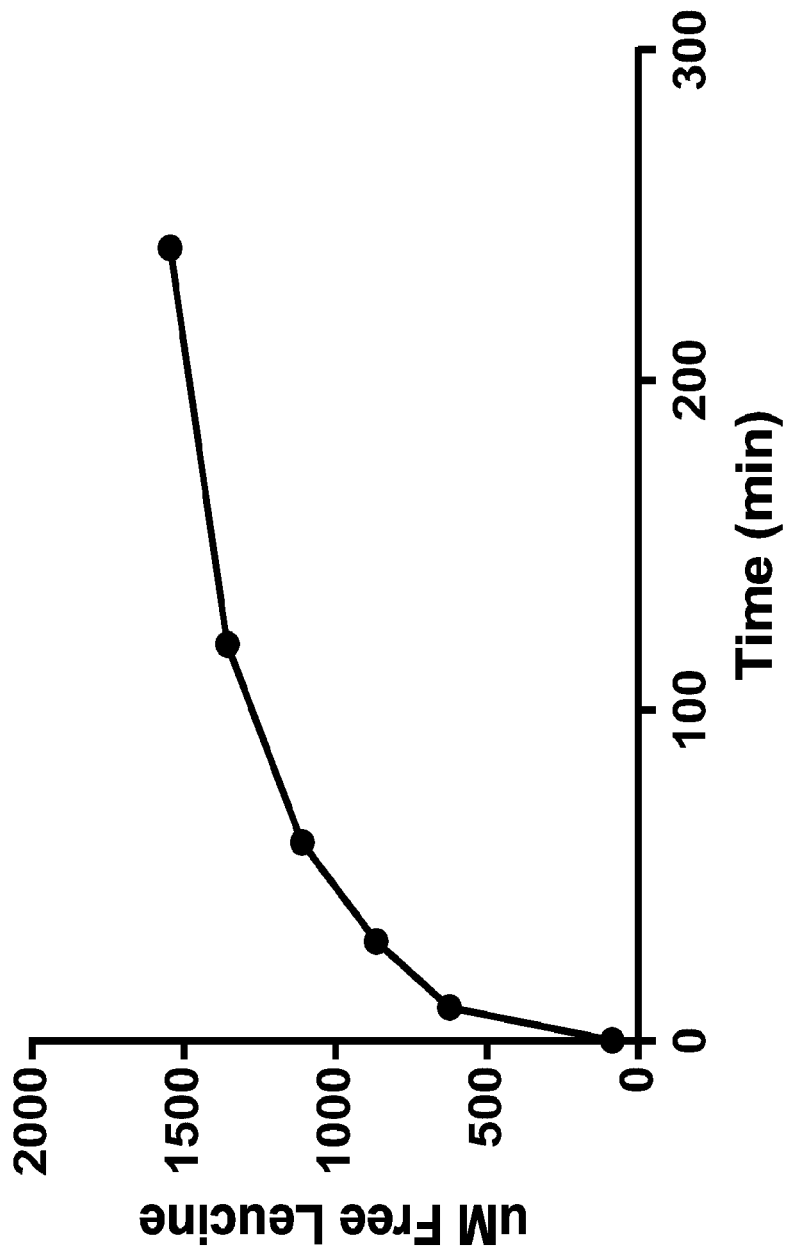
FIG. 46 is a chart demonstrating a time-course of free Leu release during Pancreatin digest of SEQID-00105.

Time points were analyzed for free amino acids using RP-HPLC amino acid analysis as described in Henderson, J. W., et al. Agilent Technologies (2010). Analyses were performed using an Agilent 1100 series system. Primary amino acids were derivitized pre-column at room temperature, online, using o-phthalaldehyde (OPA). The OPA-derivatives were separated using the Zorbax Eclipse-AAA 4.6×150 mm, 3.5 µm column at 40° C. The separation gradient transitioned from 100% 40 mM Na2HPO4 pH 7.8 to 65% acetonitrile/methanol/water mixture (45/45/10) over 23 minutes. Analytes were detected by fluorescence at 340 nm Ex/450 nm Em. FIG. 46 demonstrates a representative time-course of free Leu concentration during a Pancreatin digest of SEQID-00105. Free Leu concentrations for samples at the 120 min time point of the Pancreatin digest are summarized in Table E29B.

TABLE E29B

Free Leu detected at 120 min time point of Pancreatin digest of nutritive polypeptides.

| | Free Leu (µM) at 120 min time point of Pancreatin digest |
|---|---|
| SEQID-00076 | 824.3 |
| SEQID-00103 | 793.8 |
| SEQID-00105 | 1357.6 |
| SEQID-00298 (BS) | 1030.8 |
| SEQID-00338 | 1181.7 |
| SEQID-00341 | 1143.5 |
| SEQID-00352 | 906.1 |
| SEQID-00363 | 511 |
| SEQID-00363 | 561.5 |
| SEQID-00423 | 587.1 |
| SEQID-00424 | 758.7 |
| SEQID-00425 | 713.1 |
| SEQID-00426 | 952.3 |
| SEQID-00426 | 955.2 |
| SEQID-00429 | 580.7 |
| SEQID-00485 | 764.9 |
| SEQID-00605 | 937.1 |

Nutritive polypeptide release of peptides during simulated digestion. Samples from the simulated Pancreatin-based in vitro digestion described herein were analyzed for peptides by LC-MS/MS. To prepare the samples for LC-MS/MS analysis, the sample pH was adjusted to pH 3 with trifluoroacetic acid (TFA) and peptides were extracted using Hydrophilic-lipophilic Balance (HLB) solid phase extraction cartridges (Waters). Cartridges were activated with 2 mL of acetonitrile and equilibrated with 2 mL of 0.1% TFA. Samples were loaded and cartridges washed with 2 mL 0.1% TFA and eluted with 1 mL of 70% acetonitrile/0.1% TFA. The eluted peptides were dried to completion and reconstituted in 50 µL 0.1% TFA. The eluted peptides (4 µL) were loaded on-column and analyzed by nano LC-MS/MS with a Waters NanoAcquity HPLC system interfaced to a Thermo-Fisher Orbitrap Velos Pro. Peptides were loaded on a trapping column and eluted over a 75 µm analytical column at 350 nL/min; both columns were packed with Jupiter Proteo resin (Phenomenex). A 1 h gradient was employed. The mass spectrometer was operated in data-dependent mode, with MS performed in the Orbitrap mass analyzer at 60,000

FWHM resolution and MS/MS performed in the LTQ linear ion trap mass spectrometer. The fifteen most abundant ions were selected for MS/MS. Data were searched against an appropriate database using Mascot to identify peptides. Mascot DAT files were parsed into the Scaffold software for validation, filtering and to create a nonredundant list per sample. Data were filtered using a minimum protein value of 95% and a minimum peptide value of 50%.

Unique peptides were detected at the 240 min time point of the Pancreatin digest by LC-MS/MS after in vitro digestion of a given SEQID. Unique peptides detected for the SEQID-00105 sample were: LFDKDNNGSIS, FDKDNNGS, FDKDNNGSIS/FDKDNnGSIS, FDKDNNGSISS, FDKDNNGSISSSEL, DKDNNGSI, DKDNNGSIS, SLGLSPSE, NEIDVDGN, IDVDGNH, IDVDGNHQ, IDVDGNHQIE/IDVDGNHQIE, KVFD-KNGDG, VFDKNGDGLIS, DKNGDGL, KLTDAEV, LREVSDGSGEINIQQF, REVSDGSG, REVSDGSGE, REVSDGSGEI, REVSDGSGEIN/REVSDGSGEIN, REVSDGSGEINIQ, REVSDGSGEINIQQF, EVSDGSGEI, EVSDGSGEIN. Unique peptides detected for the SEQID-00426 sample were: YSFEDSGVGDVT, YSFEDSGVGD-VTG, SFEDSGVGDVTG, FEDSGVGDV, EDSGVGDVT, EDSGVGDVTG, EDSGVGDVTGF, DSGVGDVT, LRGnGYD, LRGnGYDIDV, ITHTNDIVPR, HTNDIVPR, TNDIVPR, NDIVPR, YSHSSPE, DIVKIEGIDATGGN-NQPNIPDIPAHL, KIEGID, KIEGIDATGGNNQPNIP-DIPA, IEGIDATGGNNQPNIPDIPA, EGIDATGGNNQP-NIPDIPA, GIDATGGNNQPNIPDIPA, IDATGGNNQPNIPD, IDATGGNNQPNIPDIP, IDATG-GNNQPNIPDIPA/IDATGGNNQPnIPDIPA, IDATGGN-NQPNIPDIPAH, DATGGNNQPNIPDIPA/DATGGNNqP-NIPDIPA, ATGGNNQPNIPD, ATGGNNQPNIPDIP, ATGGNNQPNIPDIPA/ATGGNNqPNIPDIPA, ATGGN-NQPNIPDIPAH, TGGNNQPNIPDIPA, GGNNQPNIPDIP/ GGNnQPNIPDIP, GGNNQPNIPDIPA/GGnNQPNIPDIPA/ GGnnQPNIPDIPA, GNNQPNIPDIPA/GNNqPNIPDIPA, NNQPNTPDIPA, NQPNIPDIPA, PNIPDIPA.

Nutritive Polypeptide Intact Half-Life Determination in a Complex Mixture.

The in vitro intact half-life of multiple polypeptides in a complex mixture was determined using the simulated gastric in vitro digestion described above. Briefly, the 168 nutritive polypeptide library was generated as described herein by cloning, transforming, and expressing a gene library encoding 168 proteins as a single mixture. The recombinantly expressed proteins were purified from host cell proteins by IMAC purification as described herein.

The 168 Protein Library was treated with SGF as described above and the t=0 and t=10 min samples were analyzed for intact protein by LC-MS/MS. To begin, 10 µg of sample was loaded onto a 10% SDS-PAGE gel (Invitrogen) and run approximately 5 cm into the gel. The gel was excised into ten fractions from 100 kD to the dye front and the gel slices were processed by washing with 25 mM ammonium bicarbonate, followed by acetonitrile. Gel fractions were then reduced with 10 mM dithiothreitol at 60° C., followed by alkylation with 50 mM iodoacetamide at room temperature. Finally, the samples were digested with trypsin (Promega) at 37° C. for 4 h and the digestions were quenched with the addition of formic acid. The samples were then analyzed by nano LC/MS/MS using an EasynLC 1000 HPLC system interfaced to a ThermoFisher Q Exactive. Peptides were loaded on a trapping column and eluted over a 75 µm analytical column at 350 nL/min; both columns were packed with PepMap C18 3 µm resin (ThemoFisher). A 1 hour gradient was employed. The mass spectrometer was operated in data-dependent mode, with MS and MS/MS performed in the Orbitrap at 70,000 FWHM resolution and 17,500 FWHM resolution, respectively. The fifteen most abundant ions were selected for MS/MS. Data were searched against an appropriate database using Mascot to identify peptides. Mascot DAT files were parsed into the Scaffold software for validation, filtering and to create a nonredundant list per sample. Data were filtered at 1% protein and peptide false discovery rate (FDR) and requiring at least two unique peptides per protein. A full list of detected proteins and their spectral counts (SpC) was generated and reported as a function of each collected gel fraction. SpC are a count of the number of spectra identified for a given protein and are used as a measure of relative protein abundance (Liu, H. et al., Analytical Chemistry 2004, 76: 4193-4201). To calculate the percentage of intact protein remaining at the 10 min time point of the SGF digest the number of SpC representative of intact peptide in the t=10 min sample were divided by the number of SpC representative of intact peptide in the t=0 min sample. The number of SpC representative of intact peptide was defined as the sum of the SpC in the fraction with the highest number of SpC assigned to that protein in the t=0 min sample and the two flanking fractions. Results for % Intact Protein at 10 min are shown in Table E20C. Intact half-life values for purified proteins, determined by chip electrophoresis, and percentage of intact peptide remaining at 10 min for proteins detected in the 168 SEQID Library, determined by LC-MS/MS analysis, are compared for fourteen polypeptides in Table E20D. The linear relationship between percentage protein remaining intact at t=10 min and half-life value was analyzed and the R2 value determined to be 0.72.

TABLE E20C

Percent intact protein remaining at 10 min time point of 168 nutritive polypeptide library SGF digest.

| Protein | % Intact Protein at 10 min |
|---|---|
| SEQID-00338 | 3.9 |
| SEQID-00484 | 0 |
| SEQID-00485 | 0 |
| SEQID-00489 | 0 |
| SEQID-00495 | 0 |
| SEQID-00496 | 0 |
| SEQID-00497 | 20.3 |
| SEQID-00502 | 9.7 |
| SEQID-00507 | 0 |
| SEQID-00509 | 36.4 |
| SEQID-00510 | 13.4 |
| SEQID-00511 | 4.3 |
| SEQID-00515 | 17 |
| SEQID-00518 | 0 |
| SEQID-00520 | 0 |
| SEQID-00521 | 11.5 |
| SEQID-00524 | 0 |
| SEQID-00525 | 13.7 |
| SEQID-00528 | 11.8 |
| SEQID-00529 | 0 |
| SEQID-00532 | 0 |
| SEQID-00533 | 19 |
| SEQID-00534 | 0 |
| SEQID-00536 | 11.8 |
| SEQID-00540 | 0 |
| SEQID-00541 | 0 |
| SEQID-00544 | 0 |
| SEQID-00545 | 0 |
| SEQID-00546 | 0 |
| SEQID-00552 | 79 |
| SEQID-00555 | 6.8 |
| SEQID-00559 | 3.1 |
| SEQID-00562 | 0 |

TABLE E20C-continued

Percent intact protein remaining at 10 min time point of 168 nutritive polypeptide library SGF digest.

| Protein | % Intact Protein at 10 min |
|---|---|
| SEQID-00564 | 89.6 |
| SEQID-00570 | 91.4 |
| SEQID-00573 | 66.7 |
| SEQID-00574 | 0 |
| SEQID-00577 | 30.8 |
| SEQID-00581 | 33.3 |
| SEQID-00582 | 15.2 |
| SEQID-00583 | 0 |
| SEQID-00587 | 21.7 |
| SEQID-00590 | 0 |
| SEQID-00591 | 20 |
| SEQID-00592 | 24.3 |
| SEQID-00598 | 24.3 |
| SEQID-00599 | 0 |
| SEQID-00601 | 1.1 |
| SEQID-00602 | 0 |
| SEQID-00603 | 0 |
| SEQID-00605 | 0 |
| SEQID-00606 | 0 |
| SEQID-00607 | 0 |
| SEQID-00609 | 0 |
| SEQID-00610 | 3.3 |
| SEQID-00612 | 0 |
| SEQID-00613 | 0 |
| SEQID-00615 | 85.7 |
| SEQID-00617 | 43.9 |
| SEQID-00618 | 0 |
| SEQID-00619 | 68.5 |
| SEQID-00620 | 0 |
| SEQID-00622 | 43.6 |
| SEQID-00623 | 63.6 |
| SEQID-00624 | 0 |
| SEQID-00625 | 0 |
| SEQID-00626 | 0 |
| SEQID-00628 | 0 |
| SEQID-00629 | 40 |
| SEQID-00631 | 17.1 |
| SEQID-00632 | 1.2 |
| SEQID-00633 | 92.1 |
| SEQID-00634 | 36.8 |
| SEQID-00636 | 60 |
| SEQID-00638 | 0 |
| SEQID-00639 | 0 |
| SEQID-00640 | 50 |
| SEQID-00641 | 21.2 |
| SEQID-00642 | 75 |
| SEQID-00643 | 13.6 |
| SEQID-00644 | 0 |
| SEQID-00645 | 0 |
| SEQID-00647 | 12 |
| SEQID-00648 | 39.5 |

TABLE E20D

Comparison of intact half-life values for purified proteins, determined by chip electrophoresis, and percentage of intact peptide remaining at 10 min for proteins detected in the 168 nutritive polypeptide library, determined by LC-MS/MS analysis.

| Protein | Half-life (min) | % Remaining at 10 min |
|---|---|---|
| SEQID-00338 | 0.2 | 3.9 |
| SEQID-00601 | 0.2 | 1.1 |
| SEQID-00605 | 0.1 | 0 |
| SEQID-00647 | 0.2 | 12 |
| SEQID-00510 | 0.3 | 13.4 |
| SEQID-00511 | 0.3 | 4.3 |
| SEQID-00606 | 0.3 | 0 |
| SEQID-00610 | 0.4 | 3.3 |
| SEQID-00559 | 0.5 | 3.1 |
| SEQID-00485 | 0.5 | 0 |
| SEQID-00598 | 0.5 | 24.3 |
| SEQID-00502 | 0.6 | 9.7 |
| SEQID-00587 | 2.4 | 21.7 |
| SEQID-00622 | 6.6 | 43.6 |

Example 30

Viscosity of Nutritive Polypeptides

It has been demonstrated that the presence of strong attractive self-associating interactions results in higher viscosity solutions (Yadav, Sandeep, et al. Journal of pharmaceutical sciences 99.12 (2010): 4812-4829.). Specifically, electrostatic interactions of oppositely charged residues results in high viscosity solutions (Liu, Jun, et al. Journal of pharmaceutical sciences 94.9 (2005): 1928-1940.). A nutritive polypeptide with low viscosity can be selected using net charge or charge per amino acid calculations described herein, and selecting proteins with highly positive or highly negative charges. Proteins selected in this way would lack complementary electrostatic interactions and would instead have an overall repulsive force that limits the ability to self-associate thus reducing viscosity of the solutions.

Figure 47:
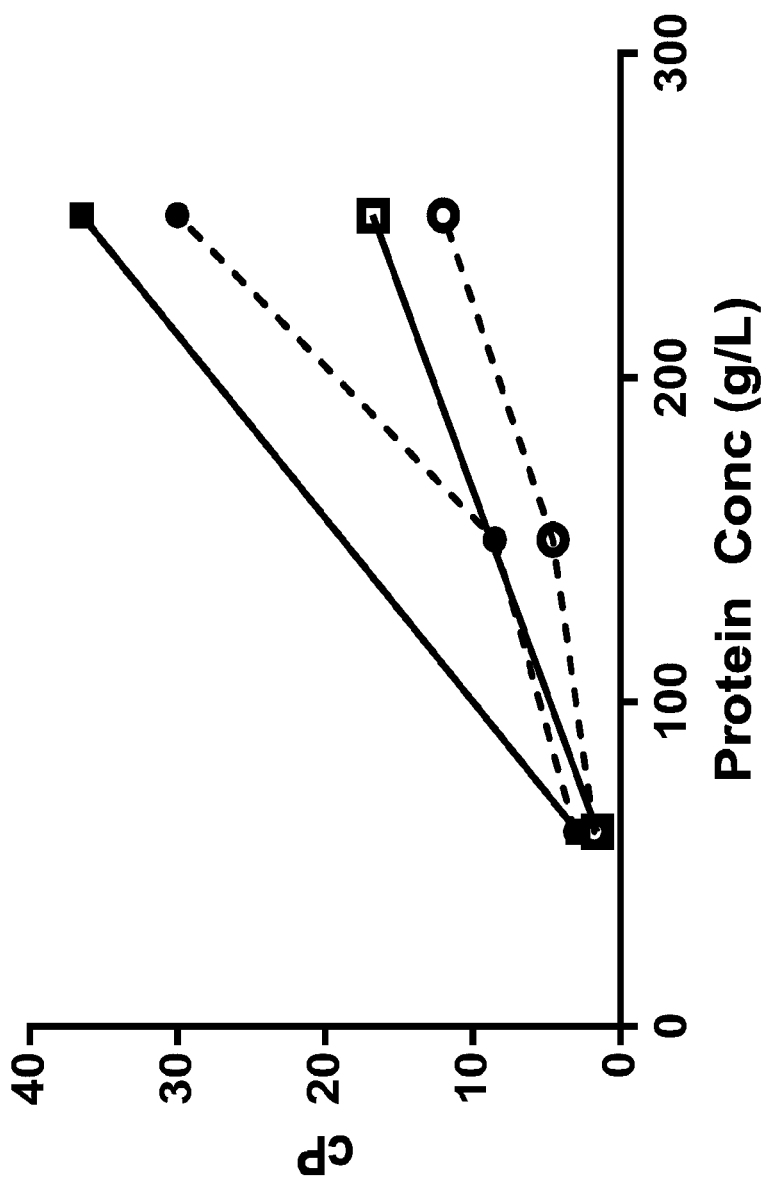
FIG. 47 is a chart demonstrating viscosity measured in centipoise for SEQID-00105 at 4 C (closed circles) and 25 C (open circles) and whey at 4 C (closed squares) and 25 C (open squares) over a range of protein concentrations.

Solutions of a nutritive polypeptide (SEQID-00105) and whey were measured for relative viscosity. Both proteins were resuspended with water to the desired concentration for analysis. Viscosity was measured using a Brookfield LVDV-II+ PRO Cone/Plate with a CPE-40 spindle. All tests were performed at 4 C and 25 C. Sample volume was 0.5 ml. Temperature was maintained with a Brookfield TC-550AP-115 Programmable Temperature Bath. All samples were equilibrated for a minimum of two minutes at 4 C and one minute at 25 C. All readings were taken between 10% and 100% torque. FIG. 47 shows viscosity measured in centipoise for SEQID-00105 at 4 C (closed circles) and 25 C (open circles) and whey at 4 C (closed squares) and 25 C (open squares).

SEQID-00105 has been shown herein to have a negative net charge across a range of pH, and SEQID-00105 is presently shown at multiple temperatures and polypeptide concentrations to be less viscous than whey, which is a disperse mixture of proteins without a dominant single charge.

To generate a solution with increased viscosity transglutaminase can be used to create a network consisting of enzyme-induced permanent covalent cross-links between nutritive polypeptides thereby generating additionally viscous solutions. This enzyme treatment can also be followed by thermal processing to make a viscous solution containing a nutritive polypeptide. To generate nutritive polypeptide samples containing crosslinks that increase viscosity, a sample is mixed with a transglutaminase solution at pH 7.0 to give an enzyme to protein weight ratio of 1:25. The enzyme-catalyzed cross-linking reaction is conducted at 40° C. in most of the experiments.

Example 31

Analytical Demonstration of Nutritive Polypeptide Solubility and Thermostability Solubility.

The solubility of proteins was evaluated by determining the protein concentration of reconstituted lyophilized powder, centrifugal filtered, and/or ultrafiltered solutions (Carpenter et al. (2002) Rational. Design of Stable Lyopholized Protein Formulations: Theorty and Practice, Kluwer Academic/Plenum publishers, New York, pp. 109-133; Millipore publication, Amicon Ultra: Centrifugal Filter Devices for the Concentration and Purification of Biological Samples (2001); Oss et al. (1969) A membrane for the rapid concentration of dilute protein samples in an ultrafilter, Clinical Chemistry, 15(8): 699-707). Protein samples were dried by lyophilization on a FreeZone Freeze Dry System (Labconco) using the manufacturer's standard protocol and then resuspended in buffer to the desired concentration. Centrifugal and tangential ultrafiltration were used to selectively remove buffer from the protein sample until the desired concentration was reached. Centrifugal ultrafiltration of protein solutions was performed by centrifugation (10,000×g) of 10 mg of protein in an Amicon centrifugal filter (Millipore) with a molecular weight cutoff of 3 kDa, 10 kDa, or 30 kDa, depending on the protein size, until the desired contrentration was reached. Ultrafiltration of protein solutions was performed on Hydrosart ultrafiltration cassettes (Sartorius Stedim, Bohemia, N.Y.) with a molecular weight cutoff of 3 kDa, 10 kDa, or 30 kDa, depending on the protein size, at a cross flow rate of 12 L/m2/min. For most processes, transmembrane pressure was maintained at 20 psi and performed until the desired contrentration was reached.

The protein concentration of the above samples was measured by one or a combination of the following methods: Coomassie Plus Protein Assay, absorbance at 280 nm (A280), and total amino acid analysis. Coomassie Plus Protein Assays (Pierce) were performed according to the manufacturer's protocol. Absorbance at 280 nm was measured on a Nanodrop 2000 UV-Vis spectrophotometer. Protein concentration was determined using the A280 value and molar extinction coefficient, which was calculated by primary amino acid sequence using ProtParam (Gasteiger, Elisabeth, et al. The proteomics protocols handbook. Humana Press, 2005. 571-607.). Total amino acids were analyzed by HPLC after acid hydrolysis as described in Henderson, J. W., et al. Agilent Technologies (2010).

TABLE E31A

Solubility of proteins. All proteins were produced in *E. coli*, unless otherwise noted.

| Protein | Solubility (g/L) |
|---|---|
| SEQID-00008 | 265 |
| SEQID-00009 | 53 |
| SEQID-00076 | 150 |
| SEQID-00085 | 50 |
| SEQID-00087 | 176 |
| SEQID-00099 | 91 |
| SEQID-00100 | 107 |
| SEQID-00102 | 120 |
| SEQID-00103 | 133 |
| SEQID-00104 | 192 |
| SEQID-00105 | 500 |
| SEQID-00115 | 70 |
| SEQID-00220 | 166 |
| SEQID-00226 | 107 |
| SEQID-00236 | 60 |
| SEQID-00240 | 163 |
| SEQID-00241 | 207 |
| SEQID-00265 | 95 |
| SEQID-00269 | 159 |
| SEQID-00287 | 192 |
| SEQID-00298 (BS) | 209 |
| SEQID-00302 | 158 |
| SEQID-00305 | 231 |
| SEQID-00338 | 254 |
| SEQID-00341 | 166 |
| SEQID-00345 | 196 |
| SEQID-00346 | 161 |
| SEQID-00352 | 223 |
| SEQID-00354 | 235 |
| SEQID-00357 | 211 |
| SEQID-00363 (AN) | 336 |
| SEQID-00363 a-mannosidase treated | 229 |
| SEQID -00423 (BA) | 193 |
| SEQID -00424 (AO) | 205 |
| SEQID -00425 (KL) | 190 |
| SEQID -00426 (TL) | 138 |
| SEQID-00429 (BL) | 214 |
| SEQID-00485 | 99 |
| SEQID-00510 | 135 |
| SEQID-00511 | 135 |
| SEQID-00546 | 149 |
| SEQID-00559 | 156 |
| SEQID-00587 | 223 |
| SEQID-00598 | 150 |
| SEQID-00605 | 128 |

(AN) = *Aspergillus niger*, (AO) = *Aspergillus oryzae*, (BS) = *Bacillus subtilis*, (BA) = *Bacillus amyloliquefaciens*, (KL) = *Kluyveromyces lactis*, (TL) = *Thermomyces lanuginosus*, (BL) = *Bacillus licheniformis*.
Alpha-mannosidase-treated SEQID-00363 and protein originating from AO, BA, KL, TL, and BL were produced as described herein.

pH Solubility. The pH solubility of proteins was determined in a buffer cocktail of Citric Acid and Dibasic Sodium Phosphate over a pH range of 2.8 to 7.1. pH solutions were prepared as outlined in Table E31B. Protein was either lyophilized and then resuspended in buffer cocktail mixtures, or concentrated and then spiked into buffer cocktail mixtures at a final protein concentration of 5 to 30 mg/ml. As a control, protein was also dissolved in a solution of 8 M urea. Protein solutions were shaken for 10 min at room temperature. Turbidity of proteins was determined by measuring the absorbance of protein solutions at 650 nm. The protein solution was then centrifuged for 10 min at 1100×g to pellet undissolved or precipitated protein. The soluble protein fraction (supernatant) was sampled and protein concentration was measured by one or more of the following methods: Coomassie Plus Protein Assay (Pierce), Chip electrophoresis, gel electrophoresis, and/or absorbance at 280 nm. The pH range over which select proteins remained greater than 80% soluble as determined by Bradford and the A650 value are listed in Table E31C.

TABLE E31B

Buffer composition for pH solubility screen.

| Buffer # | pH | Sodium Phosphate Dibasic (mM) | Citric Acid (mM) | mL of 42 mM Sodium Phosphate (10 mL total) | mL of 42 mM Citric Acid (10 mL total) |
|---|---|---|---|---|---|
| 1 | 7.1 | 38 | 4 | 9 | 1 |
| 2 | 6.5 | 34 | 8 | 8.1 | 1.9 |
| 3 | 6 | 32 | 10 | 7.6 | 2.4 |
| 4 | 5.6 | 30 | 12 | 7.1 | 2.9 |
| 5 | 5 | 28 | 14 | 6.7 | 3.3 |
| 6 | 4.6 | 26 | 16 | 6.2 | 3.8 |
| 7 | 4.3 | 24 | 18 | 5.7 | 4.3 |
| 8 | 3.9 | 22 | 20 | 5.2 | 4.8 |
| 9 | 3.7 | 20 | 22 | 4.8 | 5.2 |
| 10 | 2.8 | 10 | 32 | 2.4 | 7.6 |

TABLE E31C

Solubility of proteins over a range of pHs.

| | pH Range where Protein is >80% detected as Soluble and A650 <1 OD | | |
|---|---|---|---|
| Protein | High | Low | Other |
| SEQID-00009 | 9.1 | 3.7 | |
| SEQID-00076 | 7.1 | 4.6 | |
| SEQID-00085 | 7.1 | 7.1 | |
| SEQID-00100 | 7.1 | 4.3 | |
| SEQID-00103 | 7.1 | 5.6 | |
| SEQID-00104 | 7.1 | 5 | |
| SEQID-00105 | 9.1 | 4.3 | |
| SEQID-00226 | 9.1 | 2.6 | |
| SEQID-00240 | 9.1 | 6.6 | 3.0-2.6 |
| SEQID-00241 | 9.1 | 4.3 | |
| SEQID-00265 | 9.1 | 5.1 | 3 |
| SEQID-00269 | 9.1 | 7.2 | 3.0-2.6 |
| SEQID-00287 | 9.1 | 6.2 | 2.6 |
| SEQID-00338 | 7.1 | 2.8 | |
| SEQID-00485 | 7.1 | 4.6 | 2.8 |
| SEQID-00502 | | 7.1 | 2.8 |
| SEQID-00510 | 7.1 | 6.5 | 2.8 |
| SEQID-00511 | 7.1 | 5.6 | |
| SEQID-00587 | 7.1 | 2.8 | |
| SEQID-00605 | 7.1 | 5.6 | |
| SEQID-00622 | 7.1 | 2.8 | |

N/A: not applicable.

Thermostability.

The thermostability of proteins in a buffer cocktail of Citric Acid and Dibasic Sodium Phosphate over a pH range of 2.8 to 7.1 (preparation described above in Table E31B) was determined using the ProteoStat® Thermal Shift Stability Kit (Enzo Life Sciences) according to the manufacturer's standard protocol. Briefly, protein solutions (~10 mg/ml) containing 1× ProteoStat TS Detection Reagent were heated from 25° C. to 95° C. at a rate of 0.5° C. per 30 sec using a real-time PCR (rtPCR) thermocycler (BioRad) equipped with a plate reader (SynergyMx, Biotek) while monitoring the fluorescence with a Texas Red filter. The temperature of aggregation (Tagg) was identified as the temperature at which the steepest slope was observed in the trace of fluorescence intensity as a function of temperature. The temperature of aggregation at pH 7.1 for a subset of proteins is listed in Table E31 D. The temperature of aggregation over a range of pHs for a subset of proteins is listed in Table E31E.

TABLE E31D

Temperature of aggregation (Tagg) at pH 7.1

| Protein | Tagg (pH 7.1) |
|---|---|
| SEQID-00008 | >95 |
| SEQID-00009 | 56 |
| SEQID-00087 | >95 |
| SEQID-00099 | 64 |
| SEQID-00102 | >95 |
| SEQID-00220 | >95 |
| SEQID-00226 | >95 |
| SEQID-00237 | 45 |
| SEQID-00240 | >95 |
| SEQID-00241 | >95 |
| SEQID-00265 | >95 |
| SEQID-00269 | >95 |
| SEQID-00302 | 46 |
| SEQID-00305 | 48 |
| SEQID-00510 | 57.5 |
| SEQID-00606 | 95 |
| SEQID-00610 | 54.5 |

TABLE E31E

Temperature of aggregation (Tagg) as a function of pH.

| | $T_{agg}$ | | | | | | | | | |
|---|---|---|---|---|---|---|---|---|---|---|
| Protein | pH 7.1 | pH 6.5 | pH 6.0 | pH 5.6 | pH 5.0 | pH 4.6 | pH 4.3 | pH 3.9 | pH 3.7 | pH 2.8 |
| SEQID-00076 | >95 | 95 | 95 | 73.5 | 75 | 34.5 | NS | NS | NS | NS |
| SEQID-00098 | >95 | NS | NS | NS | NS | NS | NS | NS | NS | NS |
| SEQID-00100 | >95 | 95 | 95 | 95 | 95 | 84 | 83 | 95 | 95 | 95 |
| SEQID-00103 | >95 | 95 | 67.5 | 62 | 61 | 59.5 | 37.5 | 41.5 | 45.5 | NS |
| SEQID-00104 | >95 | 95 | 95 | 80 | 66 | 59.5 | 60 | 74.5 | NS | NS |
| SEQID-00105 | >95 | 95 | 95 | 70.5 | 75.5 | 61.5 | 36.5 | NS | NS | NS |
| SEQID-00338 | 51.5 | 51 | 51.5 | 51 | 50.5 | 84.5 | 40.5 | 38 | 37 | 95 |
| SEQID-00485 | 36 | 36.5 | 36 | 34.5 | 31.5 | NS | NS | NS | NS | NS |
| SEQID-00502 | 95 | 78.5 | 76.5 | 77 | 77 | 95 | 95 | NT | 95 | 95 |
| SEQID-00511 | 42 | 45.5 | 39.5 | NS | NS | NS | NS | NS | NS | NS |
| SEQID-00559 | 64.5 | 64 | 62 | 59 | 57 | 57.5 | NS | NS | NS | NS |
| SEQID-00587 | 95 | 95 | 95 | 69.5 | 67 | 63 | 58.5 | 54 | 50.5 | 50 |
| SEQID-00601 | 48.5 | 45.5 | NS | NS | NS | NS | 95 | NT | 95 | 95 |

TABLE E31E-continued

Temperature of aggregation (Tagg) as a function of pH.

| Protein | $T_{agg}$ | | | | | | | | | |
|---|---|---|---|---|---|---|---|---|---|---|
| | pH 7.1 | pH 6.5 | pH 6.0 | pH 5.6 | pH 5.0 | pH 4.6 | pH 4.3 | pH 3.9 | pH 3.7 | pH 2.8 |
| SEQID-00605 | 39 | 38.5 | 44.5 | 37 | 33.5 | 40.5 | NS | NS | NS | NS |
| SEQID-00622 | 95 | 47 | 46 | 45.5 | 42.5 | 43.5 | 43.5 | 42 | 42 | 58.5 |

NS = condition where protein was not soluble for thermal stability assay.

Thermal Unfolding.

Figure 48:
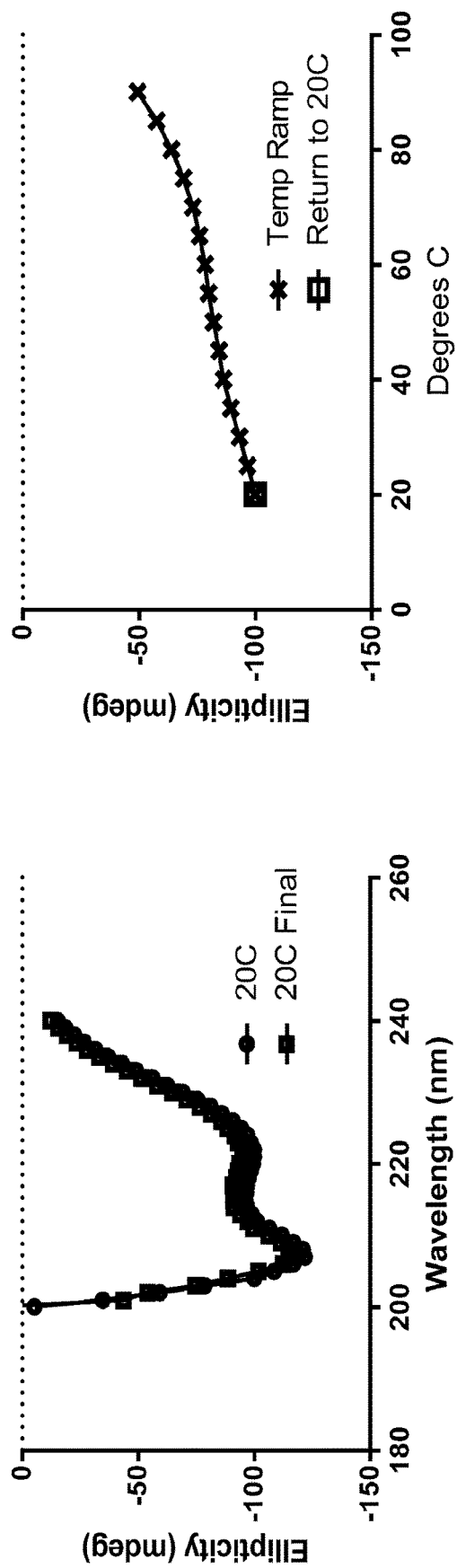
FIG. 48 is a chart demonstrating (Left) Initial and final (after heating to 90° C. and then cooling to 20° C.) protein circular dichroism spectrum for SEQID-00105 and (Right)

Thermal unfolding of proteins was monitored by circular dichroism on an Applied Photophysics CS/2 Chirascan spectrophotometer. Far-UV measurements (200-260 nm) of protein solutions (0.5 to 1.0 mg/mL) in buffer (20 mM potassium phosphate, pH 7.5) were recorded every 5° C. from 20 to 90° C. using a 0.1 cm optical path length cell. After collection of the spectrum at 90° C. the protein sample was immediately cooled to 20° C. and a final spectrum was recorded. The melting temperature (Tmelt) was calculated as the temperature with the strongest slope, and the final spectrum was compared to the initial 20° C. spectrum to determine if protein unfolding was reversible or if a permanent change in structure had occurred. FIG. 48 displays a representative CD spectra of SEQID-00105, demonstrating the nutritive polypeptide does not completely unfold at even 90 C and returns to it's original fold when cooled to 20 C.

Example 32

Nutritive Polypeptide Glycosylation

The glycans present on proteins often affect properties such as solubility, activity, and stability. Changing the pattern on glycosylation of nutritive peptides can also affect their bioavailability, nutritional quality, and product formulation attributes. Furthermore, specific sugar patterns on nutritive food peptides augment metabolic response to the ingestion of isolated nutritive food peptides based both the kinetics of amino acid absorption and the incorporation of exogenous glycans during human protein production.

Host Selection for Glycosylation State.

As described herein nutritive polypeptides were produced in a variety of hosts. Choice of host has an impact on the glycosylation state of the nutritive polypeptide which has biophysical, digestion, and immunogenic implications. For example, hosts for expression include, *E. coli, B. subtilis, B. licheniformis, Aspergillus niger, Aspergillus nidulans*, human embryonic kidney (HEK), and chinese hamster ovary cells (CHO). *E. coli, B. subtilis* and *Bacillus licheniformis* are used as an expression host due to their ability to produce polypeptides with unglycated (or minimally glycated) backbones compared to eukaryotic hosts such as *aspergillus, s. cerevisiae*, and *pichia. Aspergillus niger* is selected as a protein secretion host due to its unique glycosylation machinery that drives the addition of mannose-rich glycans to the polypeptide backbone. *Aspergillus nidulans* is selected as a protein secretion host, due to the previously demonstrated ability (Kainz et. al. N-Glycan modification in *aspergillus* species, Appl. Environ. Microbiol., 2008) to engineer the host glycosylation machinery towards reduced glycan structure complexity in to place of extensive oligomannose polysaccharides. Chinese hamster ovarian (CHO) cells are selected as an expression host for their ability to glycosylate proteins in patterns similar to human cells. Differences include the Gal α1-3 Gal epitope and the N-glycolylneuraminic acid (Neu5gc) have both been found on glycoproteins produced by CHO cells but are not found in normal human glycans (Galili, Uri, et al. *Journal of Biological Chemistry* 263.33 (1988): 17755-17762). Also, certain proteins produced in CHO cells have more acidic isoforms suggesting higher content of sialic acid. Human Embryonic Kidney 293 (HEK293) cells are selected as an expression host for their ability to have human glycosylation of proteins.

Gel Electrophoresis and Protein Transfer.

To analyze glycosylation, western blot analysis was performed with antibodies or lectins that recognize specific glycan antigens to evaluate and compare the glycosylation profile of proteins produced in eukaryotes and prokaryotes. First, protein separation was performed by gel electrophoresis using Novex® NuPAGE® Bis-Tris Pre-cast gels (Life Technologies) according to the manufacturer's protocol. Proteins were transferred from the gel to a nitrocellulose membrane using the iBlot® Dry Blotting System (Life Technologies) and iBlot® Western Detection Kit (Life Technologies) according to the manufacturer's protocol. Protein brands were visualized by staining polyacrylamide gels with Coomassie® G-250 stain SimplyBlue™ SafeStain (Life Technologies) according to the manufacturer's protocol and imaged using the Molecular Imager® Gel Doc™ XR+ System (Bio-Rad).

Glycosylation Profile of SEQID-00363 Expressed in *E. coli* and *A. niger.*

The mannose content of proteins was examined using a glycoprotein detection kit (DIG Glycan Differentiation Kit, Roche) according to the manufacturer's standard protocol. To begin, whole cell extract (5 μg) and soluble cell lysate (5 μg) from *E. coli* transformed with an expression vector encoding the gene for SEQID-00363 (as described herein), SEQID-00363 expressed in *A. niger* (5 μg), and the DIG Glycan Differentiation Kit positive control carboxypeptidase Y (5 μg) were loaded onto a Novex® NuPAGE® 10% Bis-Tris gel (Life Technologies). Protein separation and transfer were performed as described herein. Briefly, nitrocellulose membranes were incubated with digoxifenin (DIG)-labeled *Galanthus nivalis* agglutinin (GNA), a lectin that binds terminal mannose. Membranes were then incubated with anti-Digoxidenin-alkaline phosphatase (AP), followed by incubation with an AP substrate solution (NBT/BCIP). The intensity of AP staining was qualitatively visualized by the naked eye and membranes were photographed. FIG. 49 displays a representative Coomassie-stained gel (panel A) and a GNA probed western blot membrane (panel B) of SEQID-00363 isolated from *A. niger* and SEQID-00363 expressed recombinantly in *E. coli*. In lane 2, a prominent band around 120 kD is representative of glycosylated SEQID-00363. In lane 3, a band around 80 kD is representative of non-glycosylated SEQID-00363. These results demonstrate that SEQID-00363 expressed in *A. niger* (FIG. 49B, Lane 2) is a terminally mannosylated protein (FIG. 49B, Lane 3), while SEQID-00363 expressed in *E. coli* contains no terminal mannose residues on its glycans.

Protein Extraction from Food for Glycan Analysis.

Flaxseed (Organic Brown Flaxseed, Farmers Direct Coop), chickpea (Garbanzo Beans, 365 Everyday Value Organic), corn (frozen, Super Sweet Bicolor Corn, 365 Everyday Value Organic), potato (conventional yellow potato), mushroom (organic white mushroom), broccoli (frozen, Broccoli Flortes, 365 Everyday Value), tomato (conventional Roma tomato), blueberry (Organic Blueberries, Little Buck Organics), grape (Organic Red Seedless Grapes, Anthony's Organic), beef (85% Lean Ground Beef), chicken (Ground Chicken Thighs, Boneless, Skinless, Airchilled), lamb (Ground New Zealand Lamb), turkey (Ground Turkey Thighs), cod (Wild Cod Fillet), and pork (Ground Pork) were purchased from Whole Foods. Venison was provided. Aliquots of each food source (50-2,500 mg) were frozen at −80° C. Proteins were extracted from the food source by grinding the sample with a mortar and pestle before adding 1.0 mL of extraction buffer (8.3 M urea, 2 M thiourea, 2% w/v CHAPS, 1% w/v DTT) and additional grinding with the pestle. The samples were transferred to microcentrifuge tubes and agitated for 30 min at room temperature, followed by addition of 500 μL of 100-μm zirconium beads (Ops Diagnostics) and further agitation for an additional 30 min. Samples were then lysed on a TissueLyser II (Qiagen) at 30 Hz for 3 min, centrifuged for 10 min at 21,130×g, and supernatants were collected. Yeast (Nutritional Yeast, Whole Foods), soy protein isolate (Soy Protein Powder, Whole Foods), and rice protein isolate (Organic Rice Protein, Growing Naturals) were prepared by solubilization in extraction buffer. The total protein concentration of samples was determined by Coomassic Plus Protein Assays (Pierce) according to the manufacturer's standard protocol.

N-Glycolylneuraminic Acid (Neu5Gc) Detection by Western Blot Analysis.

N-glycolylneuraminic acid (Neu5Gc) is a sialic acid found on most mammalian glycans, but is not present on human protein glycoproteins. Human biochemical pathways don't recognize the Neu5Gc sialic acid as foreign, leading to trace amounts found in human glycoproteins following uptake into golgi and incorporation onto newly synthesized proteins. Despite integrating biochemically, however, the immune system recognizes as foreign the adjusted surface conformation containing an externally-derived sialic acid, increasing the risk of many diseases. Anti-Neu5Gc antibodies, which have been detected in human plasma, cause chronic inflammation in response to the ingestion of Neu5Gc containing protein sources (Varki et. al. "Uniquely human evolution of sialic acid genetics and biology", PNAS 2011). The main sources of Neu5Gc include lamb, beef, pork, and even dairy products, with trace amounts also found in fish (Tangvoranuntakul et al., 2003, PNAS, 100 (21): 12045-12050).

Western blot analysis was performed with an anti-Neu5Gc antibody to characterize the Neu5Gc content of proteins extracted from food as well as proteins expressed recombinantly by bacterial hosts. Proteins were extracted from meat sources as described herein. Also, proteins were recombinantly expressed in *E. coli* and/or *B. subtilis* by transformation with individual expression vectors, as described herein, or by transformation with a library of expression vectors, as described in herein. Proteins originating from individual expression vectors, and in some cases protein originating from a library of expression vectors, were purified by IMAC purification, as described herein. A mixture (Protein Mixture 1) of purified proteins recombinantly expressed in *E. coli* was prepared to contain each protein at a final concentration of approximately 1 mg/mL. The proteins included in this mixture, as well as the species in which they are naturally produced, SEQID-00076 Cow, SEQID-00240 Cow, SEQID-00298 Cow, SEQID-00359 Sheep, and SEQID-00510 Turkey.

A sample of each meat extract (beef, pork, deer, lamb, turkey, chicken, and cod), Protein Mixture 1, the 168 nutritive polypeptide library expressed in *E. coli* (IMAC-purified lysate) and *B. subtilis* (IMAC-purified lysate and unpurified supernatant and lysate,), and the cDNA Library expressed in *E. coli* (Rosetta, GamiB, and Gami2 soluble lysate and Rosetta whole cell) and *B. subtilis* (PH951 Grac lysate) were loaded onto a Novex® NuPAGE® 10% Bis-Tris gel (Life Technologies). Protein separation and transfer were performed as described herein. Neu5Gc was detected using the SNAP i.d.® Protein Detection System (Millipore) according to the standard manufacturer's protocol with chicken anti-Neu5Gc (IgY) primary antibody (BioLegend) and goat anti-chicken IgY-horseradish peroxidase (HRP) secondary antibody, both diluted 3:5,000 in Blok™-PO Blocking Buffer. Blots were treated with Luminata Classico Western HRP Substrate (Millipore) according to the manufacturer's protocol and imaged using chemiluminescent detection on the Molecular Imager® Gel Doc™ XR+ System (Bio-Rad). FIG. 50 displays representative Coomassie-stained gels (panel A) and anti-Neu5Gc probed western blot membranes (panel B). These results demonstrate that while Neu5Gc is present in proteins extracted from cow, pig, sheep, turkey, and chicken meat, it is not present in proteins from these animals that have been recombinantly expressed in *E. coli* or *B. subtilis*.

Xylose and Fucose Detection by Western Blot Analysis.

Xylose and fucose are sugars that are often present on plant glycoproteins and can be immunogenic to humans (Bardor et al., 2003, Glycobiology, 13(6): 427-434). The xylose and fucose content of proteins extracted from food sources and proteins recombinantly expressed by bacterial hosts was examined by western blot analysis using anti-Xylose and anti-Fucose antibodies. As described herein, protein samples were prepared either by extraction from food sources or by reconstitution of purchased protein isolates. Proteins were recombinantly expressed in *E. coli* and purified by IMAC purification, as described in herein. A mixture (Protein Mixture 2) of purified proteins recombinantly expressed in *E. coli* was prepared to contain each protein at a final concentration of approximately 1 mg/mL. The proteins included in this mixture, as well as the species in which they are naturally produced, are SEQID-00103 Rice, SEQID-00104 Corn, SEQID-00352 Corn, SEQID-00485 Chickpea, SEQID-00559 Rice, SEQID-00598 Flaxseed, and SEQID-00605 Mushroom.

A sample of each plant and fungi extract (yeast, flaxseed, chickpea, corn, potato, mushroom, soy, rice, broccoli, tomato, blueberry, and grape), Protein Mixture 2, horseradish peroxidase (positive control), and fetuin (negative control) were loaded onto a Novex® NuPAGE® 10% Bis-Tris gel (Life Technologies). Protein separation and transfer were performed as described herein. Western blot analysis was performed using the SNAP i.d.® Protein Detection System (Millipore) according to the standard manufacturer's protocol. Xylose was detected by blotting with rabbit anti-xylose primary antibody (Agrisera) and donkey anti-rabbit IgG- HRP secondary antibody (abeam) diluted 3:5,000 and 3:2,500 in Blok™-PO Blocking Buffer, respectively. Fucose was detected by blotting with rabbit anti-fucose primary antibody (Agrisera) and donkey anti-rabbit IgG-HRP secondary antibody (abeam) diluted 3:10,000 and 3:3,000 in Blok™-PO Blocking Buffer, respectively. Blots were treated with Luminata Classico Western HRP Substrate (Millipore) according to the manufacturer's protocol and imaged using chemiluminescent detection on the Molecular Imager® Gel DOC™ XR+ System (Bio-Rad). FIG. 51 demonstrates a representative Coomassie-stained gel, anti-xylose probed western blot membrane, and anti-fucose probed western blot membrane. These results demonstrate that while xylose and fucose are both present in plant proteins extracted from flaxseed, chickpea, corn, potato, soy, rice, broccoli, tomato, blueberry, and grape, they are not present in proteins from plant and fungi sources that have been recombinantly expressed in E. coli.

Selection of Proteins with High Asparagine, Serine, and/or Threonine Mass Compositions to Decrease Nutritive Polypeptide Glycosylation.

The glycosylation state of a nutritive polypeptide can be decreased by selecting sequences low in glycosylation sites. These sites include Asparagine, for N-linked glycosylation, and serine and threonine, for O-linked glycosylation. These isolated polypeptides contain a higher amino acid percentage by mass due to the reduced level of bound polysaccharide composition along the polypeptide, allowing a higher digestible amino acid dose per gram of nutritive polypeptide, and have reduced immune activity upon consumption. The N-linked glycosylation of available glycan acceptor sites along a nutritive polypeptide backbone occurs predominantly at Asparagine amino acid residues. Expression of heterologous polypeptides selected for their low levels of Asparagine allows for polypeptides to be isolated with decreased glycan structures. The O-linked glycosylation of available glycan acceptor sites along a nutritive polypeptide backbone occurs predominantly at Serine and Threonine amino acid residues. Expression of heterologous polypeptides selected for their low levels of either Serine or Threonine allows for polypeptides to be isolated with decreased glycan structures Selection of proteins with high Asparagine, Serine, and/or Threonine mass compositions to increase nutritive polypeptide glycosylation. The glycosylation state of a nutritive polypeptide can be increased by selecting sequences rich in glycosylation sites. These sites include Asparagine, for N-linked glycosylation, and serine and threonine, for O-linked glycosylation. Increase in glycosylation can enable increased solubility and thermostability of the nutritive polypeptide. The N-linked glycosylation of available glycan acceptor sites along a nutritive polypeptide backbone occurs predominantly at Asparagine amino acid residues. Expression of heterologous polypeptides selected for their high levels of Asparagine allows for polypeptides to be isolated with increased glycan structures. The O-linked glycosylation of available glycan acceptor sites along a nutritive polypeptide backbone occurs predominantly at Serine and Threonine amino acid residues. Expression of heterologous polypeptides selected for their high levels of either Serine or Threonine allows for polypeptides to be isolated with increased glycan structures Removal of Glycans from Isolated Nutritive Polypeptides.

The glycosylation state of nutritive polypeptides can have an effect on structure and physical properties. As described herein, nutritive polypeptides expressed in recombinant hosts can have a different glycosylation than occurs naturally. If a nutritive polypeptide is produced with glycosylation, the glycans can be released to alter structural and physical properties using chemical or enzymatic methods. Common chemical methods of glycan release are hydrazinolysis and alkali/reducing conditions (β-elimination) (Takasaki, Seiichi, et al. Methods in enzymology 83 (1981): 263-268.). Glycans can be released from proteins using an Endoglycosidases such as PNGaseF, Endo-H, Endo F2, PNGaseA, or O-Glycanase or using an Exoglycosidases such as Sialidase, Alpha Galactosidase, Beta Galactosidase, Hexosaminidase, Galactosaminidase, Alpha Mannosidase, Beta Mannosidase, Alpha Fucosidase, exact enzymes are selected based on oligosaccharide composition and linkage (Merry, Tony, et al. Capillary Electrophoresis of Carbohydrates. Humana Press, 2003. 27-40.).

PNGase F is a very effective enzymatic method for removing almost all N-linked oligosaccharides from glycoproteins. PNGase F digestion deaminates the aspargine residue to aspartic acid, and leaves the oligosaccharide intact. To deglycosylate a protein using an Endoglycosidase, 500 ug of glycoprotein is resuspended in 50 ul of 50 mM sodium phosphate pH 7.5. PNGase F is added at 0.1 U/ml and the solution is incubated at 37 C for 24 hours. The reaction is monitored for completion by SDS-PAGE.

Screening for IgE-Mediated Allergic Response Due to Glycan.

A change in glycan modifications to a nutritive polypeptide affects the IgE binding interactions. About 20% or more of allergic patients generate specific anti-glycan IgE, which is often accompanied by IgG (Altmann, F. The role of protein glycosylation in allergy, Int Arch Allergy Immunol. 2007). For polypeptides which induce an IgE-mediated immune response, as is the case with allergens, a glycan modification as described herein may reduce the isolated polypeptide's allergenicity compared to in its native composition. In this example, polypeptides are screened for IgE binding in an in-vitro serum assay as well as for reactivity by skin prick test (as described in Mari, A et. al. IgE to Cross-Reactive Carbohydrate Determinants: Analysis of the Distribution and Appraisal of the in vivo and in vitro Reactivity, 2002).

Allergenic response due to the glycan (termed cross-reactive carbohydrate determinants), can be determined by comparing results of a skin prick test with an IgE serum binding assay. Unselected consecutive subjects presenting respiratory symptoms that suggest an allergic disease, and referred to an allergy unit, are enrolled. Demographical and clinical data are recorded for each patient. Patients with a clinical history of anaphylaxis are excluded from the study. Those patients who haven't previously received a specific immunotherapy (SIT) course are not excluded. All the treated patients receive alum-adsorbed extract of the nutritive polypeptide in both the isolated form and in the native composition. For statistical purposes, only pollen treated patients are evaluated. Patients undergo skin prick testing (SPT), with a standardized procedure and recording (Mari, A. et. al Specific IgE to cross-reactive carbohydrate determinants strongly affect the in vitro diagnosis of allergic diseases. J Allergy Clin Immunol 1999), using the allergenic extracts described above. Following the SPT, sera are obtained from patients who consent to blood sampling for an in vitro diagnostic procedure. Sera are stored at −20° C. until required. Informed consent for skin testing and blood sampling is obtained by patients or caregivers during the allergy consultation.

Total IgE is determined in all the sera (Radim, Pomezia, Italy). Allergen-specific IgE is detected by the CAP system following the manufacturer's instructions (Pharmacia, Uppsala, Sweden). Values 60.4 kUA/I is considered positive. As there is not a single test to detect CCD-IgE, discrepancy of the results between a positive in vitro test to the nutritive polypeptide bearing carbohydrate moieties recognized by IgE and a negative SPT to the same glycoprotein is assumed to be indicative of the presence of CCD-IgE. IgE detection is performed on the largest random samples of sera recorded negative in the SPT to the same allergenic extract. Modification in the glycan structure that mediates binding to IgE is observed by a shift in the distribution in patients for which a CCD-IgE is detected upon isolation of the nutritive polypeptide and confirmation of altered glycan structure.

Example 33

In Animal Demonstration of Nutritive Polypeptide Amino Acid Pharmacokinetics

Pharmacokinetic (PK) studies may be performed to evaluate the plasma concentration of amino acids following oral administration of a nutritive polypeptide formulation. Such analyses provide information on the rate and extent of digestion of the protein in the gastrointestinal intact and the bioavailability of the free amino acids and/or peptides released during digestion. Growing rats, which have a similar small intestinal transit rat to adult humans (3-4 h), are accepted as a suitable model for pharmacokinetic studies with oral administration (DeSesso and Jacobson (2001) Anatomical and physiological parameters affecting gastrointestinal absorption in humans and rats, Food and Chemical Toxicology 39: 209-228).

Rat Pharmacokinetic Studies.

Male Sprague Dawley rats with indwelling jugular vein cannula (NC) were purchased from Harlan Laboratories and acclimated to the Test Facility (Agilux Laboratories) for at least two days prior to study initiation. Prior to dose administration animals were fasted overnight (11-13 h) and remained fasted until completion of the study. Test articles were orally administered via a bulb-tipped 18 gauge stainless steel gavage needle attached to a syringe. The weight of all dose syringes were recorded prior to and following dosing to more accurately determine the volume of solution dosed. Serial blood samples (~300 μL) were collected from the NC at time 0 (pre-dose) and 0.25, 0.5, 1, 2, and 4 h post-dose. Blood samples were collected into tubes containing the anti-coagulant K2EDTA, a general protease inhibitor cocktail (Sigma P8340, diluted 1:100 in whole blood), and a DPP IV inhibitor (Millipore DPP4, diluted 1:100 in whole blood). Immediately following blood collection tubes were vortexed and stored on wet ice until processing to plasma by centrifugation (3,500 rpm at 5° C.) within 1 h of collection. Plasma samples were then transferred into new tubes and stored at −80° C. In some cases, following the terminal blood collection animals were euthanized and the terminal ileum and its contents were collected and analyzed as described herein.

The concentration of Glu, Ser, His, Gly, Thr, Arg, Ala, Tyr, Val, Met, Phe, Ile, Leu, and Lys in the plasma samples was determined by HPLC amino acid analysis, as described herein. Prior to HPLC amino acid analysis, insoluble particles were removed from plasma samples by centrifugation (1100×g at 4° C.) for 10 min. A 25 μL sample of the soluble fraction was then transferred to a 96-well plate, for some samples an internal standard (Norvaline, Agilent) was added to each plasma sample at final concentration of 0.5 mM. Amino acids not measured in the current HPLC amino acid analysis, including Gln, Asn, Trp, Hydroxyproline (Hyp), and Sarcosine (Sar), are analyzed by using a standard mixture that includes the individual standard stocks provided in the supplemental amino acid kit (Agilent) and comparing the chromatographic profiles of the samples against that of the combined standards. Because solutions containing the supplemental standards are unstable at room temperature the supplemental amino acid standards are prepared immediately prior to use and used for no longer than 24 h.

FIG. 52 displays the change in average area under the curve (AUC) (±SD) of plasma amino acid concentrations (μM·h) measured in blood samples collected from rats over 4 h following oral administration of the indicated nutritive polypeptides at the doses listed in Table E33A. FIG. 53 shows SEQID-00105 as an example of oral administration of nutritive polypeptides altering the concentration of amino acids in rat plasma. The profile of amino acids detected in the rat plasma after oral administration was dependent on the amino acid sequence of the nutritive polypeptide. For example, oral administration of the polypeptides SEQID-00240, SEQID-00338, and SEQID-00352 increased the change in AUC0-4h for plasma Lys, whereas administration of the polypeptides SEQID-00363, SEQID-00424, and SEQID-00426 did not alter the change in AUC0-4h for plasma Lys (FIG. 52). Additionally, the nutritive polypeptide SEQID-00240 serves as an example of a polypeptide that is capable of delivering essential amino acids (EAAs) while causing no flux in plasma Phe concentration. FIG. 54 demonstrates representative plasma amino acid concentration time curves for oral administration of SEQID-00105 (2.85 g/kg) to rats. FIG. 54 demonstrates a dose-response effect on plasma Leu concentrations following oral administration of SEQID-00105 at the doses indicated in Table E33A. Taken together, these results demonstrate that oral administration of nutritive polypeptides can be used to deliver specific amino acid profiles to the systemic circulation in rats.

TABLE E33A

List of the nutritive polypeptides and doses used in rat pharmacokinetic studies.

| FIG. 52 and 53 Symbol | SEQID | Dose (g/kg) |
|---|---|---|
| 1 | Vehicle | NA |
| 2 | 105 | 2.85 |
| 3 | 240 | 1.54 |
| 4 | 338 | 2.85 |
| 5 | 352 | 2.85 |
| 6 | 363 | 2.85 |
| 7 | 423 | 2.85 |
| 8 | 424 | 2.85 |
| 9 | 425 | 2.85 |
| 10 | 426 | 2.85 |
| 11 | 429 | 2.85 |
| 12 | 559 | 2.85 |
| 13 | 587 | 2.85 |
| 14 | 105 | 2.85 |
| 15 | 105 | 1.78 |
| 16 | 105 | 1.11 |

NA: not applicable.

Example 34

Modulation of Nutritive Polypeptide Digestibility

Multiple methods of protein modification were used to alter the structure of a model nutritive polypeptide, SEQID- 00363. These methods were performed to assess the relevance of specific structural features in regards to protein digestibility and bioavailability. These modifications include reduction of glycans, hydrolysis of the protein, reduction/alkylation of disulfide bonds, and thermal denaturing of protein structure. Resulting materials from these modifications were evaluated for improved digestion using in vitro digestion assays and, in some cases, in vivo assays. These methods or other means of producing similar structural changes end can be applied to other nutritive polypeptides.

Enzymatic Deglycosylation.

It is predicted that SEQID-00363 contains high-mannose O-linked glycosylation (Goto et al., 2007 Biosci. Biotechnol. Biochem.). To assess the effect of glycosylation on the digestion of SEQID-00363 the mannose glycans were significantly reduced enzymatically. A non-specific alpha mannosidase (M7257, Lot SLBC4303V, Sigma Aldrich, St. Louis, Mo.) was used to cleave all 1-3, 1-4 and 1-6 glycosidic linkages within the O-glycans. This alpha mannosidase does not cleave any non-mannose glycosidic linkages; it is predicted that this enzyme is ineffective against N-linked glycan release.

The deglycosylation reaction was adapted from Jafari-Aghdam et al., 2005 Biochimica et Biophysica Acta. The protein stock of SEQID-00363 was resuspended from lyophilized powder to an enzyme concentration of 100 g/L into deglycosylation reaction buffer: 20 mM sodium acetate, 2 mM zinc chloride, 0.01% 2-mercaptoethanol, pH 4.3. Reagent stocks were diluted into the deglycosylation reaction to a final volume of 0.5 L. The reaction was performed at a SEQID-00363 concentration of 10 g/L and an alpha mannosidase concentration of 0.5 EU per mg of SEQID-00363. The reaction was sterile filtered through a 0.2 um filter directly into 7×70 mL 3.5 kD dialysis cassettes in 20 L of deglycosylation reaction buffer. The reaction was performed in dialysis in order to decrease proposed feedback inhibition of the alpha mannosidase by released (mono/poly) saccharides. The reaction was then stored at 37° C. for six days. Throughout the course of the reaction, approximately 10% of SEQID-00363 was lost due to insoluble aggregate formation. At the terminal (6 day) time point, the reaction was collected from dialysis, sterile filtered, concentrated, and diafiltered into 10% phosphate buffered saline, pH 7.4. Successfully reduction of mannose glycans was monitored by a decrease in size by SDS-PAGE and anti-GNA western blot as described herein. In order to create a high protein concentration formulation of deglycosylated SEQID-00363, the remaining pool was concentrated in an Amicon spin concentrator (EMD Millipore, Billerica, Mass.) until the final concentration approached 250 g/L. The high-concentration formulation remained soluble at 4° C., and was held at that temperature for long-term storage.

Protein Hydrolysis.

Another approach to increasing bioavailability relative to a preparation of native protein was hydrolysis into short peptides. Protein hydrolysates of commodity proteins, such as whey (Perea et al., 1993 Enzyme Microb. Technol.) and soy (Kong et al., 2008 Bioresource Technology) are generated enzymatically through subtilisin-mediated proteolysis.

Subtilisin is most active at pH 8.5 and 55° C. (Alder-Nissen, 1986). For the intent of this experiment, a lyophilized preparation of a model protein enzyme was resuspended to 275 g/L in 100 mM sodium carbonate in order to bring the pH of the resulting protein solution to approximately pH 8. Subtilisin (Alcalase 2.4 L, Sigma Aldrich, St. Louis, Mo.) was added to the protein solution at a concentration of 5.93×10-4 U per mg of model protein enzyme. The reaction was then diluted to 250 g/L model protein enzyme and transferred to 55° C. for 24 hours. Once completed, the hydrolyzed material was stored at 4° C.

Reaction progress was monitored by size exclusion chromatography (SEC) using a Superdex 75 (5×150 mm) column (GE Healthcare, Uppsala, Sweden) and also by SDS-PAGE analysis.

Protein Reduction and Alkylation.

Disulfide containing proteins can be reduced and alkylated in order to break disulfide bonds and stabilize free thiols. This modification disrupts all disulfide bridge structure and furthermore prevents disulfide bridges from reforming both intramolecularly or extramolecularly. SEQID-00363 contains 10 cysteines, and four disulfide bonds as predicted by SCRATCH Protein Predictor (Cheng et al., 2005 Nucleic Acids Res.).

SEQID-00363 was reduced and alkylated at a final concentration of 6 g/L using Bio-Rad ready Prep Reduction/Alkylation Kit (Bio-Rad, Hercules, Calif.). The reduction/alkylation reaction was performed as recommended by the manufacturer's instructions. SEQID-00363 was reduced and alkylated in 50 mM phosphate, pH 8.0. Samples were analyzed by non-reducing SDS-PAGE analysis.

Heat-Induced Protein Destabilization.

Denaturation of protein involves the disruption of ordered structure of the molecule; i.e., reduction of all quaternary, tertiary and secondary structure to primary structure. Denaturation disrupts all non-covalent intramolecular interactions; i.e., hydrogen bonding, ionic interaction, Vander Waals interaction and hydrophobic interaction. Heat can be used to disrupt these interactions, and reduce a native protein to its primary structure (with the exception of disulfide linkages).

SEQID-00363 was diluted to 30 g/L in 10% PBS, pH 7.4 and rapidly heated to 95° C. Upon boiling, the protein was removed from heat treatment and immediately transferred to in vitro digestion analysis as described in herein.

In Vitro Digestibility of Modified Forms of SEQID-00363.

The digestibility of native SEQID-00363 and modified forms (ie. deglycosylated, reduced and alkylated, and heat-denatured) of SEQID-00363 was evaluated using the methods described herein. Briefly, native and modified forms of SEQID-00363 were treated with simulated gastric fluid (SGF) and the presence of intact protein remaining at various time points was analyzed by gel electrophoresis as described herein. Additionally, the amount of free amino acids present after exposure to a Pancreatin-based simulated digestive system was analyzed by reverse phase HPLC amino acid analysis as described herein. Results from the SGF digest of native and modified forms of SEQID-00363 demonstrate that modification of SEQID-00363 via deglycosylation, reduction and alkylation, and heat-denaturation enhances the digestibility of the protein to varying degrees. Results from the Pancreatin digest of native and modified forms of SEQID-00363 demonstrate that modification of SEQID-00363 via deglycosylation and heat-denaturation, but not reduction and alkylation, enhanced the release of free Leu during digestion. Table E34A lists half-life values calculated from the exponential decay curves and free Leu (µM) at 120 min time point.

TABLE E34A

SGF Half-life (t½) in min and Free Leu (μM) at 120 min time point of Pancreatin digest of modified nutritive polypeptide

|  | SGF Half-life (t½) in min | Free Leu (μM) at 120 min time point of Pancreatin digest |
|---|---|---|
| SEQID-00363 | 36 | 574.2 |
| Heat-denatured SEQID-00363 | 20.4 | 763.5 |
| Reduced and alkylated SEQID-00363 | 20.4 | 598.1 |
| Deglycosylated SEQID-00363 | 4.3 | 799.2 |

Bioavailability of Modified Forms of SEQID-00363.

The bioavailability of native and modified forms (ie. deglycosylated and hydrolyzed) of SEQID-00363 was evaluated using the methods described in herein. Briefly, native and modified forms of SEQID-00363 were orally administered to intrajugular-cannulated rats and concentration of free amino acids in plasma samples collected over a 4 h period was determined by HPLC amino acid analysis. Amino acid analysis of plasma samples collected in the rat pharmacokinetic study of native and modified forms of SEQID-00363 are displayed in FIG. 55. These results demonstrate that hydrolysis of SEQID-00363 increased the bioavailability of Leucine, Serine, Threonine, and in general essential amino acids (EAAs). While deglycosylation of SEQID-00363 did not increase the bioavailability of Leucine or EAAs, it did increase the bioavailability of Serine and Threonine.

Ileal Digestibility of Modified Forms of SEQID-00363.

Protein quality is a function of amino acid composition, digestibility, and bioavailability. Ileal digestibility assays may be used to measure the difference between the contents (ie. amino acid, nitrogen, dry matter weight) of a protein and the contents of the digesta in the terminal ileum following ingestion of the protein. Results from ileal digestibility assays can be used to calculate amino acid, nitrogen, and dry matter ileal digestibility coefficients and provide knowledge about the protein's digestibility and amino acid bioavailability (Darragh and Hodgkinson, 2000, Journal of Nutrition, 130(7): 1850S-1856S). Fecal digestibility coefficients, determined over the entire digestive tract, tend to overestimate amino acid digestibility and bioavailability due to microbial metabolism in the large intestine. Since protein digestion and amino acid absorption occurs mainly in the upper small intestine and is effectively complete by the end of the ileum, ileal digestibility assays are now accepted as the method of choice for determining protein and amino acid digestibility in monogastric mammals. Growing rats, which have a similar small intestinal transit rate to adult humans (3-4 h), are accepted as a suitable model for ileal digestibility assays (Amidon et al., 1986, The Journal of Pharmacy and Pharmacology, 38(5): 363-368).

A rat pharmacokinetic study with oral administration of native and modified forms of SEQID-00363 was performed as described herein. The indigestible marker Cobalt-EDTA was formulated at 50 mg/L in the dosed protein solutions to monitor differences in intestinal transit rate between treatment groups and individual rats. Following the final blood collection (at t=4 h) rats were euthanized and the terminal ileum (20 cm of small intestine prior to the cecum) and its contents (the digesta) were collected into a pre-weighed tube. The ileum was flushed with saline and pooled with the digesta. The pH of the digesta was adjusted to ~3.0 with HCl in order to inactivate all enzymes. The ileum samples were placed into separate pre-weighed 15 mL conical tubes. All samples were flash frozen in liquid nitrogen, and stored at −80° C. until further analysis. Individual ileum and ileum content weights were calculated and recorded for each sample.

A sample of the digesta, which exists as a heterogenous solution containing insoluble particles, was used in the Coomassie Plus Protein Assay, as described herein, to determine protein concentration. The average total protein concentration in digesta samples harvested from rats administered vehicle, native SEQID-00363, deglycosylated SEQID-00363, and hydrolyzed SEQID-00363 was 0.1, 0.9, 0.9, and 0.3 mg/mL, respectively. Based on the volumes of collected digesta the total protein mass in digesta samples harvested from rats administered vehicle, native SEQID-00363, deglycosylated SEQID-00363, and hydrolyzed SEQID-00363 was 1.2, 6.9, 7.7, and 2.2 mg, respectively. These results demonstrate that the concentration and total mass of protein is higher in the digesta of rats administered native and deglycosylated SEQID-00363 than in rats administered either vehicle or hydrolyzed SEQID-00363. Together these results suggest that hydrolyzed SEQID-00363 is more completely digested in the rat gastrointestinal system than either native or deglycosylated SEQID-00363.

To determine ileal digestibility coefficients an aliquot of the dosing sample and the ileal digesta sample are analyzed for total amino acid content by reverse phase HPLC amino acid analysis (Lookhart and Jones, 1985, Cereal Chemistry, 62(2):97-102), total nitrogen content by Kjeldhal analysis (Lynch and Barbano, 1999, JOURNAL OF AOAC INTERNATIONAL, 82(6): 1389-1398), and Cobalt content by Inductively Coupled Plasma Mass Spectrometry (ICP-MS) (Taylor, H. E., Inductively Coupled Plasma-mass Spectrometry: Practices and Techniques, Academic Press, 2001) to determine ileal amino acid and nitrogen digestibility coefficients.

Example 35

Treatment of Nutritive Polypeptides for Reduced Activity

Modification of enzymatically active nutritive polypeptides can alter both the enzymatic activity, and the structural stability of the protein. It can be advantageous for an orally administered nutritive polypeptides to lack activity that is not required for delivery of amino acid nutrients. Furthermore, deactivation is indicative of destabilization that can be more digestible and bioavailable than its native counterpart. Enzyme modification was achieved through either chemical or heat treatment(s). Enzymatic activity was measured through an in vitro assay.

Activity Assay.

Inactivation of SEQID-00363 was tested by a glucoamylase activity assay. Glucoamylase acts to hydrolyze p-nitrophenyl-α-D-glucopyranoside to p-nitrophenol (PNP) and glucose. The activity of the enzyme in units (U) per mL was determined by measuring the absorbance of release PNP at 400 nm (method adapted from Glucoamylase Activity Assay (U.S. Pharmacopeia. Food Chemicals Codex, 8th edition; 2012:1314-1315.)) PNP standards at 0.12, 0.06, 0.03, 0.015 and 0.0075 mol/mL in 0.3 M sodium carbonate were used to determine the millimolar extinction coefficient (∈) using the follow equation: ∈=A400 nm/C where the average value considered where A400 nm is the absorbance at 400 nm measured using a spectrophotometer with a 10 mm light path and C is the standard concentration in μmol/mL. The samples were made at dilutions in 0.1 M sodium acetate pH 4.5 that fall in the absorbance range of the standards. 100 μL of sample was incubated at 50° C. for 5 minutes prior to addition of 100 μL of PNPG solution (100 mg PNPG, dilute to 100 mL in 0.1 M sodium acetate pH 4.5) that had been equilibrated at 50° C. for at least 15 minutes. The sample was then incubated at 50° C. and 100 μL of 0.3 M sodium carbonate added 10 minutes after PNPG addition to stop the reaction. The absorbance at 400 nm was then measured and the activity in U/mL calculated as follows: Activity= [(Asample−Ablank)×0.3 mL×Dilution Factor]/∈×10 min× 0.10 μmol/min/unit×0.1 mL where Asample is the sample absorbance and Ablank is the blank absorbance at 400 nm, 0.3 mL is the volume of the reaction, 10 min is the reaction time, 0.10 μmol/min is the amount of PNP cleaved per unit of enzyme and 0.1 mL is the sample aliquot. 1:1:1:0.1 M sodium acetate pH 4.5:0.3 M sodium carbonate: PNPG solution is used as a blank. Activity is reported as specific activity (U/mL or U/mg) or as a relative activity (i.e. compared to a control protein).

Protein Modification for Deactivation.

Protein enzymes can be deactivated through chemical-induced destabilization of the enzymatic active site of the molecule. An experiment was performed that screened a subset of reagents that represented different chemical classes and mechanisms of action including: Oxidation (Bleach, H2O2, ethylene oxide); Reduction (DTT, bME, TCEP); Chaotrope (CaCl2, Urea, Gnd HCl, NaSCN); High pH (Na2CO3, Tris Base, Na2HPO4); Low pH (Na3Citrate, Tris HCl, Acetic acid, Boric acid); Neutral pH (Na-Citrate, MOPS Acid, MES Acid, Na-Acetate); Detergents (Tween 80, Triton-X-100, CHAPS, SDS, MPD); Chelation (EDTA, citrate).

SEQID-00363 was formulated in water to 300 g/L and diluted 10× into an array of chemical deactivation conditions (final concentration=30 g/L). SEQID-00363 was subsequently assayed for enzymatic activity after 10 minutes of deactivation and 4 days of deactivation Table E35A.

TABLE E35A

Chemical deactivation of SEQID-00363. Results of enzyme activity assay at 4 day time point. All enzyme activities are normalized to the negative control (water).

| Condition | Activity After 4 Days (% of Water) |
|---|---|
| Water Control | 100% |
| 1% Triton-X-100 | 93% |
| 200 mM CaCl2 | 92% |
| 1% CHAPS | 85% |
| 50 mM CaCl2 | 84% |
| 400 mM CaCl2 | 79% |
| 100 mM CaCl2 | 78% |
| 5% BME | 77% |
| 250 mM EDTA | 76% |
| 0.1% H2O2 | 76% |
| 0.01% Bleach | 73% |
| 50 mM DTT | 73% |
| 0.3% H2O2 | 72% |
| 1% Tween 80 | 66% |
| 1% SDS | 65% |
| 0.5M Gnd HCl | 60% |
| 1M Gnd HCl | 58% |
| 250 mM Tris Base | 56% |
| 100 mM Tris Base | 54% |
| 2M Gnd HCl | 46% |
| 500 mM Tris Base | 41% |
| 5M Urea | 41% |
| 0.1% Bleach | 21% |

TABLE E35A-continued

Chemical deactivation of SEQID-00363. Results of enzyme activity assay at 4 day time point. All enzyme activities are normalized to the negative control (water).

| Condition | Activity After 4 Days (% of Water) |
|---|---|
| 50 mM Na2CO3 | 19% |
| 10M Urea | 15% |
| 4M Gnd HCl | 10% |
| 0.615% Bleach | 9% |
| 100 mM Na2CO3 | 6% |
| 200 mM Na2CO3 | 4% |
| 500 mM Na2CO3 | 0% |
| 6M Gnd HCl | 0% |

Relative to a water deactivation negative control, SEQID-00363 displayed greatest deactivation in strong chaotropes such as 6M Gnd.HCl and 4M urea; high pH formulations of sodium carbonate; and the strong oxidizer, sodium hypochlorite (household bleach). At t=4 days, these conditions all displayed less than 20% of relative enzymatic activity after four days of treatment. Due to the health risks associated with consumption of vigorous oxidizers and strong chaotropes, treatment of SEQID-00363 with high pH was identified as the best condition for deactivation of the enzyme. Relative to the 10 minute time point, samples taken at the four day time point suggest that chemical deactivation at room temperature is not a fast-acting process. The kinetics of deactivation are likely not very fast in many of the assayed conditions.

An experiment measured deactivation of SEQID-00363 by heat at multiple buffer conditions was tested. SEQID-00363 was diluted to 3 g/L in 20 mM sodium phosphate pH 7, 20 mM sodium phosphate pH 9, 20 mM sodium carbonate pH 11 and water. 100 μL of sample was then treated at ambient temperature, 60° C., 70° C., 80° C. and 90° C. for each buffer for 5 minutes in a PCR thermocycler. The activity of each enzyme was tested by the glucoamylase activity assay and each activity normalized to the activity in water at ambient temperature (control). The results are shown below in Table E35B.

TABLE E35B

Chemical deactivation of SEQID-00363. Results of enzyme activity assay at 4 day time point. All enzyme activities are normalized to the negative control (water).

| Condition | Activity (% of Water, Ambient) |
|---|---|
| Water, Ambient | 100% |
| Water, 60° C. | 84% |
| Water, 70° C. | 14% |
| Water, 80° C. | 3% |
| Water, 90° C. | 3% |
| 20 mM Sodium Phosphate pH 7, Ambient | 101% |
| 20 mM Sodium Phosphate pH 7, 60° C. | 53% |
| 20 mM Sodium Phosphate pH 7, 70° C. | 2% |
| 20 mM Sodium Phosphate pH 7, 80° C. | 1% |
| 20 mM Sodium Phosphate pH 7, 90° C. | 1% |
| 20 mM Sodium Phosphate pH 9, Ambient | 99% |
| 20 mM Sodium Phosphate pH 9, 60° C. | 27% |
| 20 mM Sodium Phosphate pH 9, 70° C. | 2% |
| 20 mM Sodium Phosphate pH 9, 80° C. | 1% |
| 20 mM Sodium Phosphate pH 9, 90° C. | 1% |
| 20 mM Sodium Carbonate pH 11, Ambient | 93% |
| 20 mM Sodium Carbonate pH 11, 60° C. | 0% |
| 20 mM Sodium Carbonate pH 11, 70° C. | 0% |

TABLE E35B-continued

Chemical deactivation of SEQID-00363. Results of enzyme activity assay at 4 day time point. All enzyme activities are normalized to the negative control (water).

| Condition | Activity (% of Water, Ambient) |
| --- | --- |
| 20 mM Sodium Carbonate pH 11, 80° C. | 0% |
| 20 mM Sodium Carbonate pH 11, 90° C. | 1% |

An additional multifactorial experiment was performed that assayed the effect of temperature and pH for varying exposure time on the enzymatic activity of SEQID-00363. SEQID-00363 was formulated to 100 g/L, and the effect of either a high pH spike, or a diafiltration into high pH buffers was tested against a gradient of temperatures across 25° C. to 70° C. over a time course of 0 hours to 24 hours. Upon analysis, samples were neutralized to ~pH 7 using a spike of 1M sodium acetate buffer.

SEQID-00363 experimental overview and design was as follows. SEQID-00363 was resuspended to 100 g/L and either spiked with 0.25M sodium carbonate pH 10, diafiltered into 50 mM sodium carbonate pH 10, or diafiltered into 10% phosphate buffered saline pH 9.0. Samples were incubated at either 40, 50, 60 or 70° C. across a time course that included sampling points at t=0, 1, 2, 4 and 24 h.

Inactivation of SEQID-00363 was assayed using an activity assay as described herein. Samples were analyzed by specific activity (U/mg) and visual solubility, as either a gel, viscous or fluid. This study found SEQID-00363 is enzymatically deactivated by both temperature and pH. Some treatments caused irreversible aggregation, and gel formation of the nutritive polypeptide; these samples were not analyzed for enzymatic activity. The results of this experiment suggest that SEQID-00363 can be solubly deactivated at pH 10 at 25° C. As the temperature of the reaction increases, the protein remains deactivated, but becomes insoluble.

pH was therefore defined as a critical process variable in regard to SEQID-00363 deactivation. A subsequent study was performed to explored SEQID-00363 deactivation as a function of pH at room temperature. A process which can be performed at room temperature is less costly and easier to scale up than a heated process. SEQID-00363 was formulated to 100 g/L at pH 3.6 and using an ultrafiltration membrane, the buffer was exchanged into a series of sodium carbonate buffers. The SEQID-00363 solution pH increased from 3.6 to 11.0 during the course of buffer exchange. Samples of the protein were taken from the ultrafiltration system systematically during the course of buffer exchange, resulting in a set of samples across the pH range. These samples were held at room temperature and each sample was split in half. Half of each sample was neutralized into sodium acetate buffer after 2-5 hours. Neutralized samples were then assayed for enzyme activity as described and results are in the Table E35C.

TABLE E35C

Effect of 2-5 hour incubation over pH range on activity.

| pH | Relative activity (%) |
| --- | --- |
| 3.6 | 100 |
| 4 | 91 |
| 5 | 83 |

TABLE E35C-continued

Effect of 2-5 hour incubation over pH range on activity.

| pH | Relative activity (%) |
| --- | --- |
| 6 | 82 |
| 7 | 89 |
| 8 | 86 |
| 9 | 56 |
| 9.7 | 54 |
| 10 | 37 |
| 10.9 | 13 |

Deactivation by hydrolysis of SEQID-00363 was also tested by glucoamylase activity assay. The procedure of protein hydrolysis is described herein. Hydrolysis was found to reduce activity to 7% relative to control.

Other amylase nutritive polypeptide deactivation was also tested. Deactivation of SEQID-00424 was tested by the glucoamylase activity assay as described herein, but instead utilizing a pH 5.0 acetate buffer (recommended for *Aspergillus oryzae* derived enzymes). Samples were deactivated by hydrolysis or by boiling, as described herein. Boiling reduced activity to 0% and hydrolysis reduced activity to 51% relative to control.

Example 36

Disruption of Nutritive Polypeptide Enzymatic Activity

Construction of Mutant Proteins.

Multiple mutations were tested to determine the degree of enzymatic inactivation that could be achieved for a model protein known to have enzymatic activity (SEQID-00338, UniProt ID: P07170). In this protein, the substrate binding sites includes positions 42, 134, 167, and 178. In addition, there is a magnesium ion binding site at position 91. Single amino acid mutations were made at several substrate-binding positions. The mutants were expressed and tested for enzymatic activity.

The single amino acid mutant proteins were constructed by PCR amplification of two pieces. The first piece is amplified using a forward primer that binds to the 5'-end of the gene (ATCACCACCATCACCATCATAGCAGCAGC-GAAAGCATTCGTATG) with an overhang that is compatible with a His-tag and a reverse primer (Table E36A) containing the most common codon for the target amino acid in *Escherichia coli* and the 20-bp flanking region upstream and downstream of the mutation. The second piece amplifies the 3'-end of the protein immediately following the mutation site using a forward primer specific to the position of the mutation (Table E36A) and a reverse primer that binds to the 3'-end of the gene (TGTTAGCAGCCGGATCCT-TAATCTTTGCCCAGTTTATTCAGAATATC). Standard PCR reaction conditions were used for all pieces, which contains 0.5 uM forward primer, 0.5 uM reverse primer, 1× Phusion Polymerase Master Mix (New England Biolabs), and 1-100 ng template DNA in 50 ul final volume. The thermocycle conditions are initial denaturing at 98° C. for 30 sec, cycle 30 times with denaturing temperature at 98° C. for 10 sec, annealing temperature at 55-60° C. 15 sec, extension temperature at 72° C. for 15 sec/kb product. The template DNA are removed from the final products by adding 1 ul Dpn I (New England Biolabs) and 5 ul 10× CutSmart buffer and incubating at 37° C. for 1 hour. Each PCR product is cleaned and concentrated following a Gel Recovery kit (Zymo Research) and eluted in 20 ul sterile water before proceeding to the next assembly step.

TABLE E36A

List of reverse primers used to amplify PCR piece 1 for the mutants.

| Mutation | Reverse Primer 1 |
|---|---|
| D91F | GGAATGGTACGCGGAAAACCAAACAGAATAAAGCCATTTTTGCATGCC |
| D91I | GGAATGGTACGCGGAAAACCAATCAGAATAAAGCCATTTTTGCATGCC |
| R134M | CCGCTTGCCGGATGAATCAGCATACCGGTAATACGTGCAACCAG |
| R134Y | CCGCTTGCCGGATGAATCAGATAACCGGTAATACGTGCAACCAG |
| R42A | GTACCTTTTGCAATCTGGCTTGCCAGCATATCACCGGTTGCCAG |
| R42C | GTACCTTTTGCAATCTGGCTACACAGCATATCACCGGTTGCCAG |
| R42G | GTACCTTTTGCAATCTGGCTACCCAGCATATCACCGGTTGCCAG |
| R42I | GTACCTTTTGCAATCTGGCTAATCAGCATATCACCGGTTGCCAG |
| R42K | GTACCTITTGCAATCTGGCTTTTCAGCATATCACCGGTTGCCAG |
| R42L | GTACCTTTTGCAATCTGGCTCAGCAGCATATCACCGGTTGCCAG |
| R42Q | GTACCTTTTGCAATCTGGCTCTGCAGCATATCACCGGTTGCCAG |
| R42T | GTACCTTTTGCAATCTGGCTGGTCAGCATATCACCGGTTGCCAG |
| R42V | GTACCTITTGCAATCTGGCTAACCAGCATATCACCGMTGCCAG |
| Position | Forward Primer 2 |
| 91 | GGTTTTCCGCGTACCATTCC |
| 134 | CTGATTCATCCGGCAAGCG |
| 42 | AGCCAGATTGCAAAAGGTACAC |

Mutations are specified by original amino acid in its single letter abbreviation followed by the position and the final amino acid in its single letter abbreviation.

The PCR amplified pieces were inserted into the expression plasmid by Gibson assembly and transformed into T7 Express (New England Biolabs) cells for expression. The expression plasmid pET15b containing a T7 promoter, an 8×His-tag, and a stop codon was amplified by PCR using primers GGATCCGGCTGCTAACAAAGCC and ATGATGGTGATGGTGGTGATGATGAC so that there will be 20 bp overlap between each PCR piece, so that they will be properly assembled by Gibson assembly. In Gibson assembly, 1 ul of each PCR piece is combined into 10 ul final volume with 1× Gibson Assembly Master Mix (New England Biolabs) and incubated at 50° C. for 1 hour. The assembly reaction mixture was diluted 3× by adding 20 ul water. 3 ul of the diluted mixture was transformed into 30 ul T7 Express (New England Biolabs) cells. Single colonies were picked and plasmids extracted and sequence confirmed before moving on to expression studies.

Expression and Purification of Mutant Proteins.

Single colonies were used to inoculate a 2 mL deep well block with 1 mL of LB medium with 100 mg/L carbenicillin in each well. Cultures were shaken at 37° C. and 900 rpm overnight in a deep well block shaker. The deep well block was used to inoculate another deep well block with 1 mL of BioSilta EnBase medium with 600mU/L glucoamylase to an OD600 of 0.1. Cultures were shaken for 16 hours at 37° C. and 900 rpm, at which point 1 mM IPTG was added to induce the cultures, and additional Enbase supplemental media and another 600mU/L of glucoamylase was added to supplement the cultures. Expression was carried out for another 6 hours at 37° C. and 900 rpm. Cultures were harvested by spinning the deep well block at 3,000×g for 10 minutes at RT. After centrifugation, the supernatant was carefully removed the cell pellets were frozen at −20° C. Frozen cell pellets were thawed and 0.3 g of 0.1 mm zirconium beads were added to each sample followed by 0.5 ml of PBS. The cells were lysed in the cold room (4° C.) by bead-beating for 5 min in a Qiagen TissuelyserII (Qiagen, Hilden, Germany) equipped with a 96-well plate adapter. Cell lysates were centrifuged at 3000 rpm for 10 min and the supernatant was removed, sampled, and analyzed for protein concentration by chip electrophoresis. Samples were prepared by adding 2 µl of sample to 7 µl sample buffer, heating at 95 C for 5 minutes, and then adding 35 µl of water. Analysis was completed using HT Low MW Protein Express LabChip® Kit or HT Protein Express LabChip® Kit (following the manufacturer's protocol). A protein ladder ran every 12 samples for molecular weight determination (kDa) and quantification (ng/µl).

The mutant proteins were purified using the His Multitrap HP (GE Healthcare) system according to manufacturer's protocol. The concentrations of the proteins were measured by SDS-PAGE stained by Coomasie Blue and absorbance at 280 nm. The proteins were diluted in 40 mM Tris buffer for kinase activity assay.

Determination of the Kinase Activity of SEQID-00338.

The ADP-Glo™ Max Assay was obtained from Promega (Catalog number V7001, Madison, Wis.). Adenosine Mono-phosphate was obtained from Sigma-Aldrich (Catalog number A1752, St. Louis, Mo.). 5× Kinase Buffer was prepared w/ 1.211 g Tris Base (Catalog number BP152-2, Fisher Bioreagents, Pittsburgh, Pa.), 692 µL 12% hydrochloric acid solution (Catalog number BDH3026-500MLP, VWR, Radnor, Pa.), 10.0 mL 500 mM magnesium chloride (Catalog number BP214-500, Fisher Bioreagents, Pittsburgh, Pa.) and the volume brought to 50 mL with MilliQ water and filtered through 0.22 µm PES filter (Catalog number SCGP00525, Millipore, Billerica, Mass.) into a sterile 50 mL tube.

Twelve his-tag purified mutant proteins and the wild-type protein at 35 µg/mL in Tris buffer were serially diluted to 7.0 and 1.4 µg/mL. Prepared kinase reaction mix at 0.5 mM AMP/0.5 mM ATP to test for activity and at 0 mM AMP/0 mM ATP to assay background activity by diluting 5× Kinase Buffer with appropriate volumes of 10 mM AMP and 10 mM ATP in MilliQ water. Duplicate reactions were prepared by mixing 9 µL of the reaction mixture with 6 µL of diluted SEQID-00338, mixing by pipetting up and down and dispensing 5 µL into a 384-well white OptiPlate (PerkinElmer, Waltham, Mass.). An ADP standard curve was prepared by serially diluting 4 mM ADP in MilliQ water and adding kinase buffer to 1× for a standard at 0.0005, 0.001, 0.005, 0.01, 0.05, 0.1, 0.5, 1, 2, 3, and 4 mM ADP. The plate was covered with a foil plate seal and incubated at 30° C. for 30 min. Following the kinase reaction, 5 µL of ADP-Glo™ Reagent was added to each well. The plate was sealed with a foil plate seal and placed on a horizontal plate shaker at 450 rpm for 2 minutes at room temperature. The plate was removed from the plate shaker and incubated at room temperature for 40 minutes. The plate was then centrifuged for 15 seconds at 1109×ref and 10 µL of ADP-Glo™ Max Detection Reagent was added. The plate was sealed with a foil plate seal and shaken on a horizontal plate shaker at 450 rpm at room temperature for 2 minutes. The plate was then removed from the plate shaker and incubated at room temperature for 60 minutes. The plate was centrifuged for 15 seconds at 1109×ref and the luminescence read on an EnspireAlpha plate reader (PerkinElmer, Waltham, Mass.).

The ADP standard curve was used to determine the concentration of ADP in sample wells in the presence or absence of substrate. Concentrations were determined by performing a non-linear 4 parameter logistic on the X=log (X) transformed ADP standard luminescence values. Background ADP was found to be below the limit of detection in most samples. Where the background concentration of ADP in the absence of substrate was calculable the average of those values were subtracted from the calculated ADP concentration in the substrate incubated wells. Activity knock out was calculated by percentage activity relative to purified wild-type protein at the same concentration.

Table E36B lists the average percent activity of variants relative to purified wild-type protein. All of the variants have decreased activity compared to the wild-type protein. Kinase variants exhibit differences in activity at 7 µg/mL.

TABLE E36B

The proportion activity was calculated as the percentage AMP + ATP→2ADP converted by SEQID-00338 at 7 µg/mL during a 30 minute reaction at 30° C.

| KINASE | AVG | SD | N |
|---|---|---|---|
| Wild-type | 100.0% | 11.2% | 2 |
| D91F | 0.9% | 0.60% | 2 |
| D91I | 0.4% | 0.20% | 2 |
| R134M | 0.3% | 0.09% | 2 |

TABLE E36B-continued

The proportion activity was calculated as the percentage AMP + ATP→2ADP converted by SEQID-00338 at 7 µg/mL during a 30 minute reaction at 30° C.

| KINASE | AVG | SD | N |
|---|---|---|---|
| R134Y | 0.2% | 0.08% | 2 |
| R42A | 0.9% | 0.08% | 2 |
| R42C | 1.8% | 0.14% | 2 |
| R42G | 1.2% | 0.06% | 2 |
| R42I | 1.5% | 0.07% | 2 |
| R42K | 2.2% | 0.14% | 2 |
| R42L | 1.7% | 0.08% | 2 |
| R42Q | 1.2% | 0.05% | 2 |
| R42T | 1.9% | 0.06% | 2 |

Example 37

Engineering of Secreted Polypeptide for Reduced Enzymatic Activity

A mutant protein was constructed to reduce the enzymatic activity of a nutritive polypeptide. The active sites of SEQID-00407 are predicted to be residues D217 and E249, which are acidic residues lying in the center of the catalytic domain. To produce a polypeptide free of enzymatic activity and enriched in amino acids important to nutrition and health, we mutated those two sites to disrupt the catalytic activity of SEQID-00407. D217 and E249 in SEQID-00407 may act as nucleophiles and proton donors or acceptors to form hydrogen bonds with their ligands.

To remove enzymatic activity from SEQID-00407, we engineered a protein with a single amino acid mutation at E249, changing it from glutamic acid to phenylalanine. The mutant was constructed by assembling two PCR fragments. The first contains the 5'-end of the enzyme up to 20 bp downstream of the mutation site. The second contains the 3'-end of the enzyme starting immediately after the mutation site. In the first PCR fragment, specific PCR primers were designed to bind the targeted mutation site and incorporate the desired mutant amino acid codon. The TTT codon was selected because it is the most highly used codon for phenylalanine in Bacillus subtilis. The two PCR fragments were assembled and inserted into the plasmid vector using Gibson Assembly method (NEB Gibson Assembly Master Mix) at 50° C. for 1 hour. The constructs were built in E. coli and confirmed by DNA sequencing before transforming into Bacillus subtilis for secretion and enzymatic activity assays.

Secretion of Nutritive Polypeptides from Bacillus subtilis.

Three separate colonies of B. subtilis expression strains were used to inoculate 1-ml of 2×L-Mal medium (20 g/l NaCl, 20 g/l tryptone, and 10 g/l yeast extract, 75 g/l maltose) with Cm5, in deep well blocks (96-square wells). Culture blocks were covered with porous adhesive plate seals and incubated overnight in a micro-expression chamber (Glas-Col, Terre Haute, Ind.) at 37° C. and 880 rpm. Overnight cultures were used to inoculate fresh, 2×L-Mal, Cm5 cultures, in deep well blocks, to a starting OD600=0.1. These expression cultures were incubated at 37° C., 880 rpm until the OD600=1.0 (approx. 4 hrs) at which time they were induced by adding isopropyl β-D-1-thiogalactopyranoside (IPTG) at a final concentration of 0.1 M and continuing incubation for 4 hrs. After 4 hrs, the cell densities of each culture was measured (OD600) and cells were harvested by centrifugation (3000 rpm, 10 min, RT). After centrifugation, culture supernatant was carefully removed and transferred to a new block and cell pellets were frozen at −80° C. To determine the levels of secreted protein, the supernatants were assayed to determine the levels of secreted protein of interest (POI) by chip electrophoresis. Briefly, samples were prepared by adding 2 µl of sample to 7 µl sample buffer, heating at 95 C for 5 minutes, and then adding 35 µl of water. Analysis was completed using HT Low MW Protein Express LabChip® Kit or HT Protein Express LabChip® Kit (following the manufacturer's protocol). A protein ladder ran every 12 samples for molecular weight determination (kDa) and quantification (ng/µl).

Amylase Activity Assay.

SEQID-00407 is an α-amylase in *Bacillus subtilis* that has the activity of breaking down polysaccharides, such as starch, into monosaccharides or disaccharides. To demonstrate that the specific mutants have removed enzymatic activity, *Bacillus subtilis* secreting the enzyme were plated onto agar plates containing starch. If there is enzymatic activity, the secreted enzyme will breakdown the starch and upon staining by iodine, there will be a halo surrounding the *Bacillus subtilis* colonies. 1% starch plates were made by combining 25 g Luria Broth-Miller, 10 g starch, 15 g bacteriological agar, and 1 L water. 10 mM IPTG was added to the starch plates after the agar has solidified. Single colonies of *Bacillus subtilis* strains expressing the mutant polypeptides were inoculated in 5 ml LB at 37° C. for 4 hours and 50 µl of the liquid culture were spotted at the center for the starch plates. After 20 hours of growth and induced secretion, 10% iodine was added to the starch plates to stain for starch. When the wild-type enzyme is secreted, it creates a large halo around the cells. However, when the engineered enzymes are secreted, the halo reduces in area, similar to the negative control strain, which expresses the empty vector without the enzyme. Table E37A quantifies the area of the halos relative to the area of the cells. It is shown that the difference in area between the halo and the cells is larger for the wild-type than engineered mutants. From the data shown, we demonstrated the engineering of secreted nutritive polypeptide with reduced enzymatic activity.

TABLE E37A

Quantified area of cells, halos, and their differences measured in in2.

| Protein | Cell Area (in$^2$) | Halo Area (in$^2$) | Halo/Cell |
|---|---|---|---|
| No protein control | 0.413 | 0.6 | 1.45 |
| Wild-type | 1.27 | 2.246 | 1.77 |
| E249F sample 1 | 0.331 | 0.496 | 1.50 |
| E249F sample 2 | 1.335 | 1.936 | 1.45 |

Example 38

Engineering of Nutritive Polypeptide Amino Acid Content to Modulate Polypeptide Activity and to Enrich Essential Amino Acid Content To demonstrate the engineering of secreted polypeptides for enriched amino acid content, we chose a microorganism known to secrete protein at high levels *Bacillus subtilis*. SEQID-00407 was identified a major secreted protein in *Bacillus subtilis*. Using sequence conservation and crystal structure data for SEQID-00407, we identified contiguous regions within each protein that were predicted to be tolerant to mutations without negatively affecting the structural stability of the protein and/or the ability of the host organism to secrete the protein.

We analyzed the secondary structure of SEQID-00407 reported in the structural protein databank entry IUA7. We identified 19 loop regions within the sequence of the protein that are not part of an α-helix or a β-sheet. These loop regions are defined by the following amino acid residues: 73-76, 130-133, 147-152, 157-161, 189-192, 222-227, 239-244, 283-286, 291-298, 305-308, 318-323, 336-340, 356-360, 365-368, 387-392, 417-421, 428-432, 437-442, and 464-466. Loop regions less than 4 amino acids in length were not considered for mutation.

Conservation of sequence over evolutionary space was also considered for identifying positions amenable for engineering while maintaining structural stability and secretion competency. Positions that are less conserved within a family of homologous sequences are inherently variable and likely more amenable to mutation without affecting activity, which is intrinsically tied to structure. To find positions that are less conserved, we downloaded the alignment of the pfam00128 from the NCBI Conserved Domain Database, which contains 31 protein sequences including the SEQID-00407 catalytic domain (Marchler-Bauer A., Zheng C., Chitsaz F., Derbyshire M. K., Geer L. Y., Geer R. C., Gonzales N. R., Gwadz M., Hurwitz D. I., Lanczycki C. J., Lu F., Lu S., Marchler G. H., Song J. S., Thanki N., Yamashita R. A., Zhang D., and S. H. Bryant. Nucleic Acids Res. (2013) 41:D348-52). We also performed a PSI-BLAST search of the NCBI protein reference sequence database (Pruitt K. D., Tatusova T., and D. R. Maglott. Nucleic Acids Res. (2005) 33:D501-504) using SEQID-00407 and obtained 500 sequences homologous to SEQID-00407. In both cases, a single iteration was performed using the BLOSUM62 position specific scoring matrix, a gap penalty of −11, a gap extension penalty of −1, and an alignment inclusion e-value cutoff of 0.005 (Altschul S. F., Nucleic Acids Res. (1997) 25:3389-3402). All protein sequence alignments were used to generate position-specific scoring matrices (PSSM) specific to each query sequence as part of the PSI-BLAST search. From the PSSMs, we identified regions predicted to be tolerant to mutation by counting the number of different amino acids associated with a positive PSSM score at each position within each loop as well as the sum and average of the PSSM scores for essential amino acid substitutions at each position Furthermore, from the multiple sequence alignments obtained from each PSI-BLAST search, we calculated the amino acid entropy at each position, as defined by $S_j = \Sigma_{i \in AA} p_i \ln p_i$, where Sj is the entropy at position j and pi is the probability of observing amino acid i at position j.

Using these measures of mutation tolerance, we identified four loop regions expected to be tolerant to mutations into essential amino acids. To enrich the identified regions in essential amino acids we used a combinatorial codon library where any selected position could be either a F, I, L, V, or M (denoted Z) or a R, K, T, I, or M (denoted X). In each of the loop regions selected for mutation into an essential amino acid, each variable position was assigned as a Z or X depending upon its relative tolerance of hydrophobic residues (based upon their respective PSSM values). Positions that were tolerant of hydrophobic residues were assigned as Z and genetically encoded using the codon NTN. Positions more tolerant of hydrophilic residue were assigned as an X and genetically encoded using the codon ANR. We note that in one of the identified variable regions of SEQID-00407 (147-153), a glycine residue was inserted into the center of the loop in an attempt to enhance the conformational flexibility of this region. For SEQID-00407 the sequences of the identified regions are summarized in Table E38A.

TABLE E38A

| Start residue # | original | degenerate |
|---|---|---|
| 148 | YAAI | XXGXX |
| 240 | NTSA | ZXXZ |
| 291 | SHYASD | XZYXXZ |
| 389 | QPEE | XPZZ |

X = NTN, codes for F, L, I, M, V
Z = ANR, codes for I, M, T, K, R

Library Design and Construction.

Based on identification of variable regions, we designed primers that can amplify each variable region as explained herein. For example if there are four variable regions, we need four pair of primers to generate four variable fragments. In step 1 we used pES1205 as the template which contains SEQID-00407 fused with N-terminal AmyQ signal peptide and downstream of pGrac promoter. pES1205 is a derivative of the vector, pHT43 (MoBiTec), containing a 1905-bp DNA fragment encoding the amyE gene from *B. subtilis* (minus the initial 93-bp encoding the AmyE signal peptide) plus a C-terminal 1×FLAG tag. The amyE::1×FL:AG sequence is cloned, in-frame with the SamyQ sequence encoded on pHT43. For fragment 1, 2, 3, 4, the forward PRIMERID-45053, PRIMERID-45054, PRIMERID-45055, and PRIMERID-45056 contain 25 bases of constant sequence before the variable region followed by degenerate sequences to represent the variable region and 25 bases of constant sequence downstream of the variable region. For fragment 1, 2, 3, the reverse primers PRIMERID-45061, PRIMERID-45062, and PRIMERID-45063 contain 25 bases of reverse complementary sequence upstream of next variable region respectively. For fragment 4, the reverse primer PRIMERID-45064 contains 25 bases of reverse complementary sequence at an arbitrary distance from variable region 4. Four separate PCR amplifications were run using Phusion DNA polymerase (New England Biolabs, Beverly, Mass.) and reaction parameters recommended by the manufacturer. As separate reactions, four wild type fragments, WT-frag-1, WT-frag-2, WT-frag-3 and WT-frag-4 were generated using PES1205 as template and primer pairs PRIMERID-45057 & PRIMERID-45061, PRIMERID-45058 & PRIMERID-45062, PRIMERID-45059 &. PRIMERID-45063, and PRIMERID-45060 & PRIMERID-45064, respectively. All PCR fragments were gel purified. In step 2, two separate PCR reactions were set. The first PCR reaction contain fragment 1 and 2 in equimolar ratio as template and PRIMERID-45057 and PRIMER ID-45062 as primers. The second PCR reaction contain fragment 3 and 4 in equimolar ratio and PRIMERID-45059 and PRIMERID-45064 as primers. In both the reactions, respective wild type fragments were added in a molar ratio of library members present in each variable fragments. Fragment 5 and 6 are gel purified and used as templates in equimolar ratio in step 3. The primers used in the PCR reaction include PRIMERID-45057 and PRIMERID-45064. The vector PCR product was generated using pES1205 and primer pairs, PRIMERID-45065 and PRIMERID-45066. Both fragment 7 and vector PCR product were gel purified and cloned together using the Gibson Assembly Master Mix (New England Biolabs, Beverly, Mass.) and transformed into the cloning host *E. coli* Turbo (New England Biolabs) according to manufacturer's instructions. 50 colonies were sequenced to determine the diversity of the library. The colonies on the agar plate were then suspended in LB media and harvested for plasmid purification. In a similar fashion, we generated 9 specific variants of SEQID-00407 which were altered with 9 specific amino acids, F, L, I, M, V, T, K, R, W at every variable position identified in the mutant design. Specific variant primers are denoted by the single letter amino acid abbreviation in the name. All primers are listed in Table E38B.

TABLE E38B

| Primer sequence |
|---|
| GGTCATCAATCATACCACCAGTGATNTNNTNGGCNTNNTNTCCAATGAGGTTAAGAGTATTCCAAACTGG |
| CAGTCAATTTTGGCCGAATATCACAANRNTNNTNANRGAGTTCCAATACGGAGAAATCCTGC |
| TCGTAATCTGGGCGTGTCGAATATCNTNANRTATNTNNTNANRGTGTCTGCGGACAAGCTAGTGAC |
| GATTTCACAATGTGATGGCTGGANTNCCTANRANRCTCTCGAACCCGAATGGAAAC |
| GGTCATCAATCATACCACCAGTG |
| CAGTCAATTTTGGCCGAATATCAC |
| TCGTAATCTGGGCGTGTCG |
| GATTTCACAATGTGATGGCTGG |
| TGTGATATTCGGCCAAAATTGACTG |
| GATATTCGACACGCCCAGATTACG |
| TCCAGCCATCACATTGTGAAATC |
| ATCTGCACGCAAGGTAATCGTCAG |
| CTGACGATTACCTTGCGTGCAG |
| CACTGGTGGTATGATTGATGACC |
| GGTCATCAATCATACCACCAGTGATCTTCTGGGCCTTCTGTCCAATGAGGTTAAGAGTATTCCAAACTGG |

TABLE E38B-continued

| Primer sequence |
|---|
| GGTCATCAATCATACCACCAGTGATATTATCGGCATTATCTCCAATGAGGTTAAGAGTATTCCAAACTGG |
| GGTCATCAATCATACCACCAGTGATGTTGTGGGCGTTGTGTCCAATGAGGTTAAGAGTATTCCAAACTGG |
| GGTCATCAATCATACCACCAGTGATTTTTTCGGCTTTTTCTCCAATGAGGTTAAGAGTATTCCAAACTGG |
| GGTCATCAATCATACCACCAGTGATTGGTGGGATGGTGGTCCAATGAGGTTAAGAGTATTCCAAACTGG |
| GGTCATCAATCATACCACCAGTGATATGATGGGCATGATGTCCAATGAGGTTAAGAGTATTCCAAACTGG |
| GGTCATCAATCATACCACCAGTGATACAACGGGCACAACGTCCAATGAGGTTAAGAGTATTCCAAACTGG |
| GGTCATCAATCATACCACCAGTGATTATAAGAAAGGCAAGAAAAATGAGGTTAAGAGTATTCCAAACTGG |
| GGTCATCAATCATACCACCAGTGATTATCATCATGGCCATCACAATGAGGTTAAGAGTATTCCAAACTGG |
| CAGTCAATTTTGGCCGAATATCACAAAGCTTCTGGGCGAGTTCCAATACGGAGAAATCCTGC |
| CAGTCAATTTTGGCCGAATATCACAAAGATTATCGGCGAGTTCCAATACGGAGAAATCCTGC |
| CAGTCAATTTTGGCCGAATATCACAAAGGTTGTGGGCGAGTTCCAATACGGAGAAATCCTGC |
| CAGTCAATTTTGGCCGAATATCACAAAGTTCTTTGGCGAGTTCCAATACGGAGAAATCCTGC |
| CAGTCAATTTTGGCCGAATATCACAAAGTGGTGGGGCGAGTTCCAATACGGAGAAATCCTGC |
| CAGTCAATTTTGGCCGAATATCACAAAGATGATGGGCGAGTTCCAATACCGAGAAATCCTGC |
| CAGTCAATTTTGGCCGAATATCACAAAGACGACAGGCGAGTTCCAATACGGAGAAATCCTGC |
| CAGTCAATTTTGGCCGAATATCACAAAGAAAGGAGCAGAGTTCCAATACGGAGAAATCCTGC |
| CAGTCAATTTTGGCCGAATATCACACATCATGGAGCAGAGTTCCAATACGGAGAAATCCTGC |
| TCGTAATCTGGGCGTGTCGAATATCCTTCACTATCTTCTGGATGTGTCTGCGGACAAGCTAGTGAC |
| TCGTAATCTGGGCGTGTCGAATATCATTCACTATATCATTGATGTGTCTGCGGACAAGCTAGTGAC |
| TCGTAATCTGGGCGTGTCGAATATCGTTCACTATGTTGTGGATGTGTCTGCGGACAAGCTAGTGAC |
| TCGTAATCTGGGCGTGTCGAATATCTTCCACTATTTCTTTGATGTGTCTGCGGACAAGCTAGTGAC |
| TCGTAATCTGGGCGTGTCGAATATCTGGCACTATTGGTGGGATGTGTCTGCGGACAAGCTAGTGAC |
| TCGTAATCTGGGCGTGTCGAATATCATGCACTATATGATGGATGTGTCTGCGGACAAGCTAGTGAC |
| TCGTAATCTGGGCGTGTCGAATATCACACACTATACAACGGATGTGTCTGCGGACAAGCTAGTGAC |
| TCGTAATCTGGGCGTGTCGAATATCTCCAAGTATAAAGCAAAGGTGTCTGCGGACAAGCTAGTGAC |
| TCGTAATCTGGGCGTGTCGAATATCTCCCATTATCACGCACATGTGTCTGCGGACAAGCTAGTGAC |
| GATTTCACAATGTGATGGCTGGACTTCCTGAGGAACTCTCGAACCCGAATGGAAAC |
| GATTTCACAATGTGATGGCTGGAATTCCTGAGGAACTCTCGAACCCGAATGGAAAC |
| GATTTCACAATGTGATGGCTGGAGTTCCTGAGGAACTCTCGAACCCGAATGGAAAC |
| GATTTCACAATGTGATGGCTGGATTCCCTGAGGAACTCTCGAACCCGAATGGAAAC |
| GATTTCACAATGTGATGGCTGGATGGCCTGAGGAACTCTCGAACCCGAATGGAAAC |
| GATTTCACAATGTGATGGCTGGAATGCCTGAGGAACTCTCGAACCCGAATGGAAAC |
| GATTTCACAATGTGATGGCTGGAACACCTGAGGAACTCTCGAACCCGAATGGAAAC |
| GATTTCACAATGTGATGGCTGGAAAGCCTGAGGAACTCTCGAACCCGAATGGAAAC |
| GATTTCACAATGTGATGGCTGGACATCCTGAGGAACTCTCGAACCCGAATGGAAAC |

Bacillus subtilis Strain Construction.

B. subtilis strain WB800N (MoBiTec, Göttingen, Germany) and used as the expression host. WB800N is a derivative of a well-studied strain (B. subtilis 168) and it has been engineered to reduce protease degradation of secreted proteins by deletion of genes encoding 8 extracellular proteases (nprE, aprE, epr, bpr, mpr, nprB, vpr and wprA). B. subtilis transformations were performed according to the manufacturer's instructions. Approximately 5 µg of library for SEQID-00407 variant constructs was transformed into WB800N and single colonies were selected at 37° C. by plating on LB agar containing 5.0 µg/ml chloramphenicol (Cm5). For 9 specific variants, 1 µg of specific SEQID-00407 variant was transformed into WB800N and single colonies were selected at 37° C. by plating on LB agar containing 5.0 µg/mIchloramphenicol (Cm5).

Bacillus subtilis Library Screening.

800 individual transformants of the B. subtilis SEQID-00407 library were used to inoculate individual, 1-ml cultures of 2×-MAL medium (20 g/l NaCl, 20 g/l tryptone, and 10 W1 yeast extract, 75 g/l maltose) with Cm5, in deep well blocks (96-square wells). In addition to the library strains, a strain containing plasmid with AmyE and the SamyQ leader peptide was inoculated as a positive control and a strain containing plasmid with no gene of interest was inoculated as negative control. Culture blocks were covered with porous adhesive plate seals and incubated overnight in a micro-expression chamber (Glas-Col, Terre Haute, Ind.) at 37° C. and 880 rpm. Overnight cultures were used to inoculate fresh, 2×-MAL, Cm5 cultures, in deep well blocks, to a starting OD600=0.1.

Expression cultures were incubated at 37° C., 880 rpm until the OD600=1.0 (approx. 4 hrs) at which time they were induced by adding isopropyl β-D-1-thiogalactopyranoside (IPTG) at a final concentration of 1 mM and continuing incubation for 4 hrs. After 4 hrs, the cell densities of each culture was measured (OD600) and cells were harvested by centrifugation (3000 rpm, 10 min, RT). After centrifugation, culture supernatant was carefully removed and transferred to a new block and cell pellets were frozen at −80° C. To determine the levels of secreted protein, 0.5-ml aliquots of the culture supernatants were filtered first through a 0.45-µm filter followed by a 0.22 µm filter. The filtrates were then assayed to determine the levels of secreted protein of interest (POI) by chip electrophoresis system and compared with the level of secretion of base construct. Briefly, samples were prepared by adding 2 µl of sample to 7 µl sample buffer, heating at 95 C for 5 minutes, and then adding 35 µl of water. Analysis was completed using HT Low MW Protein Express LabChip® Kit or HT Protein Express LabChip® Kit (following the manufacturer's protocol). A protein ladder ran every 12 samples for molecular weight determination (kDa) and quantification (ng/µl).

SEQID-00690 and SEQID-00702 were confirmed by LC/MS/MS of the gel band of interest. Selected hits were mixed with Invitrogen LDS Sample Buffer containing 5% β-mercaptoethanol, boiled and loaded on a Novex® NuPAGE® 10% Bis-Tris gel (Life Technologies). After running, the gels were stained using SimplyBlue™ SafeStain (Life Technologies) and desired bands were excised and submitted for analysis. Gel bands were washed, reduced and alkylated, and then digested with Trypsin for 4 hours followed by quenching with formic acid. Digests were then analyzed by nano LC/MS/MS with a Waters NanoAcquity HPLC system interfaced to a ThermoFisher Q Exactive. Peptides were loaded on a trapping column and eluted over a 75 µm analytical column at 350 nL/min; both columns were packed with Jupiter Proteo resin (Phenomenex). The mass spectrometer was operated in data-dependent mode, with MS and MS/MS performed in the Orbitrap at 70,000 FWHM resolution and 17,500 FWHM resolution, respectively. The fifteen most abundant ions were selected for MS/MS. The resulting peptide data were searched using Mascot against the relevant host database with relevant variant protein sequence appended.

Diluted overnight cultures were used as inoculum for LB broth cultures containing Cm5. These cultures were grown at 37 C until they reached log phase. Aliquots of these cultures were mixed with glycerol (20% final concentration) and frozen at −80° C. The top 30 hits are then purified using Instagene matrix (Biorad, USA) and amplified using CTT-GAAATTGGAAGGGAGATTC and GTATAAACTTTTCAGTTGCAGAC, and sequenced using the same primers to identify the SEQID-00407 variant sequence.

Bacillus subtilis Secretion Library Analysis.

All the secreted variants of SEQID-00407 (SEQIDs 45002-45028) were analyzed to determine if there were any position specific biases in the amino acids present in the secreted variants, relative to the expected position specific biases present in the initial genetic library. To this end, an exact binomial test was performed for each amino acid at each position to determine the likelihood that the observed number of each amino acid was significantly ($p<0.05$) more or less than expected by chance. Table E38C shows the p-values of this single tailed test, where those highlighted elements have p values <0.05. Note that aside from wild type values, which were all significantly higher than expected, all other significant different amino acid frequencies were less than expected. The expected position specific amino acid biases are shown in Table E38D, and were found by sequencing 47 randomly selected variants after the library had been constructed and transformed into E. coli. It was assumed that all positions designed to be an X effectively sampled from the same distribution of L, I, V, F, and M codons (i.e., for all X positions, there were no position specific amino acid biases). As such, the observed counts of each amino acid were aggregated across positions to determine the expected amino acid likelihoods for all X positions. A similar assumption was made for all positions designed to be a Z. As can be seen in Table E38C, in addition to the strong bias toward the wild type sequence at each position, there are a number of different amino acids that were observed significantly less than expected, indicating a bias away from those amino acids at that position in the secreted library. This data provides additional information for the design of specific, rationally designed variants with specific mutations at each position. As an example, to enrich a secreted variant in leucine, positions 241 and 291 may be less desired choices. Alternatively, to enrich a secreted variant in valine, positions 149, 241, 242, 291, 294, 295, and 389 may be less desired choices.

TABLE E38C

Single tailed binomial test p-values assessing position specific amino acid biases in secreted variants of SEQID-450001

| Position | 148 | 149 | 150 | 151 | 240 | 241 | 242 | 243 | 291 |
|---|---|---|---|---|---|---|---|---|---|
| L | 0.40 | 0.25 | 0.07 | 0.25 | — | 7.8E+05 | 0.22 | — | 0.03 |
| I | 0.14 | 0.43 | 0.15 | 0.03 | 0.48 | 0.19 | 0.42 | 0.06 | 0.17 |
| V | 0.45 | 0.04 | 0.35 | 0.18 | — | 0.04 | 9.2E−03 | — | 1.4E−03 |
| F | 0.15 | 0.55 | 0.09 | 0.55 | — | 0.32 | 0.51 | — | 0.51 |
| M | 0.20 | 0.20 | 0.22 | 0.56 | 0.03 | 0.11 | 0.26 | 0.25 | 0.51 |

TABLE E38C-continued

Single tailed binomial test p-values assessing position specific amino acid biases in secreted variants of SEQID-450001

| | | | | | | | | | |
|---|---|---|---|---|---|---|---|---|---|
| T | — | — | — | — | 0.22 | — | — | 0.22 | — |
| K | — | — | — | — | 0.42 | — | — | 4.0E-03 | — |
| R | — | — | — | — | 2.5E+03 | — | — | 0.03 | — |
| wt | 3.4E-07 | 3.4E-07 | 3.1E-06 | 3.4E-07 | 2.1E-13 | 1.5E-14 | 1.2E-11 | 4.4E-12 | 2.9E-14 |

| Position | 292 | 294 | 295 | 296 | 389 | 391 | 392 |
|---|---|---|---|---|---|---|---|
| L | — | 0.07 | 0.19 | — | 0.21 | — | — |
| I | 0.29 | 0.36 | 0.17 | 0.03 | 0.31 | 0.21 | 0.43 |
| V | — | 0.05 | 0.02 | — | 0.03 | — | — |
| F | — | 0.16 | 0.51 | — | 0.43 | — | — |
| M | 0.17 | 0.22 | 0.24 | 0.04 | 0.04 | 0.48 | 0.10 |
| T | 0.04 | — | — | 0.30 | — | 0.08 | 0.07 |
| K | 0.05 | — | — | 0.32 | — | 0.39 | 0.54 |
| R | 0.42 | — | — | 0.14 | — | 3.8E+05 | 1.3E+03 |
| wt | 2.0E-10 | 6.0E-14 | 2.3E-11 | 2.0E-10 | 2.3E-13 | 4.5E-13 | 4.6E-14 |

TABLE E38D

Position specific, expected amino acid likelihoods in the constructed SEQID-450001 library

| | X | Z |
|---|---|---|
| L | 30.2% | — |
| I | 12.3% | 9.7% |
| V | 36.4% | — |
| F | 6.7% | — |
| M | 10.7% | 12.2% |
| T | — | 18.3% |
| K | — | 17.9% |
| R | — | 36.2% |
| Wt | 3.7% | 5.7% |

*Bacillus subtilis* Expression Testing of Specific Variants.

Three separate colonies of *B. subtilis* expression strains were used to inoculate 1-ml of 2×-MAL medium (20 g/l NaCl, 20 g/l tryptone, and 10 g/l yeast extract, 75 g/l maltose) with Cm5, in deep well blocks (96-square wells). Culture blocks were covered with porous adhesive plate seals and incubated overnight in a micro-expression chamber (Glas-Col, Terre Haute, Ind.) at 37° C. and 880 rpm. Overnight cultures were used to inoculate fresh, 2×-MAL, Cm5 cultures, in deep well blocks, to a starting OD600=0.1. These expression cultures were incubated at 37° C., 880 rpm until the OD600=1.0 (approx. 4 hrs) at which time they were induced by adding isopropyl β-D-1-thiogalactopyranoside (IPTG) at a final concentration of 0.1 M and continuing incubation for 4 hrs. After 4 hrs, the cell densities of each culture was measured (OD600) and cells were harvested by centrifugation (3000 rpm, 10 min, RT). After centrifugation, culture supernatant was carefully removed and transferred to a new block and cell pellets were frozen at −80° C. To determine the levels of secreted protein, 0.5-ml aliquots of the culture supernatants were filtered first through a 0.45-µm filter followed by a 0.22 µm filter. The filtrates were then assayed to determine the levels of secreted protein of interest (POI) by chip electrophoresis. Briefly, samples were prepared by adding 2 µl of sample to 7 µl sample buffer, heating at 95 C for 5 minutes, and then adding 35 µl of water. Analysis was completed using HT Low MW Protein Express LabChip® Kit or HT Protein Express LabChip® Kit (following the manufacturer's protocol). A protein ladder ran every 12 samples for molecular weight determination (kDa) and quantification (ng/µl).

SEQID-45025, SEQID-45026, SEQID-45027, and SEQID-45028 were confirmed by LC/MS/MS of the gel band of interest. Selected hits were mixed with Invitrogen LDS Sample Buffer containing 5% β-mercaptoethanol, boiled and loaded on a Novex® NuPAGE® 10% Bis-Tris gel (Life Technologies). After running, the gels were stained using SimplyBlue™ SafeStain (Life Technologies) and desired bands were excised and submitted for analysis. Gel bands were washed, reduced and alkylated, and then digested with Trypsin for 4 hours followed by quenching with formic acid. Digests were then analyzed by nano LC/MS/MS with a Waters NanoAcquity HPLC system interfaced to a ThermoFisher Q Exactive. Peptides were loaded on a trapping column and eluted over a 75 µm analytical column at 350 nL/min; both columns were packed with Jupiter Proteo resin (Phenomenex). The mass spectrometer was operated in data-dependent mode, with MS and MS/MS performed in the Orbitrap at 70,000 FWHM resolution and 17,500 FWHM resolution, respectively. The fifteen most abundant ions were selected for MS/MS. The resulting peptide data were searched using Mascot against the relevant host database with relevant variant protein sequence appended.

Amylase Activity Assay for Engineered Polypeptides.

One of the engineered polypeptides were tested to demonstrate enzymatic activity. SEQID-00407 is an α-amylase in *Bacillus subtilis* that has the activity of breaking down polysaccharides, such as starch, into monosaccharides or disaccharides. To demonstrate that the SEQID-00690 has retained enzymatic activity, *Bacillus subtilis* secreting the enzyme were plated onto agar plates containing starch. If there is enzymatic activity, the secreted enzyme will breakdown the starch and upon staining by iodine, there will be a halo surrounding the *Bacillus subtilis* colonies. 1% starch plates were made by combining 25 g Luria Broth-Miller, 10 g starch, 15 g bacteriological agar, and 1 L water. 10 mM IPTG was added to the starch plates after the agar has solidified. Single colonies of *Bacillus subtilis* strains expressing the mutant polypeptides were inoculated in 5 ml LB at 37° C. for 4 hours and 50 µl of the liquid culture were spotted at the center for the starch plates. After 20 hours of growth and induced secretion, 10% iodine was added to the starch plates to stain for starch. When SEQID-00690 was plated on the starch plates, the enzyme is secreted abd creates a large halo around the cells, similar to wild-type strain, and much larger than the negative control strain, which expresses the empty vector without the enzyme. Table E38E quantifies the area of the halos relative to the area of the cells. From the data shown, we demonstrated the engineering of secreted nutritive polypeptide enriched in essential amino acids which retains enzymatic activity.

TABLE E38E

Quantified area of cells, halos, and their differences measured in in2.

| Protein | Cell Area (in²) | Halo Area (in²) | Halo/Cell |
|---|---|---|---|
| No protein control | 0.413 | 0.600 | 1.45 |
| Wild-type | 1.270 | 2.246 | 1.77 |
| SEQID-00690 | 0.469 | 1.234 | 2.63 |

Example 39

Determination of Muscle Protein Fractional Synthesis Rate in Human Subjects Following Oral Consumption of Leucine-Enriched Nutritive Polypeptides Oral ingestion of leucine or leucine-containing proteins stimulates muscle protein synthesis (Layman & Walker, 2006, The Journal of nutrition: 136: 319-323). Many of the leucine-enriched nutritive polypeptides described herein are highly water soluble and readily digested and absorbed in human subjects. The pharmacokinetics of amino acids as delivered via nutritive polypeptides and their effect on muscle protein synthesis are described here.

Effects of the leucine-enriched nutritive polypeptides on muscle protein synthesis were measured in apparently healthy subjects. Twelve (12) apparently healthy subjects (average height: 1.7 m, weight: 78.5 kg, age: 56.2, and BMI: 26.8) between the ages of 50 and 70 were randomly assigned in a single-blinded manner to a sequence of treatments. One group of six received formulations of SEQID-105 and 90% whey protein isolate (WPI) control, and the other group received SEQID-363 and 90% whey protein isolate control. The treatments were staggered such that each individual received 35 grams of each nutritive polypeptide formulation on separate days (2-3 days apart) to allow for washout of the initial formulation. Each subject served as their own control in the within-subject cross-over comparison.

Subjects were excluded from the study if they met any of the following exclusion criteria: History of diabetes. History of malignancy in the previous 6 months. Prior gastrointestinal bypass surgery (Lapband, etc.). Chronic inflammatory condition or disease (Lupus, HIV/AIDS, etc.). Known sensitivity or allergy to whey protein, mold spores or fungi. Do not refrain from eating animal proteins during their participation in this study. Cannot refrain from consuming protein or amino acid supplements during their participation in this study. Cannot refrain from resistance training during the study period. Currently participating in another research study with an investigational product. Hemoglobin less than 9.5 mg/dl at the screening visit. Concomitant use of corticosteroids or testosterone replacement therapy (ingestion, injection, or transdermal). Any other diseases or conditions that would place the subject at increased risk of harm if they were to participate, at the discretion of the medical staff.

All subjects were asked to maintain their current dietary habits, maintain their activities of daily living, and to not participate in any resistance exercise during the study.

The anabolic effect of each nutritive formulation was measured using the fractional rate of muscle protein synthesis (FSR) (Smith, Villareal, & Mittendorfer, 2007, American journal of physiology—Endocrinology and metabolism: 293: E666E671). Research procedures included venous blood draws and vastus lateralis muscle biopsies during a primed, constant infusion of L-[ring-d5]-phenylalanine (Cambridge Isotope Laboratories, Tewksbury, Mass.). The fractional rate of muscle protein synthesis (FSR) was measured by muscle biopsies during a primed, constant infusion of L-[ring-d5]-phenylalanine. Specifically, the fractional rate of muscle protein synthesis (FSR) was measured in fasted human subjects after an overnight fast (>8 hrs) using the stable isotope tracer incorporation technique from vastus lateralis muscle biopsies performed 2, 4, and 7 hrs after initiating stable isotope tracer infusion. Blood samples were also collected at specified time points after the beginning of stable isotope tracer infusion (i.e. 2, 3, 4, 4+30, 5, 5+30, 6, 6+30, and 7 hrs) to assess changes in amino acid concentrations.

For each subject, on the morning of the study and after an overnight fast (8 hrs), an 18-22 gauge polyethylene catheter was inserted into each arm. One catheter was inserted into a distal vein for heated blood sampling to obtain a background blood sample (5 ml), and another into the forearm for infusion of the stable isotope tracers. After insertion of peripheral catheters, a primed (5.04 µmol/kg), constant (0.084 µmol/kg/min) infusion of the stable isotope (GRAS substance) ring-d5-phenylalanine was started. Stable isotopes were obtained from Cambridge Isotope Laboratories (Tewksbury, Mass.) and were tested for sterility and pyrogenicity (by CIL and the preparing pharmacy—PharmaCare). Prior to infusion, the tracer was reconstituted with sterile saline. The stable isotope was filtered during infusion through a sterile 0.22 micron (Millipore) filter placed in the infusion line.

Blood samples (5 ml) were collected in serum separator tubes at specified time points after the beginning of isotope infusion (2, 3, 4, 4+30, 5, 5+30, 6, 6+30, and 7 hrs). About 60 ml of blood was drawn during the entire study, and this volume was replaced with saline infused with a stable isotope tracer.

Muscle biopsies from the vastus lateralis were performed at 2, 4; and 7 hrs of tracer infusion. After the biopsy at 4 hr, the nutritive protein formulation was administered orally. All muscle biopsies were performed under local anesthesia (using sterile 1% lidocaine, without epinephrine) for normal pain management and strict sterile procedures. Prior to each muscle biopsy, skin was cleaned using a sterile skin preparation kit Betadine), and the skin and tissue below was injected with local anesthetic (Lidocaine) to minimize pain.

Through a small incision (about 1 cm), a 5 mm Bergstrom needle "O" was advanced into the muscle and suction applied. A piece of the muscle was then removed with the needle (approximately 50-100 mg). The skin was then cleansed, edges approximated with ¼ inch×1.5 inch adhesive Steri-strips, and a transparent, breathable film dressing (Tegaderm) was applied to the site. Firm pressure was maintained until bleeding at the site ceased. To minimize the risk of infection and bruising, an antibiotic ointment and pressure dressing (with self-adhesive elastic bandage) was applied, respectively, by the medical staff before the subject was released.

FSR, measured in (%/hr), was calculated as follows:

$$FSR = \left[\frac{Ep_2 - Ep_1}{E_m}\right] * \frac{1}{t} * 60 * 100,$$

where enrichments (EP1, EP2, and Em) are expressed as mole percent excess (MPE) and calculated as the ratio of labeled phenylalanine tracer to unlabeled phenylalanine tracee (TTR), once the tracer concentration has plateaued. EP1 and EP2 are the enrichments of bound ring-2H5-phenylalanine in the first and second biopsies (or second and third), respectively, and Em is the mean value of the enrichments of ring-2H5-phenylalanine in the intracellular pool. "t" is the time in minutes elapsed between 1st and 2nd muscle biopsy in min (or between the second and third). Constant conversion factors of 60 min/hr and 100 were used to express FSR in percent per hour. Outcome variables (muscle protein synthesis and blood amino acid concentrations) were analyzed via paired t-tests. Statistical significance was established a priori at P<0.05 and trends were accepted as 0.051<P<0.10.

Tables E39A-C show the calculated FSR data for each subject before and after an acute, oral dose of each nutritive protein formulation, and FIG. 56 shows the change in average FSR. The data shown is the mean+/− standard error of the mean. Note that the fasted FSR value from subject 3 in the WPI group had a very elevated FSR, inconsistent with normal fasted values, with a z-value of 2.85. A two-tailed grubbs' outlier test indicated that it was a significant (p<0.05) outlier and it was removed when calculating the mean and standard error as shown in FIG. 56.

TABLE E39A

| | WPI FSR (hr$^{-1}$) | |
|---|---|---|
| Subject ID | Fasted | Fed |
| 1 | 0.00023651 | 0.00072108 |
| 2 | 0.00041336 | 0.00037967 |
| 3 | 0.00168551 | 0.00022099 |
| 4 | 0.00032137 | 0.00112458 |
| 5 | 0.00064807 | 0.0005574 |
| 6 | 0.00078224 | 0.00133908 |
| 7 | 0.00029799 | 0.00058582 |
| 8 | 0.00063563 | 0.0007537 |
| 9 | 0.00043453 | 0.000653 |
| 10 | 0.0006604 | 0.00088189 |
| 11 | 0.00056282 | 0.00067366 |
| 12 | 0.00040945 | 0.00070602 |

TABLE E39B

| | SEQID-363 FSR (hr$^{-1}$) | |
|---|---|---|
| Subject ID | Fasted | Fed |
| 1 | 0.00040882 | 0.00106664 |
| 2 | 0.00090652 | 0.00040036 |
| 3 | 0.00040061 | 0.00094592 |
| 4 | 0.00078852 | 0.00082819 |
| 5 | 0.00057147 | 0.00038021 |
| 6 | 0.00054359 | 0.00047435 |

TABLE E39C

| | SEQID-105 FSR (hr$^{-1}$) | |
|---|---|---|
| Subject ID | Fasted | Fed |
| 7 | 0.00037724 | 0.00090154 |
| 8 | 0.00041119 | 0.00047965 |
| 9 | 0.00043875 | 0.00075389 |
| 10 | 0.00039112 | 0.00032007 |

TABLE E39C-continued

| | SEQID-105 FSR (hr$^{-1}$) | |
|---|---|---|
| Subject ID | Fasted | Fed |
| 11 | 0.00049953 | 0.00088001 |
| 12 | 0.00022427 | 0.00085157 |

Paired t-tests comparing the fasted and fed response of each group indicate that the fed response in the WPI treated subjects is significantly different from the fasted response when subject 3 is removed. (p=007), consistent with previous studies examining the FSR response to WPI (Paddon-Jones, D., Sheffield-Moore, M., Katsanos C. S., Xiao-Jun Z., Wolfe, R. R. Differential stimulation of muscle protein synthesis in elderly humans following isocaloric ingestion in amino acids or whey protein. Exp. Gerontol. (2006) 41: 215-219). If subject three is included, the difference loses significance (p=0.45). The fasted and fed FSR response in the SEQID-105 fed group are significantly different (p=0.04), but the fasted and fed FSR response in the SEQID-363 fed group are not significantly different (p=0.68).

Example 40

Oral Pharmacokinetics of Formulations Containing Nutritive Polypeptides

The anabolic response to protein ingestion is predicated on the delivery of essential amino acids. The purpose of this study was to examine the changes in plasma amino acid concentrations in response to various proteins over a period of 240 minutes. Four apparently healthy subjects between the ages of 18 and 50 were randomly assigned in a double-blinded manner to a sequence of treatments, receiving 20 grams of either whey protein isolate or SEQID-105 orally, in a volume of 170 ml. Subjects were fasted overnight (>8 hrs) before oral pharmacokinetic study. Venous blood samples were collected at specified time points (i.e. 0, 15, 30, 60, 90, 120, 150, 180, 210 and 240 minutes) following the oral ingestion of nutritive polypeptide to assess changes in plasma amino acid concentrations. Plasma amino acid concentrations were quantified by Quest Diagnostics or Laboratory Corporation of America.

FIGS. 57-60 show the plasma time course of each measured amino acid and the aggregate groups, essential amino acids (EAA), branched chain amino acids (BCAA), and total amino acids (TAA), for WPI and SEQID-105.

Using a 1-way ANOVA test to assess significant differences in plasma amino acid levels across the time points measured, for WPI, these data indicate that there are significant differences across time for Asn, Ile, Leu, Lys, Met, Phe, Pro, Trp, Tyr, EAA, BCAA, and TAA (p<0.05).

Using a 1-way ANOVA test to assess significant differences in plasma amino acid levels across the time points measured, for a nutritive formulation of SEQID-105, these data indicate that there are significant differences across time for Arg, Asn, Asp, Glu, Gly, His, Ile, Leu, Lys, Met, Phe, Ser, Tyr, Val, EAA, BCAA, and TAA (p<0.05).

FIGS. 61-63 show the integrated area under the curve (AUC) of each measured amino acid as well as the aggregate groups, essential amino acids (EAA), branched chain amino acids (BCAA), and total amino acids (TAA), for WPI and SEQID-105.

Using a t-test to compare the AUCs of each amino acid or amino acid group between WPI and SEQID-105, there are significant differences in the Asp (p=0.01), His (p=0.04), Leu (0.023), Met (0.002), Phe (0.04), Pro (p<0.01), Ser (p=0.03), and Trp (p=0.002) responses.

In another study, a 35 gram dose of SEQID-105 and WPI was given orally in 100 ml and 1151 ml, respectively, to six, apparently healthy subjects between the ages of 18 and 50. FIGS. 64-67 show the plasma time course of each measured amino acid and the aggregate groups, essential amino acids (EAA), branched chain amino acids (BCAA), and total amino acids (TAA), for WPI and SEQID-105.

Using a 1-way ANOVA test to assess significant differences in plasma amino acid levels across the time points measured, for WPI, these data indicate that there are significant differences across time for Arg, Asn, Asp, Gln, Ile, Leu, Lys, Met, Phe, Pro, Ser, Thr, Trp, Tyr, Val, EAA, BCAA, and TAA (p<0.05).

Using a 1-way ANOVA test to assess significant differences in plasma amino acid levels across the time points measured, for a nutritive formulation of SEQID-105, these data indicate that there are significant differences across time for Arg, Asn, Asp, Glu, His, Ile, Ley, Lys, Met, Phe, Ser, Thr, Tip, Val, EAA, BCAA, and TAA (p<0.05).

FIGS. 68-70 show the integrated area under the curve (AUC) of each measured amino acid as well as the aggregate groups, essential amino acids (EAA), branched chain amino acids (BCAA), and total amino acids (TAA), for WPI and SEQID-105 dosed at 35 g.

Using a two-tailed, unequal variance t-test to compare the AUCs of each amino acid or amino acid group between WPI and SEQID-105, there are significant differences in the Asn (p=0.006), His (p=0.01), Ile (p=0.03), Lys (p=0.02), Met (p<0.001), Phe (p<0.001), Pro (p=0.002), Ser (p=0.005), Thr (p=0.004), Trp (p<0.001), Tyr (p=0.003), and Val (p=0.012) responses.

In another study examining the pharmacokinetics of amino acid delivery via nutritive polypeptides, three apparently healthy subjects between the ages of 18 and 50 were randomly assigned in a double-blinded manner to a sequence of treatments, receiving 20 grams of either whey protein isolate or SEQID-363 orally. Subjects were fasted overnight (>8 hrs) before oral pharmacokinetic study. Venous blood samples were collected at specified time points (i.e. 0, 15, 30, 60, 90, 120, 150, 180, 210 and 240 minutes) following the oral ingestion of nutritive polypeptide to assess changes in plasma amino acid concentrations. Plasma amino acid concentrations were quantified by Quest Diagnostics or Laboratory Corporation of America.

FIGS. 71-74 show the plasma time course of each measured amino acid and the aggregate groups, essential amino acids (EAA), branched chain amino acids (BCAA), and total amino acids (TAA), for WPI and SEQID-363.

Using a 1-way ANOVA test to assess significant differences in plasma amino acid levels across the time points measured, for WPI, these data indicate that there are significant differences across time for Gln, Ile, Leu, Lys, Phe, Ser, Tyr, Val, EAA, BCAA, and TAA (p<0.05).

Using a 1-way ANOVA test to assess significant differences in plasma amino acid levels across the time points measured, for SEQID-363, these data indicate that there are no significant differences across time (p<0.05).

Example 41

Chronic Treatment of Sarcopenia and Loss of Physical Function in Elderly Frail Subjects Using Nutritive Polypeptides Supplementation of leucine or leucine-containing proteins improve muscle mass build-up after exercise and maintain skeletal muscle mass during long-term disuse (Layman & Walker, 2006, The Journal of nutrition: 136: 319-323). Nutritive polypeptides enriched in leucine and essential amino acids are described herein. Elderly, frail subjects are randomly assigned in a double blind manner to a specific treatment group: a control group receiving an isocaloric control or one of 3 dose ranging treatment arm receiving 3 times daily a dose of 15, 30, or 40 grams of a nutritive polypeptide formulation for 30 days. Enrolled subjects are provided with a control diet based upon individual's body mass index (BMI) and physical activities throughout the trial period. Food and calorie intakes are recorded. Enrolled subjects maintain their regular daily activities. Daily physical activities and calorie consumption are measured by a physical activity tracker (FitBit Flex wrist band). Lean body mass is measured by MRI (Müller, M. J., et al. "Assessment and definition of lean body mass deficiency in the elderly." European journal of clinical nutrition (2014)) or dual-energy X-ray absorptiometry (DEXA; Nielsen, Palle Kjrerulff, Jorgen Ladefoged, and Klaus Olgaard. "Lean body mass by Dual Energy X-ray Absorptiometry (DEXA) and by urine and dialysate creatinine recovery in CA PD and pre-dialysis patients compared to normal subjects." Adv Perit Dial 10 (1994): 99-103.) on day 1 (prior to nutritive polypeptide dosing) and day 31 after treatment has concluded to assess the change of skeletal muscle mass. Physical function is also assessed at the start and end of the treatment period using the short physical performance battery score (Volpato, Stefano, et al. "Predictive value of the Short Physical Performance Battery following hospitalization in older patients." The Journals of Gerontology Series A: Biological Sciences and Medical Sciences 66.1 (2011): 89-96.), measures of gait speed, 6 minute walk test (6MWT), and the timed up and go test (TUGS; Podsiadlo, D; Richardson, S. "The timed 'Up & Go': A test of basic functional mobility for frail elderly persons". Journal of the American Geriatrics Society (1991) 39: 142-8). The absolute and percent change in lean body mass as well as SPPB score, gait speed, 6MWT, and TUGS, from baseline is compared across treatment arms and relative to control to assess treatment efficacy.

Example 42

Oral Pharmacokinetics of Formulations Containing Nutritive Polypeptides Deficient in Methionine The purpose of this study was to examine the changes in plasma amino acid concentrations in response to a methionine deficient nutritive protein over a period of 240 minutes. Four apparently healthy subjects between the ages of 18 and 50 were randomly assigned in a double-blinded manner to a sequence of treatments, receiving 20 grams of SEQID-426 orally, in a volume of 170 ml. Subjects were fasted overnight (>8 hrs), and the following morning venous blood samples were collected at specified time points (i.e. 0, 15, 30, 60, 90, 120, 150, 180, 210 and 240 minutes) after the oral ingestion of nutritive polypeptide to assess changes in plasma amino acid concentrations. Plasma amino acid concentrations were quantified by Quest Diagnostics or Laboratory Corporation of America.

FIGS. 75-78 show the plasma time course of each measured amino acid and the aggregate groups, essential amino acids (EAA), branched chain amino acids (BCAA), and total amino acids (TAA), for SEQID-426.

Using a 1-way ANOVA test to assess significant differences in plasma amino acid levels across the time points measured, for SEQID-426, these data indicate that there are significant differences across time for Glu and EAA (p<0.05). A Dunnett multiple comparison test examining the plasma EAA time course further indicates that the plasma EAA levels at the 30 and 60 min. time points are significantly different from the basal levels at time 0 min. Methionine shows no significant change over time.

Example 43

Nutritive Polypeptides for the Treatment of Short Bowel Syndrome in Humans

A nutritive polypeptide containing a high percentage of BCAAs is provided and dosed orally to humans with short bowel syndrome to alleviate protein malnutrition and to increase gastrointestinal markers of intestinal function such as GLP-2. GLP-2 has been shown in numerous preclinical and clinical models to be involved in the regulation of cell proliferation, apoptosis, nutrient absorption, motility, as well as epithelial and intestinal permeability. (See, e.g., Martin, G R. et al., (2006). Gut hormones, and short bowel syndrome: The enigmatic role of glucagon-like peptide-2 in the regulation of intestinal adaptation. *World J Gastroenterol.* 12(26): 4117-4129.) Reduction of parenteral nutrition dependence, weight gain, changes in BMI, serum albumin, creatinine, reduction of inflammatory infiltrate (such as neutrophils) in the intestine, muscle mass/muscle synthesis, urine osmolality, amino acid pharmacokinetic and pharmacodynamic data are collected and improved in subjects receiving nutritive polypeptides. Exemplary polypeptides are listed herein. Nutritive polypeptides are well tolerated in patients with short bowel or gastrointestinal disorders since they are formulated in a small volume that can deliver high percentage BCAAs compared to the current standard of care. Optionally, nutritionally complete nutritive polypeptides, in particular polypeptides with high percentage EAAs, are provided.

Example 44

Nutritive Polypeptides for the Treatment of Anorexia Nervosa in Humans

A nutritive polypeptide containing a high percentage of BCAAs is provided and dosed orally to humans with anorexia nervosa to alleviate gastrointestinal malabsorption associated with disordered eating and provide protein nutrition. Exemplary polypeptides enriched in BCAAs are described herein. Weight gain, changes in BMI, serum clotting factors, serum albumin, creatinine, increases in muscle and/or muscle synthesis, urine osmolality, amino acid pharmacokinetic and pharmacodynamic data are collected. High percentage BCAA Nutritive polypeptides in a small volume are preferred in patients with anorexia, whose small stomach volume severely limits the efficacy of currently available dietary therapies to treat gastrointestinal malabsorption.

Example 45

Nutritive Polypeptides for the Treatment of Inflammatory Conditions in Humans

A nutritive polypeptide containing a high percentage of EAAs and, optionally BCAAs, is provided and dosed orally to humans with inflammatory bowel disease to alleviate gastrointestinal malabsorption associated with mucosal injury and provide protein nutrition. Exemplary polypeptides enriched in BCAAs are described herein. Weight gain, serum albumin, creatinine, amino acid pharmacokinetic and pharmacodynamic data are collected. High percentage EAA (and, optionally, BCAA) Nutritive polypeptides in a small volume are preferred in patients with TBD, whose small stomach volume severely limits the efficacy of currently available dietary therapies to treat gastrointestinal malabsorption.

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

TABLE 1

| SEQID | DBID | Predicted Leader | Fragment Indices | EAAcomplete | EAA | BCAA | A | R | N | D | C | Q | E | G | H | I | L | K |
|---|---|---|---|---|---|---|---|---|---|---|---|---|---|---|---|---|---|---|
| SEQID-00001 | P01012 | — | — | 1 | 0.47 | 0.22 | 0.06 | 0.05 | 0.05 | 0.04 | 0.01 | 0.04 | 0.10 | 0.03 | 0.02 | 0.07 | 0.08 | 0.06 |
| SEQID-00002 | P04405 | — | — | 1 | 0.36 | 0.18 | 0.04 | 0.08 | 0.08 | 0.04 | 0.02 | 0.12 | 0.09 | 0.04 | 0.01 | 0.05 | 0.08 | 0.04 |
| SEQID-00003 | P02754 | — | — | 1 | 0.50 | 0.16 | 0.07 | 0.02 | 0.03 | 0.06 | 0.04 | 0.06 | 0.10 | 0.01 | 0.01 | 0.06 | 0.15 | 0.10 |
| SEQID-00004 | P02662 | — | — | 1 | 0.44 | 0.21 | 0.03 | 0.04 | 0.04 | 0.03 | 0.00 | 0.07 | 0.13 | 0.02 | 0.03 | 0.06 | 0.10 | 0.08 |
| SEQID-00005 | P02666 | — | — | 1 | 0.48 | 0.25 | 0.03 | 0.02 | 0.02 | 0.02 | 0.00 | 0.10 | 0.10 | 0.01 | 0.03 | 0.05 | 0.12 | 0.06 |
| SEQID-00006 | P00711 | — | — | 1 | 0.53 | 0.23 | 0.02 | 0.01 | 0.06 | 0.09 | 0.05 | 0.06 | 0.06 | 0.02 | 0.03 | 0.06 | 0.12 | 0.09 |
| SEQID-00007 | P56552 | — | — | 0 | 0.28 | 0.10 | 0.02 | 0.05 | 0.02 | 0.09 | 0.13 | 0.03 | 0.08 | 0.04 | 0.00 | 0.02 | 0.05 | 0.14 |
| SEQID-00008 | P29290 | — | — | 0 | 0.45 | 0.21 | 0.03 | 0.05 | 0.07 | 0.09 | 0.00 | 0.03 | 0.21 | 0.03 | 0.01 | 0.07 | 0.10 | 0.06 |
| SEQID-00009 | Q5ZMN0 | — | — | 0 | 0.34 | 0.20 | 0.01 | 0.05 | 0.03 | 0.11 | 0.01 | 0.01 | 0.23 | 0.00 | 0.01 | 0.03 | 0.14 | 0.06 |
| SEQID-00010 | P04699 | — | — | 1 | 0.41 | 0.29 | 0.10 | 0.02 | 0.06 | 0.17 | 0.00 | 0.22 | 0.01 | 0.05 | 0.01 | 0.05 | 0.19 | 0.00 |
| SEQID-00011 | P42212 | — | — | 0 | 0.50 | 0.20 | 0.02 | 0.03 | 0.05 | 0.08 | 0.01 | 0.04 | 0.08 | 0.05 | 0.05 | 0.05 | 0.09 | 0.09 |
| SEQID-00012 | P56552 | — | — | 0 | 0.28 | 0.10 | 0.03 | 0.05 | 0.05 | 0.08 | 0.01 | 0.08 | 0.08 | 0.01 | 0.02 | 0.02 | 0.05 | 0.14 |
| SEQID-00013 | P56552 | — | 5:54 | 0 | 0.28 | 0.11 | 0.02 | 0.05 | 0.07 | 0.08 | 0.13 | 0.06 | 0.09 | 0.02 | 0.02 | 0.02 | 0.06 | 0.13 |
| SEQID-00014 | P56552 | — | 1:51 | 0 | 0.30 | 0.11 | 0.02 | 0.05 | 0.07 | 0.08 | 0.12 | 0.08 | 0.08 | 0.02 | 0.02 | 0.02 | 0.06 | 0.15 |
| SEQID-00015 | P56552 | — | 5:51 | 0 | 0.30 | 0.12 | 0.03 | 0.06 | 0.08 | 0.08 | 0.11 | 0.07 | 0.07 | 0.01 | 0.02 | 0.02 | 0.06 | 0.14 |
| SEQID-00016 | — | — | — | 0 | 0.45 | 0.25 | 0.08 | 0.00 | 0.03 | 0.07 | 0.04 | 0.06 | 0.14 | 0.02 | 0.00 | 0.05 | 0.18 | 0.07 |
| SEQID-00017 | — | — | — | 0 | 0.45 | 0.20 | 0.06 | 0.01 | 0.05 | 0.07 | 0.00 | 0.03 | 0.12 | 0.03 | 0.00 | 0.08 | 0.08 | 0.04 |
| SEQID-00018 | P10568 | — | 693:792 | 1 | 0.52 | 0.19 | 0.04 | 0.17 | 0.03 | 0.00 | 0.01 | 0.08 | 0.00 | 0.02 | 0.02 | 0.06 | 0.11 | 0.13 |
| SEQID-00019 | — | — | — | 0 | 0.46 | 0.21 | 0.07 | 0.31 | 0.00 | 0.00 | 0.00 | 0.13 | 0.00 | 0.02 | 0.04 | 0.04 | 0.11 | 0.13 |
| SEQID-00020 | — | — | — | 0 | 0.52 | 0.20 | 0.07 | 0.09 | 0.03 | 0.03 | 0.03 | 0.06 | 0.03 | 0.02 | 0.02 | 0.07 | 0.09 | 0.13 |
| SEQID-00021 | — | — | — | 0 | 0.39 | 0.23 | 0.05 | 0.12 | 0.08 | 0.03 | 0.02 | 0.05 | 0.02 | 0.02 | 0.01 | 0.06 | 0.10 | 0.10 |
| SEQID-00022 | P04700 | — | 40:139 | 0 | 0.42 | 0.29 | 0.10 | 0.01 | 0.05 | 0.00 | 0.00 | 0.22 | 0.00 | 0.01 | 0.01 | 0.04 | 0.20 | 0.00 |
| SEQID-00023 | P04705 | — | 388:487 | 0 | 0.41 | 0.36 | 0.08 | 0.04 | 0.05 | 0.00 | 0.01 | 0.23 | 0.01 | 0.00 | 0.02 | 0.06 | 0.26 | 0.00 |
| SEQID-00024 | P15989 | — | 341:442 | 0 | 0.52 | 0.36 | 0.07 | 0.07 | 0.04 | 0.06 | 0.00 | 0.07 | 0.06 | 0.03 | 0.00 | 0.12 | 0.15 | 0.04 |
| SEQID-00025 | P15989 | — | — | 0 | 0.48 | 0.36 | 0.08 | 0.06 | 0.08 | 0.05 | 0.00 | 0.06 | 0.11 | 0.03 | 0.00 | 0.13 | 0.16 | 0.02 |
| SEQID-00026 | — | — | — | 0 | 0.74 | 0.59 | 0.06 | 0.05 | 0.00 | 0.00 | 0.00 | 0.00 | 0.09 | 0.06 | 0.00 | 0.04 | 0.52 | 0.00 |
| SEQID-00027 | — | — | — | 0 | 0.51 | 0.36 | 0.01 | 0.03 | 0.02 | 0.02 | 0.00 | 0.05 | 0.11 | 0.02 | 0.01 | 0.07 | 0.20 | 0.05 |
| SEQID-00028 | — | — | — | 0 | 0.50 | 0.41 | 0.03 | 0.00 | 0.04 | 0.00 | 0.01 | 0.02 | 0.20 | 0.02 | 0.02 | 0.09 | 0.16 | 0.00 |
| SEQID-00029 | — | — | — | 0 | 0.37 | 0.27 | 0.02 | 0.08 | 0.01 | 0.09 | 0.00 | 0.02 | 0.15 | 0.02 | 0.02 | 0.05 | 0.16 | 0.03 |
| SEQID-00030 | P10587 | — | 1287:1386 | 0 | 0.49 | 0.26 | 0.02 | 0.04 | 0.06 | 0.06 | 0.00 | 0.12 | 0.15 | 0.00 | 0.02 | 0.04 | 0.17 | 0.13 |
| SEQID-00031 | Q27991 | — | 1353:1452 | 0 | 0.46 | 0.23 | 0.04 | 0.07 | 0.02 | 0.10 | 0.00 | 0.11 | 0.16 | 0.02 | 0.01 | 0.02 | 0.17 | 0.17 |
| SEQID-00032 | P29616 | — | 51:151 | 0 | 0.48 | 0.23 | 0.04 | 0.04 | 0.04 | 0.04 | 0.00 | 0.04 | 0.22 | 0.00 | 0.01 | 0.04 | 0.15 | 0.15 |
| SEQID-00033 | — | — | — | 0 | 0.64 | 0.33 | 0.04 | 0.03 | 0.01 | 0.09 | 0.00 | 0.05 | 0.13 | 0.01 | 0.01 | 0.06 | 0.21 | 0.18 |
| SEQID-00034 | — | — | — | 0 | 0.53 | 0.27 | 0.08 | 0.01 | 0.05 | 0.05 | 0.03 | 0.07 | 0.09 | 0.03 | 0.02 | 0.07 | 0.16 | 0.14 |
| SEQID-00035 | P47807 | — | 887:986 | 0 | 0.57 | 0.33 | 0.07 | 0.06 | 0.02 | 0.05 | 0.01 | 0.05 | 0.05 | 0.03 | 0.04 | 0.02 | 0.21 | 0.11 |
| SEQID-00036 | — | — | — | 1 | 0.64 | 0.28 | 0.02 | 0.01 | 0.03 | 0.05 | 0.03 | 0.04 | 0.04 | 0.03 | 0.04 | 0.06 | 0.17 | 0.11 |
| SEQID-00037 | — | — | — | 1 | 1.00 | 0.49 | 0.00 | 0.00 | 0.00 | 0.00 | 0.00 | 0.00 | 0.00 | 0.00 | 0.00 | 0.12 | 0.28 | 0.19 |
| SEQID-00038 | Q90584 | — | 424:529 | 1 | 0.55 | 0.28 | 0.02 | 0.05 | 0.06 | 0.03 | 0.03 | 0.01 | 0.10 | 0.03 | 0.02 | 0.03 | 0.19 | 0.03 |
| SEQID-00039 | Q02440 | — | 1443:1545 | 1 | 0.54 | 0.25 | 0.02 | 0.05 | 0.05 | 0.07 | 0.03 | 0.04 | 0.06 | 0.02 | 0.02 | 0.05 | 0.14 | 0.14 |
| SEQID-00040 | P15989 | — | 399:498 | 0 | 0.51 | 0.34 | 0.06 | 0.03 | 0.04 | 0.06 | 0.00 | 0.05 | 0.07 | 0.03 | 0.00 | 0.10 | 0.13 | 0.03 |
| SEQID-00041 | P10568 | — | 680:779 | 1 | 0.48 | 0.18 | 0.04 | 0.13 | 0.03 | 0.06 | 0.01 | 0.08 | 0.02 | 0.02 | 0.01 | 0.06 | 0.10 | 0.10 |
| SEQID-00042 | P79114 | — | 982:1083 | 0 | 0.25 | 0.09 | 0.05 | 0.03 | 0.06 | 0.13 | 0.00 | 0.04 | 0.15 | 0.02 | 0.04 | 0.01 | 0.04 | 0.01 |
| SEQID-00043 | P15989 | — | 398:447 | 1 | 0.57 | 0.41 | 0.03 | 0.03 | 0.02 | 0.04 | 0.03 | 0.02 | 0.09 | 0.00 | 0.00 | 0.12 | 0.18 | 0.05 |
| SEQID-00044 | P15989 | — | 399:448 | 0 | 0.59 | 0.43 | 0.06 | 0.01 | 0.03 | 0.06 | 0.00 | 0.02 | 0.09 | 0.01 | 0.04 | 0.12 | 0.17 | 0.05 |
| SEQID-00045 | P15989 | — | 402:454 | 0 | 0.56 | 0.43 | 0.06 | 0.03 | 0.06 | 0.04 | 0.00 | 0.02 | 0.09 | 0.02 | 0.00 | 0.14 | 0.20 | 0.04 |
| SEQID-00046 | P15989 | — | 403:454 | 0 | 0.55 | 0.42 | 0.06 | 0.08 | 0.06 | 0.06 | 0.00 | 0.02 | 0.09 | 0.02 | 0.00 | 0.14 | 0.18 | 0.05 |
| SEQID-00047 | P15989 | — | 406:455 | 0 | 0.58 | 0.44 | 0.07 | 0.06 | 0.06 | 0.04 | 0.02 | 0.02 | 0.10 | 0.02 | 0.00 | 0.13 | 0.21 | 0.05 |
| SEQID-00048 | P69012 | — | — | 0 | 0.08 | 0.03 | 0.03 | 0.76 | 0.00 | 0.00 | 0.00 | 0.00 | 0.00 | 0.01 | 0.00 | 0.03 | 0.00 | 0.00 |

TABLE 1-continued

| SEQID | | | Protein ID | | | | | | | | | | | | | | | |
|---|---|---|---|---|---|---|---|---|---|---|---|---|---|---|---|---|---|---|
| SEQID-00049 | — | — | P02662 | 1 | 0.52 | 0.19 | 0.03 | 0.04 | 0.05 | 0.07 | 0.01 | 0.04 | 0.07 | 0.05 | 0.08 | 0.04 | 0.08 | 0.09 |
| SEQID-00050 | — | 1:50 | P02662 | 0 | 0.59 | 0.31 | 0.05 | 0.06 | 0.04 | 0.00 | 0.02 | 0.05 | 0.09 | 0.02 | 0.05 | 0.04 | 0.18 | 0.09 |
| SEQID-00051 | — | 2:51 | P02662 | 0 | 0.59 | 0.31 | 0.05 | 0.06 | 0.04 | 0.00 | 0.02 | 0.05 | 0.09 | 0.02 | 0.02 | 0.04 | 0.18 | 0.11 |
| SEQID-00052 | — | 3:52 | P02662 | 0 | 0.59 | 0.33 | 0.05 | 0.06 | 0.06 | 0.00 | 0.02 | 0.05 | 0.09 | 0.02 | 0.05 | 0.04 | 0.18 | 0.09 |
| SEQID-00053 | — | 4:53 | P02662 | 0 | 0.57 | 0.31 | 0.05 | 0.06 | 0.06 | 0.00 | 0.02 | 0.05 | 0.09 | 0.02 | 0.05 | 0.04 | 0.16 | 0.09 |
| SEQID-00054 | — | 5:54 | P02662 | 0 | 0.55 | 0.29 | 0.05 | 0.06 | 0.06 | 0.02 | 0.02 | 0.05 | 0.09 | 0.02 | 0.05 | 0.02 | 0.14 | 0.09 |
| SEQID-00055 | — | 6:55 | P02662 | 0 | 0.55 | 0.29 | 0.05 | 0.05 | 0.06 | 0.02 | 0.02 | 0.05 | 0.11 | 0.01 | 0.05 | 0.08 | 0.16 | 0.09 |
| SEQID-00056 | — | 78:127 | P02662 | 0 | 0.41 | 0.28 | 0.00 | 0.05 | 0.02 | 0.02 | 0.00 | 0.09 | 0.18 | 0.01 | 0.02 | 0.08 | 0.12 | 0.11 |
| SEQID-00057 | — | 79:128 | P02662 | 0 | 0.41 | 0.28 | 0.00 | 0.05 | 0.02 | 0.00 | 0.00 | 0.09 | 0.15 | 0.01 | 0.02 | 0.08 | 0.12 | 0.11 |
| SEQID-00058 | — | 80:129 | P02662 | 0 | 0.41 | 0.28 | 0.00 | 0.05 | 0.02 | 0.00 | 0.00 | 0.09 | 0.15 | 0.01 | 0.02 | 0.06 | 0.12 | 0.11 |
| SEQID-00059 | — | 86:135 | P02662 | 0 | 0.41 | 0.27 | 0.01 | 0.08 | 0.04 | 0.01 | 0.00 | 0.09 | 0.15 | 0.02 | 0.02 | 0.06 | 0.13 | 0.11 |
| SEQID-00060 | — | — | | 1 | 0.48 | 0.19 | 0.03 | 0.03 | 0.04 | 0.10 | 0.01 | 0.03 | 0.11 | 0.05 | 0.08 | 0.04 | 0.08 | 0.06 |
| SEQID-00061 | — | — | P33465 | 1 | 0.55 | 0.17 | 0.02 | 0.11 | 0.04 | 0.04 | 0.03 | 0.02 | 0.04 | 0.05 | 0.08 | 0.04 | 0.08 | 0.16 |
| SEQID-00062 | — | — | Q9B8D7 | 0 | 0.67 | 0.49 | 0.03 | 0.07 | 0.04 | 0.03 | 0.03 | 0.02 | 0.02 | 0.02 | 0.04 | 0.05 | 0.32 | 0.02 |
| SEQID-00063 | — | — | P48923 | 0 | 0.63 | 0.48 | 0.05 | 0.01 | 0.02 | 0.01 | 0.00 | 0.01 | 0.04 | 0.04 | 0.01 | 0.20 | 0.19 | 0.01 |
| SEQID-00064 | — | — | P44110 | 0 | 0.62 | 0.46 | 0.04 | 0.00 | 0.02 | 0.02 | 0.00 | 0.01 | 0.01 | 0.03 | 0.01 | 0.19 | 0.20 | 0.02 |
| SEQID-00065 | — | — | O57248 | 1 | 0.66 | 0.49 | 0.05 | 0.00 | 0.02 | 0.01 | 0.00 | 0.04 | 0.02 | 0.07 | 0.01 | 0.16 | 0.24 | 0.05 |
| SEQID-00066 | — | — | P81327 | 1 | 0.70 | 0.43 | 0.02 | 0.01 | 0.06 | 0.00 | 0.01 | 0.01 | 0.03 | 0.02 | 0.00 | 0.10 | 0.23 | 0.08 |
| SEQID-00067 | — | — | | 0 | 0.68 | 0.48 | 0.04 | 0.00 | 0.03 | 0.00 | 0.00 | 0.03 | 0.02 | 0.03 | 0.00 | 0.21 | 0.18 | 0.07 |
| SEQID-00068 | — | — | | 0 | 0.57 | 0.43 | 0.00 | 0.00 | 0.04 | 0.02 | 0.01 | 0.07 | 0.13 | 0.00 | 0.03 | 0.12 | 0.21 | 0.03 |
| SEQID-00069 | — | — | | 0 | 0.56 | 0.47 | 0.06 | 0.04 | 0.04 | 0.03 | 0.02 | 0.04 | 0.09 | 0.03 | 0.00 | 0.12 | 0.23 | 0.02 |
| SEQID-00070 | — | — | | 0 | 0.50 | 0.40 | 0.06 | 0.06 | 0.04 | 0.05 | 0.00 | 0.06 | 0.11 | 0.03 | 0.00 | 0.12 | 0.19 | 0.02 |
| SEQID-00071 | — | — | | 0 | 0.62 | 0.46 | 0.05 | 0.08 | 0.06 | 0.04 | 0.00 | 0.02 | 0.09 | 0.01 | 0.01 | 0.06 | 0.20 | 0.05 |
| SEQID-00072 | — | — | P09860 | 0 | 0.46 | 0.18 | 0.03 | 0.03 | 0.05 | 0.14 | 0.01 | 0.03 | 0.17 | 0.04 | 0.06 | 0.05 | 0.08 | 0.09 |
| SEQID-00073 | — | — | P35622 | 0 | 0.49 | 0.20 | 0.04 | 0.05 | 0.02 | 0.12 | 0.00 | 0.02 | 0.16 | 0.03 | 0.05 | 0.06 | 0.10 | 0.23 |
| SEQID-00074 | — | — | P02586 | 0 | 0.42 | 0.16 | 0.05 | 0.06 | 0.02 | 0.12 | 0.01 | 0.04 | 0.19 | 0.04 | 0.01 | 0.06 | 0.06 | 0.06 |
| SEQID-00075 | — | — | P63317 | 0 | 0.46 | 0.18 | 0.03 | 0.03 | 0.02 | 0.14 | 0.01 | 0.03 | 0.17 | 0.04 | 0.00 | 0.06 | 0.08 | 0.09 |
| SEQID-00076 | — | — | P63315 | 0 | 0.46 | 0.18 | 0.03 | 0.03 | 0.03 | 0.14 | 0.01 | 0.03 | 0.17 | 0.04 | 0.01 | 0.06 | 0.08 | 0.09 |
| SEQID-00077 | — | — | D7F1Q2 | 0 | 0.47 | 0.21 | 0.04 | 0.02 | 0.04 | 0.14 | 0.02 | 0.04 | 0.18 | 0.03 | 0.02 | 0.08 | 0.09 | 0.07 |
| SEQID-00078 | — | — | Q7ZZ89 | 0 | 0.46 | 0.17 | 0.03 | 0.03 | 0.03 | 0.14 | 0.00 | 0.04 | 0.16 | 0.03 | 0.02 | 0.06 | 0.07 | 0.10 |
| SEQID-00079 | — | — | Q9FF58 | 0 | 0.58 | 0.38 | 0.05 | 0.13 | 0.00 | 0.02 | 0.05 | 0.02 | 0.02 | 0.03 | 0.00 | 0.07 | 0.24 | 0.04 |
| SEQID-00080 | — | — | P93280 | 0 | 0.62 | 0.33 | 0.01 | 0.03 | 0.06 | 0.05 | 0.11 | 0.04 | 0.04 | 0.03 | 0.00 | 0.07 | 0.21 | 0.04 |
| SEQID-00081 | — | — | Q67E55 | 0 | 0.55 | 0.30 | 0.04 | 0.04 | 0.05 | 0.02 | 0.01 | 0.05 | 0.15 | 0.03 | 0.04 | 0.08 | 0.21 | 0.02 |
| SEQID-00082 | — | — | Q35Z72 | 1 | 0.48 | 0.30 | 0.07 | 0.11 | 0.03 | 0.03 | 0.02 | 0.03 | 0.10 | 0.01 | 0.04 | 0.06 | 0.19 | 0.02 |
| SEQID-00083 | — | — | P14622 | 1 | 0.51 | 0.26 | 0.03 | 0.12 | 0.01 | 0.04 | 0.03 | 0.04 | 0.09 | 0.04 | 0.03 | 0.03 | 0.20 | 0.02 |
| SEQID-00084 | — | 1:61 | P33626 | 1 | 0.32 | 0.15 | 0.04 | 0.02 | 0.02 | 0.01 | 0.01 | 0.04 | 0.05 | 0.03 | 0.04 | 0.10 | 0.18 | 0.05 |
| SEQID-00085 | — | — | P60660 | 1 | 0.47 | 0.20 | 0.05 | 0.05 | 0.05 | 0.07 | 0.01 | 0.03 | 0.16 | 0.04 | 0.04 | 0.03 | 0.03 | 0.02 |
| SEQID-00086 | — | — | P02607 | 0 | 0.46 | 0.18 | 0.03 | 0.03 | 0.02 | 0.06 | 0.02 | 0.06 | 0.13 | 0.04 | 0.03 | 0.03 | 0.09 | 0.07 |
| SEQID-00087 | — | — | P02605 | 1 | 0.48 | 0.19 | 0.05 | 0.04 | 0.05 | 0.06 | 0.01 | 0.04 | 0.14 | 0.04 | 0.03 | 0.05 | 0.09 | 0.08 |
| SEQID-00088 | — | 1:90 | Q9FRT9 | 1 | 0.32 | 0.11 | 0.05 | 0.02 | 0.08 | 0.09 | 0.05 | 0.03 | 0.15 | 0.03 | 0.02 | 0.05 | 0.08 | 0.08 |
| SEQID-00089 | — | — | Q95M18 | 1 | 0.46 | 0.19 | 0.04 | 0.06 | 0.03 | 0.08 | 0.11 | 0.03 | 0.04 | 0.05 | 0.01 | 0.02 | 0.07 | 0.04 |
| SEQID-00090 | — | — | Q41784 | 1 | 0.43 | 0.17 | 0.04 | 0.07 | 0.05 | 0.06 | 0.01 | 0.03 | 0.15 | 0.02 | 0.01 | 0.05 | 0.08 | 0.11 |
| SEQID-00091 | — | 1:322 | P09643 | 0 | 0.44 | 0.20 | 0.06 | 0.06 | 0.04 | 0.06 | 0.02 | 0.05 | 0.10 | 0.04 | 0.03 | 0.04 | 0.08 | 0.04 |
| SEQID-00092 | — | — | P02587 | 0 | 0.42 | 0.16 | 0.05 | 0.06 | 0.02 | 0.12 | 0.01 | 0.04 | 0.09 | 0.03 | 0.03 | 0.06 | 0.08 | 0.04 |
| SEQID-00093 | — | — | P10246 | 0 | 0.45 | 0.16 | 0.05 | 0.05 | 0.03 | 0.13 | 0.01 | 0.03 | 0.19 | 0.04 | 0.01 | 0.07 | 0.05 | 0.06 |
| SEQID-00094 | — | — | P02588 | 0 | 0.45 | 0.16 | 0.05 | 0.05 | 0.02 | 0.08 | 0.03 | 0.06 | 0.18 | 0.04 | 0.01 | 0.07 | 0.06 | 0.07 |
| SEQID-00095 | — | — | P04119 | 1 | 0.50 | 0.28 | 0.05 | 0.01 | 0.05 | 0.02 | 0.03 | 0.04 | 0.10 | 0.01 | 0.02 | 0.03 | 0.09 | 0.07 |
| SEQID-00096 | — | — | Q9TSR4 | 0 | 0.53 | 0.23 | 0.02 | 0.01 | 0.05 | 0.03 | 0.05 | 0.06 | 0.06 | 0.02 | 0.03 | 0.06 | 0.12 | 0.07 |
| SEQID-00097 | — | — | Q5KR47 | 0 | 0.39 | 0.18 | 0.08 | 0.07 | 0.04 | 0.07 | 0.00 | 0.06 | 0.24 | 0.01 | 0.01 | 0.04 | 0.12 | 0.15 |
| SEQID-00098 | — | — | QO3OJ7 | 0 | 0.50 | 0.25 | 0.03 | 0.00 | 0.05 | 0.15 | 0.00 | 0.03 | 0.20 | 0.04 | 0.00 | 0.07 | 0.08 | 0.09 |
| SEQID-00099 | — | — | Q8DH53 | 0 | 0.45 | 0.28 | 0.07 | 0.00 | 0.05 | 0.10 | 0.00 | 0.04 | 0.19 | 0.05 | 0.00 | 0.06 | 0.10 | 0.09 |
| SEQID-00100 | — | — | Q5FJ18 | 0 | 0.46 | 0.12 | 0.03 | 0.02 | 0.06 | 0.15 | 0.00 | 0.03 | 0.16 | 0.02 | 0.02 | 0.11 | 0.06 | 0.08 |
| SEQID-00101 | — | — | Q9WZD0 | 0 | 0.51 | 0.29 | 0.03 | 0.02 | 0.00 | 0.14 | 0.00 | 0.01 | 0.15 | 0.03 | 0.00 | 0.09 | 0.10 | 0.12 |

TABLE 1-continued

| | | | | | | | | | | | | | | | |
|---|---|---|---|---|---|---|---|---|---|---|---|---|---|---|---|
| SEQID-00102 | Q74IP1 | — | 0 | 0.45 | 0.20 | 0.04 | 0.03 | 0.05 | 0.16 | 0.00 | 0.04 | 0.14 | 0.01 | 0.10 | 0.06 | 0.07 |
| SEQID-00103 | Q84MN0 | — | 0 | 0.45 | 0.19 | 0.03 | 0.05 | 0.05 | 0.11 | 0.01 | 0.05 | 0.16 | 0.04 | 0.05 | 0.09 | 0.06 |
| SEQID-00104 | P41040 | — | 0 | 0.45 | 0.18 | 0.05 | 0.05 | 0.05 | 0.12 | 0.01 | 0.05 | 0.15 | 0.03 | 0.05 | 0.08 | 0.08 |
| SEQID-00105 | P06787 | — | 0 | 0.44 | 0.23 | 0.05 | 0.03 | 0.06 | 0.09 | 0.01 | 0.05 | 0.14 | 0.03 | 0.06 | 0.13 | 0.06 |
| SEQID-00106 | P93087 | — | 0 | 0.46 | 0.17 | 0.04 | 0.05 | 0.05 | 0.14 | 0.01 | 0.05 | 0.15 | 0.03 | 0.05 | 0.07 | 0.08 |
| SEQID-00107 | P52193 | — | 1 | 0.42 | 0.14 | 0.03 | 0.02 | 0.03 | 0.13 | 0.00 | 0.03 | 0.12 | 0.03 | 0.06 | 0.06 | 0.11 |
| SEQID-00108 | Q95P22 | — | 1 | 0.44 | 0.14 | 0.05 | 0.02 | 0.02 | 0.14 | 0.00 | 0.00 | 0.20 | 0.04 | 0.08 | 0.05 | 0.14 |
| SEQID-00109 | P32018 | 656:709 | 0 | 0.42 | 0.33 | 0.05 | 0.03 | 0.04 | 0.10 | 0.02 | 0.02 | 0.16 | 0.03 | 0.08 | 0.16 | 0.00 |
| SEQID-00110 | Q9HD67 | 472:521 | 0 | 0.49 | 0.29 | 0.02 | 0.03 | 0.02 | 0.10 | 0.05 | 0.06 | 0.22 | 0.01 | 0.02 | 0.20 | 0.04 |
| SEQID-00111 | Q03472 | 140:189 | 1 | 0.48 | 0.26 | 0.01 | 0.00 | 0.04 | 0.07 | 0.01 | 0.12 | 0.12 | 0.02 | 0.07 | 0.21 | 0.13 |
| SEQID-00112 | Q02440 | 461:511 | 1 | 0.50 | 0.23 | 0.01 | 0.01 | 0.06 | 0.08 | 0.02 | 0.06 | 0.11 | 0.02 | 0.07 | 0.13 | 0.06 |
| SEQID-00113 | Q13402 | 452:509 | 1 | 0.52 | 0.24 | 0.03 | 0.00 | 0.08 | 0.07 | 0.01 | 0.12 | 0.25 | 0.06 | 0.10 | 0.11 | 0.04 |
| SEQID-00114 | Q90688 | 446:495 | 1 | 0.51 | 0.24 | 0.01 | 0.05 | 0.00 | 0.08 | 0.02 | 0.07 | 0.27 | 0.02 | 0.04 | 0.08 | 0.07 |
| SEQID-00115 | Q29092 | 703:803 | 0 | 0.32 | 0.13 | 0.04 | 0.05 | 0.01 | 0.16 | 0.00 | 0.02 | 0.26 | 0.00 | 0.02 | 0.08 | 0.04 |
| SEQID-00116 | Q29092 | 704:803 | 0 | 0.32 | 0.14 | 0.04 | 0.06 | 0.01 | 0.16 | 0.00 | 0.02 | 0.12 | 0.03 | 0.05 | 0.03 | 0.05 |
| SEQID-00117 | Q02440 | 413:512 | 1 | 0.52 | 0.22 | 0.02 | 0.04 | 0.04 | 0.06 | 0.01 | 0.02 | 0.12 | 0.01 | 0.09 | 0.09 | 0.06 |
| SEQID-00118 | Q28970 | 427:527 | 1 | 0.51 | 0.21 | 0.02 | 0.02 | 0.04 | 0.03 | 0.01 | 0.05 | 0.17 | 0.03 | 0.09 | 0.10 | 0.05 |
| SEQID-00119 | Q90688 | 332:481 | 1 | 0.46 | 0.24 | 0.05 | 0.02 | 0.03 | 0.05 | 0.03 | 0.03 | 0.12 | 0.02 | 0.07 | 0.07 | 0.07 |
| SEQID-00120 | Q90688 | 398:498 | 1 | 0.46 | 0.22 | 0.04 | 0.03 | 0.04 | 0.04 | 0.03 | 0.03 | 0.20 | 0.03 | 0.07 | 0.06 | 0.07 |
| SEQID-00121 | Q28083 | 23:225 | 0 | 0.29 | 0.12 | 0.03 | 0.02 | 0.03 | 0.04 | 0.00 | 0.03 | 0.21 | 0.01 | 0.04 | 0.04 | 0.04 |
| SEQID-00122 | Q28083 | 2:202 | 0 | 0.26 | 0.10 | 0.04 | 0.02 | 0.02 | 0.09 | 0.01 | 0.05 | 0.21 | 0.04 | 0.03 | 0.03 | 0.04 |
| SEQID-00123 | Q95M18 | 118:318 | 0 | 0.46 | 0.20 | 0.04 | 0.02 | 0.06 | 0.07 | 0.00 | 0.03 | 0.18 | 0.03 | 0.06 | 0.08 | 0.09 |
| SEQID-00124 | P03110 | 120:321 | 1 | 0.43 | 0.19 | 0.04 | 0.02 | 0.04 | 0.07 | 0.00 | 0.03 | 0.13 | 0.02 | 0.05 | 0.07 | 0.11 |
| SEQID-00125 | P22418 | 75:275 | 1 | 0.40 | 0.27 | 0.05 | 0.03 | 0.02 | 0.08 | 0.00 | 0.05 | 0.10 | 0.01 | 0.09 | 0.08 | 0.03 |
| SEQID-00126 | P79114 | 913:1115 | 0 | 0.26 | 0.11 | 0.04 | 0.06 | 0.03 | 0.11 | 0.03 | 0.06 | 0.15 | 0.03 | 0.02 | 0.06 | 0.02 |
| SEQID-00127 | P04119 | — | 0 | 0.50 | 0.28 | 0.05 | 0.05 | 0.02 | 0.08 | 0.03 | 0.06 | 0.10 | 0.01 | 0.03 | 0.18 | 0.07 |
| SEQID-00128 | P06714 | — | 1 | 0.53 | 0.24 | 0.09 | 0.10 | 0.01 | 0.05 | 0.03 | 0.09 | 0.04 | 0.08 | 0.01 | 0.17 | 0.04 |
| SEQID-00129 | A1AAQ3 | — | 1 | 0.51 | 0.26 | 0.06 | 0.08 | 0.01 | 0.05 | 0.01 | 0.09 | 0.06 | 0.06 | 0.02 | 0.13 | 0.02 |
| SEQID-00130 | P02114 | — | 1 | 0.56 | 0.24 | 0.07 | 0.06 | 0.05 | 0.05 | 0.03 | 0.04 | 0.05 | 0.06 | 0.05 | 0.12 | 0.02 |
| SEQID-00131 | P67975 | — | 1 | 0.50 | 0.25 | 0.06 | 0.03 | 0.04 | 0.05 | 0.03 | 0.06 | 0.11 | 0.02 | 0.06 | 0.13 | 0.08 |
| SEQID-00132 | Q90584 | 436:486 | 0 | 0.60 | 0.41 | 0.04 | 0.02 | 0.06 | 0.02 | 0.00 | 0.02 | 0.07 | 0.02 | 0.04 | 0.13 | 0.11 |
| SEQID-00133 | A6QPB3 | 473:523 | 0 | 0.61 | 0.35 | 0.04 | 0.10 | 0.04 | 0.02 | 0.00 | 0.00 | 0.15 | 0.00 | 0.02 | 0.32 | 0.07 |
| SEQID-00134 | P22281 | 82:134 | 1 | 0.58 | 0.46 | 0.04 | 0.06 | 0.04 | 0.00 | 0.03 | 0.08 | 0.02 | 0.00 | 0.14 | 0.30 | 0.11 |
| SEQID-00135 | P01958 | 63:114 | 1 | 0.61 | 0.38 | 0.06 | 0.03 | 0.09 | 0.06 | 0.00 | 0.00 | 0.00 | 0.12 | 0.00 | 0.24 | 0.00 |
| SEQID-00136 | Q9TSN7 | 63:114 | 1 | 0.62 | 0.36 | 0.09 | 0.06 | 0.02 | 0.10 | 0.00 | 0.02 | 0.02 | 0.12 | 0.00 | 0.29 | 0.05 |
| SEQID-00137 | Q17R14 | 270:321 | 0 | 0.64 | 0.39 | 0.06 | 0.06 | 0.04 | 0.06 | 0.00 | 0.02 | 0.00 | 0.02 | 0.10 | 0.27 | 0.07 |
| SEQID-00138 | P47807 | 952:1003 | 0 | 0.59 | 0.35 | 0.08 | 0.03 | 0.03 | 0.03 | 0.00 | 0.05 | 0.07 | 0.08 | 0.04 | 0.20 | 0.09 |
| SEQID-00139 | Q27991 | 1396:1446 | 0 | 0.49 | 0.31 | 0.02 | 0.08 | 0.02 | 0.11 | 0.00 | 0.11 | 0.05 | 0.02 | 0.02 | 0.27 | 0.05 |
| SEQID-00140 | P12106 | 170:120 | 1 | 0.70 | 0.32 | 0.00 | 0.00 | 0.02 | 0.06 | 0.00 | 0.02 | 0.11 | 0.05 | 0.10 | 0.23 | 0.13 |
| SEQID-00141 | P32191 | 112:163 | 1 | 0.58 | 0.31 | 0.05 | 0.05 | 0.04 | 0.02 | 0.02 | 0.02 | 0.04 | 0.07 | 0.11 | 0.14 | 0.11 |
| SEQID-00142 | P19524 | 1398:1449 | 1 | 0.56 | 0.25 | 0.01 | 0.10 | 0.06 | 0.05 | 0.02 | 0.08 | 0.09 | 0.07 | 0.11 | 0.15 | 0.06 |
| SEQID-00143 | Q03262 | 225:277 | 1 | 0.65 | 0.30 | 0.01 | 0.00 | 0.04 | 0.02 | 0.03 | 0.00 | 0.06 | 0.04 | 0.04 | 0.18 | 0.08 |
| SEQID-00144 | P32492 | 1275:1325 | 1 | 0.67 | 0.25 | 0.02 | 0.06 | 0.09 | 0.08 | 0.03 | 0.00 | 0.11 | 0.02 | 0.06 | 0.13 | 0.15 |
| SEQID-00145 | P12863 | 82:132 | 1 | 0.51 | 0.33 | 0.05 | 0.00 | 0.04 | 0.02 | 0.02 | 0.03 | 0.02 | 0.02 | 0.04 | 0.15 | 0.11 |
| SEQID-00146 | P12106 | 159:209 | 0 | 0.67 | 0.29 | 0.01 | 0.06 | 0.06 | 0.04 | 0.03 | 0.02 | 0.12 | 0.03 | 0.04 | 0.17 | 0.05 |
| SEQID-00147 | P32492 | 1092:1193 | 1 | 0.57 | 0.36 | 0.00 | 0.00 | 0.08 | 0.06 | 0.02 | 0.03 | 0.04 | 0.05 | 0.08 | 0.14 | 0.09 |
| SEQID-00148 | A6QR56 | 583:691 | 0 | 0.47 | 0.34 | 0.10 | 0.14 | 0.02 | 0.04 | 0.04 | 0.01 | 0.08 | 0.01 | 0.07 | 0.17 | 0.06 |
| SEQID-00149 | P47807 | 888:988 | 1 | 0.56 | 0.32 | 0.07 | 0.06 | 0.08 | 0.01 | 0.00 | 0.05 | 0.09 | 0.02 | 0.01 | 0.21 | 0.03 |
| SEQID-00150 | P32492 | 1218:1319 | 1 | 0.67 | 0.25 | 0.02 | 0.00 | 0.03 | 0.05 | 0.02 | 0.06 | 0.05 | 0.05 | 0.02 | 0.14 | 0.09 |
| SEQID-00151 | P79114 | 688:788 | 0 | 0.48 | 0.26 | 0.05 | 0.14 | 0.07 | 0.03 | 0.03 | 0.01 | 0.06 | 0.00 | 0.06 | 0.13 | 0.13 |
| SEQID-00152 | Q5MIB5 | 492:592 | 1 | 0.53 | 0.27 | 0.01 | 0.05 | 0.04 | 0.05 | 0.02 | 0.06 | 0.09 | 0.03 | 0.04 | 0.15 | 0.10 |
| SEQID-00153 | P04119 | 28:129 | 1 | 0.51 | 0.26 | 0.06 | 0.01 | 0.01 | 0.10 | 0.02 | 0.05 | 0.08 | 0.02 | 0.07 | 0.14 | 0.13 |
| SEQID-00154 | P06642 | 14:115 | 1 | 0.55 | 0.27 | 0.03 | 0.05 | 0.05 | 0.06 | 0.02 | 0.01 | 0.06 | 0.04 | 0.05 | 0.14 | 0.08 |

TABLE 1-continued

| | | | | | | | | | | | | | | | |
|---|---|---|---|---|---|---|---|---|---|---|---|---|---|---|---|
| SEQID-00155 | Q2XQV4 | — | 108:213 | 1 | 0.49 | 0.26 | 0.05 | 0.06 | 0.04 | 0.08 | 0.02 | 0.02 | 0.03 | 0.04 | 0.02 | 0.05 | 0.15 | 0.06 |
| SEQID-00156 | Q02440 | — | 1448:1548 | 1 | 0.52 | 0.25 | 0.02 | 0.07 | 0.05 | 0.06 | 0.04 | 0.02 | 0.07 | 0.03 | 0.03 | 0.05 | 0.15 | 0.12 |
| SEQID-00157 | Q49068 | — | — | 1 | 0.45 | 0.23 | 0.04 | 0.03 | 0.06 | 0.06 | 0.01 | 0.06 | 0.07 | 0.02 | 0.03 | 0.06 | 0.10 | 0.05 |
| SEQID-00158 | P32492 | — | 1086:1287 | 1 | 0.58 | 0.29 | 0.02 | 0.06 | 0.07 | 0.06 | 0.00 | 0.02 | 0.08 | 0.03 | 0.03 | 0.05 | 0.15 | 0.10 |
| SEQID-00159 | Q76FS2 | — | 59:260 | 1 | 0.46 | 0.23 | 0.03 | 0.06 | 0.06 | 0.07 | 0.03 | 0.03 | 0.06 | 0.05 | 0.03 | 0.04 | 0.12 | 0.03 |
| SEQID-00160 | P32492 | — | 1115:1316 | 1 | 0.61 | 0.28 | 0.02 | 0.01 | 0.07 | 0.06 | 0.00 | 0.02 | 0.07 | 0.01 | 0.03 | 0.05 | 0.14 | 0.11 |
| SEQID-00161 | Q41874 | — | 113:313 | 1 | 0.49 | 0.27 | 0.04 | 0.09 | 0.07 | 0.04 | 0.01 | 0.06 | 0.04 | 0.01 | 0.02 | 0.05 | 0.12 | 0.05 |
| SEQID-00162 | P52768 | — | — | 0 | 0.64 | 0.53 | 0.01 | 0.00 | 0.08 | 0.02 | 0.01 | 0.02 | 0.02 | 0.01 | 0.05 | 0.14 | 0.34 | 0.02 |
| SEQID-00163 | P80479 | — | — | 1 | 0.72 | 0.43 | 0.02 | 0.01 | 0.02 | 0.02 | 0.00 | 0.04 | 0.03 | 0.01 | 0.00 | 0.13 | 0.26 | 0.07 |
| SEQID-00164 | Q31K24 | — | — | 0 | 0.67 | 0.51 | 0.04 | 0.05 | 0.05 | 0.00 | 0.03 | 0.06 | 0.00 | 0.04 | 0.05 | 0.05 | 0.24 | 0.00 |
| SEQID-00165 | P51316 | — | — | 0 | 0.69 | 0.52 | 0.03 | 0.00 | 0.02 | 0.00 | 0.00 | 0.04 | 0.02 | 0.00 | 0.01 | 0.12 | 0.23 | 0.02 |
| SEQID-00166 | Q36967 | — | 1:105 | 0 | 0.65 | 0.46 | 0.08 | 0.04 | 0.05 | 0.02 | 0.00 | 0.06 | 0.02 | 0.02 | 0.03 | 0.12 | 0.26 | 0.02 |
| SEQID-00167 | O21402 | — | — | 1 | 0.65 | 0.39 | 0.05 | 0.03 | 0.05 | 0.03 | 0.02 | 0.03 | 0.03 | 0.02 | 0.02 | 0.08 | 0.29 | 0.02 |
| SEQID-00168 | Q47872 | — | — | 1 | 0.68 | 0.41 | 0.04 | 0.02 | 0.11 | 0.05 | 0.00 | 0.05 | 0.02 | 0.03 | 0.02 | 0.10 | 0.27 | 0.00 |
| SEQID-00169 | Q85X26 | — | — | 1 | 0.60 | 0.43 | 0.01 | 0.00 | 0.05 | 0.02 | 0.00 | 0.02 | 0.02 | 0.01 | 0.02 | 0.13 | 0.25 | 0.00 |
| SEQID-00170 | P14092 | — | — | 1 | 0.63 | 0.39 | 0.05 | 0.03 | 0.04 | 0.04 | 0.00 | 0.04 | 0.02 | 0.02 | 0.02 | 0.09 | 0.28 | 0.02 |
| SEQID-00171 | Q36964 | — | 1:219 | 1 | 0.65 | 0.40 | 0.06 | 0.04 | 0.04 | 0.04 | 0.03 | 0.04 | 0.03 | 0.01 | 0.05 | 0.09 | 0.25 | 0.01 |
| SEQID-00172 | Q70RQ2 | — | — | 0 | 0.64 | 0.39 | 0.07 | 0.01 | 0.06 | 0.01 | 0.00 | 0.02 | 0.02 | 0.04 | 0.02 | 0.07 | 0.24 | 0.00 |
| SEQID-00173 | P48178 | — | — | 1 | 0.64 | 0.37 | 0.05 | 0.04 | 0.04 | 0.04 | 0.03 | 0.05 | 0.05 | 0.02 | 0.03 | 0.09 | 0.23 | 0.01 |
| SEQID-00174 | Q36090 | — | 1:133 | 1 | 0.65 | 0.35 | 0.02 | 0.05 | 0.05 | 0.05 | 0.00 | 0.04 | 0.02 | 0.03 | 0.01 | 0.07 | 0.23 | 0.01 |
| SEQID-00175 | Q31721 | — | 1:58 | 0 | 0.63 | 0.38 | 0.07 | 0.00 | 0.05 | 0.00 | 0.00 | 0.05 | 0.02 | 0.03 | 0.02 | 0.07 | 0.19 | 0.00 |
| SEQID-00176 | Q3LTZ5 | — | — | 1 | 0.67 | 0.35 | 0.05 | 0.03 | 0.07 | 0.03 | 0.02 | 0.00 | 0.05 | 0.04 | 0.03 | 0.14 | 0.20 | 0.02 |
| SEQID-00177 | A4GYW9 | — | 13:120 | 1 | 0.66 | 0.41 | 0.01 | 0.00 | 0.02 | 0.07 | 0.00 | 0.05 | 0.01 | 0.03 | 0.01 | 0.10 | 0.21 | 0.01 |
| SEQID-00178 | Q31720 | — | 150:252 | 1 | 0.64 | 0.37 | 0.06 | 0.03 | 0.02 | 0.02 | 0.03 | 0.01 | 0.03 | 0.05 | 0.02 | 0.10 | 0.22 | 0.01 |
| SEQID-00179 | P27572 | — | 6:106 | 1 | 0.61 | 0.40 | 0.01 | 0.04 | 0.02 | 0.03 | 0.00 | 0.01 | 0.01 | 0.04 | 0.01 | 0.15 | 0.21 | 0.01 |
| SEQID-00180 | P11631 | — | 360:460 | 1 | 0.67 | 0.35 | 0.03 | 0.03 | 0.03 | 0.00 | 0.04 | 0.01 | 0.01 | 0.02 | 0.05 | 0.11 | 0.23 | 0.01 |
| SEQID-00181 | Q00506 | — | 30:130 | 1 | 0.68 | 0.36 | 0.03 | 0.01 | 0.11 | 0.02 | 0.01 | 0.03 | 0.03 | 0.00 | 0.01 | 0.07 | 0.28 | 0.03 |
| SEQID-00182 | P92487 | — | 272:373 | 1 | 0.63 | 0.38 | 0.04 | 0.04 | 0.05 | 0.01 | 0.00 | 0.04 | 0.02 | 0.03 | 0.01 | 0.13 | 0.21 | 0.02 |
| SEQID-00183 | B2XW14 | — | 62:163 | 1 | 0.63 | 0.38 | 0.01 | 0.01 | 0.07 | 0.04 | 0.02 | 0.06 | 0.03 | 0.04 | 0.01 | 0.18 | 0.17 | 0.02 |
| SEQID-00184 | P27572 | — | 50:150 | 1 | 0.65 | 0.33 | 0.02 | 0.03 | 0.01 | 0.03 | 0.00 | 0.02 | 0.05 | 0.02 | 0.01 | 0.10 | 0.17 | 0.02 |
| SEQID-00185 | P27572 | — | 22:122 | 1 | 0.62 | 0.37 | 0.01 | 0.05 | 0.02 | 0.01 | 0.03 | 0.02 | 0.02 | 0.03 | 0.01 | 0.16 | 0.17 | 0.02 |
| SEQID-00186 | Q31720 | — | 130:236 | 1 | 0.68 | 0.35 | 0.04 | 0.05 | 0.00 | 0.02 | 0.02 | 0.05 | 0.02 | 0.03 | 0.01 | 0.11 | 0.17 | 0.03 |
| SEQID-00187 | O47872 | — | 43:144 | 0 | 0.69 | 0.35 | 0.01 | 0.00 | 0.05 | 0.02 | 0.02 | 0.04 | 0.05 | 0.02 | 0.01 | 0.10 | 0.18 | 0.04 |
| SEQID-00188 | P50681 | — | 105:206 | 0 | 0.70 | 0.48 | 0.04 | 0.04 | 0.02 | 0.02 | 0.00 | 0.04 | 0.03 | 0.03 | 0.02 | 0.12 | 0.32 | 0.00 |
| SEQID-00189 | P14092 | — | 14:114 | 0 | 0.69 | 0.37 | 0.04 | 0.04 | 0.05 | 0.05 | 0.01 | 0.02 | 0.03 | 0.02 | 0.02 | 0.06 | 0.30 | 0.03 |
| SEQID-00190 | O47872 | — | 69:170 | 0 | 0.63 | 0.39 | 0.06 | 0.04 | 0.04 | 0.06 | 0.00 | 0.03 | 0.00 | 0.03 | 0.02 | 0.06 | 0.32 | 0.00 |
| SEQID-00191 | P50681 | — | 54:154 | 1 | 0.68 | 0.43 | 0.03 | 0.06 | 0.03 | 0.05 | 0.02 | 0.03 | 0.02 | 0.02 | 0.04 | 0.14 | 0.27 | 0.03 |
| SEQID-00192 | Q5ZMN0 | — | 111:212 | 0 | 0.64 | 0.45 | 0.03 | 0.04 | 0.02 | 0.06 | 0.00 | 0.04 | 0.02 | 0.02 | 0.03 | 0.14 | 0.29 | 0.00 |
| SEQID-00193 | Q5ZMN0 | — | 44:93 | 0 | 0.53 | 0.36 | 0.01 | 0.08 | 0.12 | 0.05 | 0.00 | 0.02 | 0.09 | 0.02 | 0.02 | 0.06 | 0.26 | 0.07 |
| SEQID-00194 | Q5ZMN0 | — | 46:95 | 0 | 0.54 | 0.36 | 0.01 | 0.03 | 0.14 | 0.06 | 0.00 | 0.02 | 0.07 | 0.02 | 0.02 | 0.06 | 0.26 | 0.07 |
| SEQID-00195 | Q5ZMN0 | — | 47:96 | 0 | 0.52 | 0.36 | 0.01 | 0.08 | 0.14 | 0.05 | 0.00 | 0.00 | 0.07 | 0.02 | 0.02 | 0.06 | 0.26 | 0.07 |
| SEQID-00196 | Q5ZMN0 | — | 1:146 | 0 | 0.53 | 0.30 | 0.00 | 0.07 | 0.10 | 0.06 | 0.00 | 0.01 | 0.09 | 0.02 | 0.02 | 0.05 | 0.21 | 0.10 |
| SEQID-00197 | Q5ZMN0 | — | 1:147 | 0 | 0.52 | 0.30 | 0.00 | 0.07 | 0.10 | 0.05 | 0.01 | 0.01 | 0.09 | 0.02 | 0.02 | 0.05 | 0.21 | 0.10 |
| SEQID-00198 | Q5ZMN0 | — | 1:142 | 0 | 0.52 | 0.30 | 0.00 | 0.06 | 0.10 | 0.06 | 0.01 | 0.01 | 0.09 | 0.02 | 0.02 | 0.05 | 0.21 | 0.10 |
| SEQID-00199 | Q5ZMN0 | — | 1:149 | 0 | 0.52 | 0.29 | 0.00 | 0.06 | 0.10 | 0.06 | 0.01 | 0.01 | 0.09 | 0.02 | 0.02 | 0.05 | 0.21 | 0.10 |
| SEQID-00200 | Q5ZMN0 | — | 1:150 | 0 | 0.52 | 0.29 | 0.01 | 0.06 | 0.10 | 0.06 | 0.01 | 0.01 | 0.09 | 0.02 | 0.02 | 0.05 | 0.21 | 0.10 |
| SEQID-00201 | Q5ZMN0 | — | 1:151 | 0 | 0.52 | 0.29 | 0.01 | 0.06 | 0.10 | 0.06 | 0.01 | 0.01 | 0.09 | 0.02 | 0.02 | 0.05 | 0.20 | 0.10 |
| SEQID-00202 | Q5ZMN0 | — | 1:152 | 0 | 0.51 | 0.29 | 0.01 | 0.06 | 0.10 | 0.07 | 0.01 | 0.01 | 0.10 | 0.02 | 0.02 | 0.05 | 0.20 | 0.10 |
| SEQID-00203 | Q5ZMN0 | — | 1:153 | 0 | 0.51 | 0.29 | 0.01 | 0.06 | 0.10 | 0.07 | 0.01 | 0.01 | 0.10 | 0.02 | 0.02 | 0.05 | 0.20 | 0.10 |
| SEQID-00204 | Q5ZMN0 | — | 1:154 | 0 | 0.51 | 0.28 | 0.01 | 0.06 | 0.09 | 0.07 | 0.01 | 0.01 | 0.11 | 0.02 | 0.02 | 0.04 | 0.19 | 0.09 |
| SEQID-00205 | P35580 | — | 1:161 | 0 | 0.49 | 0.27 | 0.03 | 0.10 | 0.02 | 0.08 | 0.02 | 0.10 | 0.10 | 0.02 | 0.02 | 0.00 | 0.16 | 0.14 |
| SEQID-00206 | P35580 | — | 117:166 | 0 | 0.56 | 0.24 | 0.03 | 0.10 | 0.02 | 0.08 | 0.02 | 0.10 | 0.10 | 0.02 | 0.02 | 0.00 | 0.16 | 0.14 |
| SEQID-00207 | Q9ILT0 | — | 127:193 | 1 | 0.54 | 0.22 | 0.01 | 0.07 | 0.01 | 0.01 | 0.00 | 0.11 | 0.20 | 0.03 | 0.01 | 0.01 | 0.15 | 0.15 |

TABLE 1-continued

| SEQID-00208 | Q61879 | — | 152:206 | 0 | 0.43 | 0.20 | 0.04 | 0.02 | 0.02 | 0.02 | 0.00 | 0.12 | 0.33 | 0.01 | 0.02 | 0.02 | 0.16 | 0.14 |
|---|---|---|---|---|---|---|---|---|---|---|---|---|---|---|---|---|---|---|
| SEQID-00209 | Q27991 | — | 102:206 | 1 | 0.49 | 0.21 | 0.06 | 0.07 | 0.01 | 0.01 | 0.00 | 0.13 | 0.17 | 0.00 | 0.02 | 0.01 | 0.15 | 0.14 |
| SEQID-00210 | Q91LT0 | — | 127:226 | 1 | 0.49 | 0.21 | 0.05 | 0.03 | 0.01 | 0.00 | 0.00 | 0.11 | 0.23 | 0.00 | 0.03 | 0.02 | 0.15 | 0.13 |
| SEQID-00211 | Q91LT0 | — | 137:231 | 1 | 0.48 | 0.21 | 0.04 | 0.09 | 0.02 | 0.00 | 0.00 | 0.10 | 0.23 | 0.00 | 0.03 | 0.02 | 0.15 | 0.12 |
| SEQID-00212 | Q27991 | — | 141:190 | 0 | 0.51 | 0.28 | 0.04 | 0.05 | 0.00 | 0.12 | 0.00 | 0.09 | 0.15 | 0.00 | 0.02 | 0.00 | 0.23 | 0.17 |
| SEQID-00213 | Q27991 | — | 136:185 | 0 | 0.51 | 0.28 | 0.04 | 0.05 | 0.02 | 0.11 | 0.00 | 0.07 | 0.18 | 0.01 | 0.00 | 0.01 | 0.21 | 0.18 |
| SEQID-00214 | Q27991 | — | 116:185 | 0 | 0.51 | 0.27 | 0.04 | 0.04 | 0.01 | 0.08 | 0.00 | 0.11 | 0.13 | 0.00 | 0.02 | 0.02 | 0.21 | 0.17 |
| SEQID-00215 | Q27991 | — | 146:200 | 0 | 0.51 | 0.29 | 0.02 | 0.07 | 0.01 | 0.11 | 0.00 | 0.10 | 0.12 | 0.00 | 0.00 | 0.01 | 0.20 | 0.18 |
| SEQID-00216 | Q27991 | — | 146:210 | 0 | 0.52 | 0.27 | 0.03 | 0.06 | 0.01 | 0.10 | 0.00 | 0.12 | 0.12 | 0.00 | 0.02 | 0.02 | 0.21 | 0.16 |
| SEQID-00217 | Q27991 | — | 131:185 | 0 | 0.50 | 0.29 | 0.03 | 0.05 | 0.02 | 0.13 | 0.00 | 0.06 | 0.13 | 0.00 | 0.02 | 0.01 | 0.21 | 0.16 |
| SEQID-00218 | Q27991 | — | 136:190 | 0 | 0.50 | 0.27 | 0.03 | 0.05 | 0.02 | 0.11 | 0.00 | 0.08 | 0.16 | 0.00 | 0.02 | 0.02 | 0.21 | 0.15 |
| SEQID-00219 | Q27991 | — | 146:195 | 0 | 0.50 | 0.30 | 0.02 | 0.08 | 0.00 | 0.12 | 0.00 | 0.11 | 0.11 | 0.01 | 0.02 | 0.02 | 0.19 | 0.19 |
| SEQID-00220 | Q27991 | — | 126:190 | 0 | 0.52 | 0.26 | 0.03 | 0.04 | 0.02 | 0.15 | 0.00 | 0.07 | 0.14 | 0.00 | 0.02 | 0.01 | 0.21 | 0.18 |
| SEQID-00221 | Q27991 | — | 141:200 | 0 | 0.51 | 0.28 | 0.03 | 0.07 | 0.02 | 0.10 | 0.00 | 0.09 | 0.15 | 0.00 | 0.02 | 0.02 | 0.16 | 0.18 |
| SEQID-00222 | Q27991 | — | 31:80 | 0 | 0.41 | 0.20 | 0.06 | 0.03 | 0.06 | 0.06 | 0.00 | 0.11 | 0.21 | 0.01 | 0.00 | 0.02 | 0.19 | 0.14 |
| SEQID-00223 | Q27991 | — | 161:210 | 0 | 0.50 | 0.24 | 0.04 | 0.05 | 0.02 | 0.12 | 0.00 | 0.11 | 0.11 | 0.02 | 0.00 | 0.02 | 0.19 | 0.17 |
| SEQID-00224 | Q27991 | — | 126:185 | 0 | 0.53 | 0.27 | 0.03 | 0.04 | 0.02 | 0.13 | 0.00 | 0.06 | 0.15 | 0.01 | 0.01 | 0.02 | 0.19 | 0.20 |
| SEQID-00225 | Q27991 | — | 111:210 | 0 | 0.50 | 0.26 | 0.04 | 0.05 | 0.03 | 0.11 | 0.00 | 0.12 | 0.12 | 0.00 | 0.01 | 0.02 | 0.18 | 0.18 |
| SEQID-00226 | Q27991 | — | 116:215 | 0 | 0.50 | 0.26 | 0.04 | 0.04 | 0.03 | 0.12 | 0.00 | 0.12 | 0.12 | 0.00 | 0.01 | 0.03 | 0.18 | 0.18 |
| SEQID-00227 | Q27991 | — | 126:225 | 0 | 0.46 | 0.22 | 0.04 | 0.04 | 0.03 | 0.12 | 0.00 | 0.08 | 0.14 | 0.00 | 0.01 | 0.03 | 0.15 | 0.17 |
| SEQID-00228 | Q27991 | — | 126:237 | 0 | 0.45 | 0.21 | 0.05 | 0.03 | 0.03 | 0.11 | 0.00 | 0.07 | 0.17 | 0.01 | 0.01 | 0.03 | 0.15 | 0.18 |
| SEQID-00229 | Q91LT0 | — | 124:174 | 0 | 0.40 | 0.22 | 0.04 | 0.13 | 0.06 | 0.06 | 0.00 | 0.06 | 0.21 | 0.01 | 0.00 | 0.02 | 0.19 | 0.06 |
| SEQID-00230 | Q91LT0 | — | 194:244 | 0 | 0.45 | 0.20 | 0.11 | 0.03 | 0.04 | 0.00 | 0.00 | 0.11 | 0.21 | 0.02 | 0.02 | 0.04 | 0.14 | 0.20 |
| SEQID-00231 | Q27991 | — | 139:227 | 0 | 0.41 | 0.20 | 0.03 | 0.08 | 0.08 | 0.09 | 0.00 | 0.00 | 0.18 | 0.01 | 0.01 | 0.03 | 0.15 | 0.20 |
| SEQID-00232 | Q61879 | — | 154:252 | 0 | 0.41 | 0.19 | 0.09 | 0.11 | 0.05 | 0.03 | 0.02 | 0.08 | 0.16 | 0.01 | 0.02 | 0.03 | 0.14 | 0.11 |
| SEQID-00233 | P15989 | — | 99:308 | 0 | 0.52 | 0.37 | 0.07 | 0.05 | 0.04 | 0.03 | 0.00 | 0.04 | 0.08 | 0.04 | 0.00 | 0.02 | 0.17 | 0.15 |
| SEQID-00234 | P15989 | — | 99:203 | 0 | 0.51 | 0.37 | 0.07 | 0.07 | 0.04 | 0.07 | 0.00 | 0.05 | 0.08 | 0.04 | 0.01 | 0.13 | 0.16 | 0.03 |
| SEQID-00235 | P15989 | — | 49:166 | 0 | 0.44 | 0.28 | 0.10 | 0.06 | 0.04 | 0.06 | 0.00 | 0.05 | 0.09 | 0.05 | 0.00 | 0.13 | 0.15 | 0.03 |
| SEQID-00236 | Q90339 | — | 201:265 | 0 | 0.45 | 0.21 | 0.06 | 0.06 | 0.02 | 0.11 | 0.00 | 0.12 | 0.16 | 0.02 | 0.00 | 0.07 | 0.18 | 0.04 |
| SEQID-00237 | Q8BE41 | — | 216:265 | 0 | 0.48 | 0.21 | 0.04 | 0.08 | 0.02 | 0.10 | 0.00 | 0.07 | 0.18 | 0.02 | 0.00 | 0.00 | 0.18 | 0.15 |
| SEQID-00238 | Q8MIV0 | — | 146:200 | 0 | 0.56 | 0.21 | 0.05 | 0.00 | 0.04 | 0.09 | 0.00 | 0.00 | 0.23 | 0.02 | 0.02 | 0.04 | 0.14 | 0.20 |
| SEQID-00239 | Q91TV62 | — | 241:290 | 0 | 0.48 | 0.17 | 0.02 | 0.08 | 0.02 | 0.09 | 0.00 | 0.08 | 0.19 | 0.01 | 0.00 | 0.04 | 0.15 | 0.22 |
| SEQID-00240 | Q5SX39 | — | 236:285 | 0 | 0.45 | 0.19 | 0.02 | 0.08 | 0.00 | 0.12 | 0.02 | 0.09 | 0.17 | 0.01 | 0.02 | 0.02 | 0.15 | 0.21 |
| SEQID-00241 | Q91V61 | — | 151:265 | 0 | 0.52 | 0.21 | 0.05 | 0.04 | 0.02 | 0.10 | 0.00 | 0.07 | 0.18 | 0.01 | 0.00 | 0.02 | 0.17 | 0.20 |
| SEQID-00242 | Q79102 | — | 55:104 | 1 | 0.75 | 0.53 | 0.07 | 0.03 | 0.03 | 0.00 | 0.00 | 0.04 | 0.02 | 0.01 | 0.02 | 0.02 | 0.16 | 0.19 |
| SEQID-00243 | Q32B19 | — | 192:241 | 1 | 0.66 | 0.47 | 0.05 | 0.00 | 0.00 | 0.04 | 0.00 | 0.05 | 0.02 | 0.04 | 0.00 | 0.08 | 0.42 | 0.00 |
| SEQID-00244 | P18937 | — | 119:170 | 1 | 0.71 | 0.46 | 0.04 | 0.03 | 0.02 | 0.05 | 0.02 | 0.00 | 0.02 | 0.06 | 0.02 | 0.08 | 0.43 | 0.00 |
| SEQID-00245 | P18937 | — | 106:157 | 1 | 0.73 | 0.43 | 0.05 | 0.00 | 0.02 | 0.05 | 0.00 | 0.04 | 0.03 | 0.07 | 0.03 | 0.06 | 0.37 | 0.02 |
| SEQID-00246 | Q90592 | — | 200:250 | 1 | 0.69 | 0.43 | 0.01 | 0.00 | 0.02 | 0.00 | 0.00 | 0.04 | 0.00 | 0.01 | 0.02 | 0.04 | 0.36 | 0.02 |
| SEQID-00247 | Q90592 | — | 152:250 | 1 | 0.61 | 0.40 | 0.07 | 0.03 | 0.06 | 0.04 | 0.01 | 0.00 | 0.02 | 0.03 | 0.02 | 0.07 | 0.39 | 0.00 |
| SEQID-00248 | O47868 | — | 56:109 | 1 | 0.69 | 0.44 | 0.05 | 0.03 | 0.05 | 0.02 | 0.00 | 0.00 | 0.02 | 0.04 | 0.00 | 0.04 | 0.30 | 0.02 |
| SEQID-00249 | O47868 | — | 11:109 | 1 | 0.65 | 0.44 | 0.09 | 0.03 | 0.05 | 0.02 | 0.00 | 0.02 | 0.07 | 0.04 | 0.01 | 0.07 | 0.39 | 0.00 |
| SEQID-00250 | A1L504 | — | 57:107 | 1 | 0.65 | 0.37 | 0.05 | 0.03 | 0.02 | 0.03 | 0.00 | 0.05 | 0.00 | 0.04 | 0.05 | 0.00 | 0.31 | 0.05 |
| SEQID-00251 | A1L504 | — | 260:327 | 1 | 0.63 | 0.44 | 0.06 | 0.06 | 0.05 | 0.06 | 0.00 | 0.02 | 0.02 | 0.02 | 0.02 | 0.03 | 0.40 | 0.00 |
| SEQID-00252 | Q32LM8 | — | 203:253 | 1 | 0.63 | 0.37 | 0.04 | 0.11 | 0.00 | 0.02 | 0.00 | 0.07 | 0.07 | 0.03 | 0.03 | 0.00 | 0.30 | 0.05 |
| SEQID-00253 | Q767L9 | — | 139:230 | 1 | 0.66 | 0.44 | 0.03 | 0.06 | 0.02 | 0.07 | 0.00 | 0.01 | 0.00 | 0.03 | 0.05 | 0.03 | 0.39 | 0.02 |
| SEQID-00254 | Q32LM8 | — | 150:230 | 1 | 0.63 | 0.43 | 0.03 | 0.07 | 0.00 | 0.03 | 0.02 | 0.01 | 0.04 | 0.03 | 0.04 | 0.03 | 0.31 | 0.02 |
| SEQID-00255 | Q6F4F5 | — | 6:55 | 0 | 0.70 | 0.45 | 0.05 | 0.03 | 0.05 | 0.00 | 0.01 | 0.00 | 0.04 | 0.03 | 0.05 | 0.02 | 0.32 | 0.03 |
| SEQID-00256 | Q6F4F5 | — | 1:52 | 1 | 0.70 | 0.46 | 0.05 | 0.00 | 0.05 | 0.02 | 0.00 | 0.00 | 0.02 | 0.05 | 0.02 | 0.02 | 0.38 | 0.05 |
| SEQID-00257 | Q35920 | — | 58:111 | 1 | 0.73 | 0.41 | 0.02 | 0.03 | 0.02 | 0.06 | 0.00 | 0.00 | 0.05 | 0.04 | 0.02 | 0.05 | 0.37 | 0.05 |
| SEQID-00258 | P49208 | — | 1:50 | 0 | 0.69 | 0.39 | 0.00 | 0.00 | 0.02 | 0.02 | 0.02 | 0.02 | 0.00 | 0.01 | 0.05 | 0.02 | 0.36 | 0.02 |
| SEQID-00259 | P00729 | — | 2:52 | 0 | 0.60 | 0.35 | 0.07 | 0.18 | 0.00 | 0.00 | 0.02 | 0.05 | 0.02 | 0.04 | 0.03 | 0.02 | 0.31 | 0.08 |
| SEQID-00260 | Q58CT4 | — | 337:386 | 0 | 0.69 | 0.43 | 0.03 | 0.03 | 0.02 | 0.02 | 0.04 | 0.00 | 0.02 | 0.05 | 0.03 | 0.02 | 0.34 | 0.05 |

TABLE 1-continued

| | | | | | | | | | | | | | | |
|---|---|---|---|---|---|---|---|---|---|---|---|---|---|---|
| SEQID-00261 | Q06639 | 422:473 | 0 | 0.64 | 0.43 | 0.00 | 0.03 | 0.10 | 0.04 | 0.02 | 0.04 | 0.01 | 0.02 | 0.06 | 0.34 | 0.02 |
| SEQID-00262 | Q9UKT8 | 15:69 | 0 | 0.61 | 0.37 | 0.01 | 0.05 | 0.05 | 0.05 | 0.00 | 0.06 | 0.02 | 0.02 | 0.02 | 0.32 | 0.06 |
| SEQID-00263 | A1A4P6 | 17:68 | 0 | 0.64 | 0.41 | 0.02 | 0.00 | 0.00 | 0.02 | 0.03 | 0.00 | 0.02 | 0.01 | 0.02 | 0.34 | 0.02 |
| SEQID-00264 | Q9TV61 | 102:344 | 0 | 0.44 | 0.19 | 0.06 | 0.06 | 0.02 | 0.08 | 0.01 | 0.08 | 0.21 | 0.01 | 0.04 | 0.12 | 0.17 |
| SEQID-00265 | Q27991 | 20:289 | 0 | 0.38 | 0.20 | 0.06 | 0.10 | 0.03 | 0.07 | 0.00 | 0.09 | 0.20 | 0.01 | 0.02 | 0.15 | 0.13 |
| SEQID-00266 | — | — | 0 | 0.52 | 0.26 | 0.03 | 0.04 | 0.01 | 0.15 | 0.00 | 0.07 | 0.14 | 0.01 | 0.02 | 0.22 | 0.18 |
| SEQID-00267 | — | — | 0 | 0.52 | 0.26 | 0.03 | 0.04 | 0.01 | 0.15 | 0.00 | 0.07 | 0.14 | 0.01 | 0.00 | 0.25 | 0.18 |
| SEQID-00268 | — | — | 0 | 0.52 | 0.28 | 0.02 | 0.04 | 0.01 | 0.15 | 0.00 | 0.07 | 0.13 | 0.01 | 0.00 | 0.28 | 0.17 |
| SEQID-00269 | — | — | 0 | 0.53 | 0.31 | 0.03 | 0.04 | 0.00 | 0.15 | 0.00 | 0.07 | 0.13 | 0.01 | 0.00 | 0.31 | 0.17 |
| SEQID-00270 | — | — | 0 | 0.56 | 0.33 | 0.02 | 0.04 | 0.00 | 0.15 | 0.00 | 0.07 | 0.13 | 0.01 | 0.00 | 0.33 | 0.16 |
| SEQID-00271 | — | — | 0 | 0.57 | 0.36 | 0.00 | 0.04 | 0.00 | 0.15 | 0.00 | 0.07 | 0.13 | 0.01 | 0.00 | 0.36 | 0.16 |
| SEQID-00272 | — | — | 0 | 0.53 | 0.28 | 0.02 | 0.04 | 0.00 | 0.15 | 0.00 | 0.07 | 0.13 | 0.01 | 0.00 | 0.28 | 0.18 |
| SEQID-00273 | — | — | 0 | 0.56 | 0.31 | 0.01 | 0.04 | 0.00 | 0.15 | 0.00 | 0.07 | 0.13 | 0.01 | 0.00 | 0.31 | 0.18 |
| SEQID-00274 | — | — | 0 | 0.57 | 0.33 | 0.00 | 0.04 | 0.00 | 0.15 | 0.00 | 0.07 | 0.13 | 0.01 | 0.00 | 0.33 | 0.18 |
| SEQID-00275 | — | — | 0 | 0.58 | 0.36 | 0.00 | 0.04 | 0.00 | 0.15 | 0.00 | 0.07 | 0.13 | 0.00 | 0.00 | 0.36 | 0.16 |
| SEQID-00276 | — | — | 0 | 0.60 | 0.36 | 0.01 | 0.02 | 0.00 | 0.15 | 0.00 | 0.07 | 0.13 | 0.01 | 0.00 | 0.36 | 0.18 |
| SEQID-00277 | Q1WLP9 | 170:263 | 1 | 0.67 | 0.33 | 0.06 | 0.02 | 0.01 | 0.00 | 0.04 | 0.01 | 0.05 | 0.01 | 0.04 | 0.14 | 0.11 |
| SEQID-00278 | A3DBX3 | — | 1 | 0.43 | 0.15 | 0.02 | 0.06 | 0.07 | 0.07 | 0.00 | 0.02 | 0.05 | 0.05 | 0.01 | 0.05 | 0.07 |
| SEQID-00279 | — | — | 0 | 0.57 | 0.35 | 0.00 | 0.04 | 0.00 | 0.15 | 0.00 | 0.07 | 0.13 | 0.01 | 0.00 | 0.35 | 0.16 |
| SEQID-00280 | — | — | 0 | 0.57 | 0.35 | 0.01 | 0.04 | 0.00 | 0.15 | 0.00 | 0.07 | 0.13 | 0.00 | 0.00 | 0.35 | 0.18 |
| SEQID-00281 | P05804 | 51:75 | 1 | 0.46 | 0.19 | 0.05 | 0.07 | 0.05 | 0.07 | 0.01 | 0.06 | 0.05 | 0.04 | 0.05 | 0.07 | 0.05 |
| SEQID-00282 | O60167 | 53:105 | 1 | 0.75 | 0.32 | 0.00 | 0.05 | 0.00 | 0.00 | 0.03 | 0.04 | 0.08 | 0.00 | 0.04 | 0.15 | 0.13 |
| SEQID-00283 | Q0WVK7 | 149:261 | 1 | 0.57 | 0.27 | 0.01 | 0.14 | 0.02 | 0.05 | 0.03 | 0.02 | 0.06 | 0.05 | 0.04 | 0.12 | 0.12 |
| SEQID-00284 | Q94A52 | 556:615 | 1 | 0.54 | 0.26 | 0.02 | 0.10 | 0.06 | 0.04 | 0.02 | 0.03 | 0.11 | 0.01 | 0.03 | 0.12 | 0.10 |
| SEQID-00285 | Q5F479 | 177:230 | 1 | 0.64 | 0.28 | 0.03 | 0.13 | 0.05 | 0.02 | 0.01 | 0.02 | 0.11 | 0.00 | 0.06 | 0.14 | 0.11 |
| SEQID-00286 | Q08213 | 1093:1165 | 1 | 0.65 | 0.31 | 0.00 | 0.05 | 0.04 | 0.04 | 0.03 | 0.04 | 0.06 | 0.02 | 0.04 | 0.14 | 0.12 |
| SEQID-00287 | P38111 | — | 1 | 0.59 | 0.30 | 0.02 | 0.05 | 0.05 | 0.05 | 0.01 | 0.01 | 0.06 | 0.01 | 0.07 | 0.13 | 0.11 |
| SEQID-00288 | O93262 | — | 1 | 0.55 | 0.27 | 0.02 | 0.06 | 0.02 | 0.10 | 0.03 | 0.06 | 0.06 | 0.01 | 0.08 | 0.13 | 0.10 |
| SEQID-00289 | O64837 | — | 1 | 0.61 | 0.26 | 0.07 | 0.06 | 0.02 | 0.06 | 0.01 | 0.02 | 0.07 | 0.03 | 0.06 | 0.13 | 0.09 |
| SEQID-00290 | Q54K39 | — | 1 | 0.53 | 0.28 | 0.03 | 0.05 | 0.03 | 0.03 | 0.01 | 0.02 | 0.10 | 0.05 | 0.03 | 0.12 | 0.09 |
| SEQID-00291 | P38111 | 1093:1182 | 1 | 0.57 | 0.27 | 0.03 | 0.03 | 0.06 | 0.04 | 0.00 | 0.04 | 0.09 | 0.05 | 0.03 | 0.11 | 0.09 |
| SEQID-00292 | P38111 | 1093:1162 | 1 | 0.57 | 0.27 | 0.02 | 0.04 | 0.06 | 0.02 | 0.00 | 0.03 | 0.06 | 0.01 | 0.07 | 0.13 | 0.10 |
| SEQID-00293 | P38111 | 1092:1166 | 1 | 0.59 | 0.29 | 0.04 | 0.04 | 0.03 | 0.03 | 0.04 | 0.04 | 0.07 | 0.03 | 0.07 | 0.13 | 0.11 |
| SEQID-00294 | P33111 | 1093:1168 | 1 | 0.58 | 0.29 | 0.02 | 0.04 | 0.04 | 0.04 | 0.00 | 0.01 | 0.06 | 0.01 | 0.08 | 0.13 | 0.10 |
| SEQID-00295 | P38111 | 1091:1164 | 1 | 0.59 | 0.30 | 0.02 | 0.07 | 0.03 | 0.05 | 0.00 | 0.04 | 0.06 | 0.01 | 0.08 | 0.13 | 0.11 |
| SEQID-00296 | P38111 | 1089:1164 | 1 | 0.58 | 0.29 | 0.02 | 0.09 | 0.03 | 0.09 | 0.01 | 0.04 | 0.08 | 0.01 | 0.09 | 0.13 | 0.10 |
| SEQID-00297 | P02190 | — | 1 | 0.58 | 0.20 | 0.07 | 0.06 | 0.04 | 0.06 | 0.02 | 0.01 | 0.03 | 0.05 | 0.06 | 0.11 | 0.14 |
| SEQID-00298 | P02192 | — | 1 | 0.59 | 0.20 | 0.07 | 0.02 | 0.02 | 0.07 | 0.01 | 0.04 | 0.07 | 0.04 | 0.05 | 0.11 | 0.14 |
| SEQID-00299 | P02189 | — | 1 | 0.56 | 0.21 | 0.06 | 0.04 | 0.02 | 0.05 | 0.00 | 0.03 | 0.05 | 0.05 | 0.08 | 0.12 | 0.14 |
| SEQID-00300 | F1RJW7 | — | 1 | 0.45 | 0.21 | 0.04 | 0.03 | 0.03 | 0.03 | 0.04 | 0.02 | 0.11 | 0.02 | 0.07 | 0.13 | 0.11 |
| SEQID-00301 | Q05JF3 | — | 1 | 0.44 | 0.21 | 0.05 | 0.03 | 0.04 | 0.14 | 0.03 | 0.02 | 0.15 | 0.02 | 0.05 | 0.10 | 0.07 |
| SEQID-00302 | 406710553 | — | 1 | 0.49 | 0.26 | 0.08 | 0.04 | 0.02 | 0.12 | 0.01 | 0.04 | 0.16 | 0.05 | 0.02 | 0.10 | 0.07 |
| SEQID-00303 | 406715845 | — | 1 | 0.46 | 0.23 | 0.05 | 0.07 | 0.03 | 0.07 | 0.01 | 0.05 | 0.09 | 0.04 | 0.02 | 0.12 | 0.09 |
| SEQID-00304 | 406711970 | — | 1 | 0.44 | 0.23 | 0.02 | 0.09 | 0.03 | 0.09 | 0.01 | 0.04 | 0.08 | 0.04 | 0.04 | 0.08 | 0.06 |
| SEQID-00305 | A6QLL8 | — | 1 | 0.44 | 0.21 | 0.03 | 0.06 | 0.04 | 0.04 | 0.02 | 0.04 | 0.04 | 0.04 | 0.07 | 0.09 | 0.06 |
| SEQID-00306 | B7TJ13 | — | 1 | 0.52 | 0.23 | 0.06 | 0.04 | 0.05 | 0.06 | 0.00 | 0.05 | 0.03 | 0.05 | 0.06 | 0.10 | 0.09 |
| SEQID-00307 | P39824 | — | 1 | 0.51 | 0.22 | 0.07 | 0.06 | 0.06 | 0.07 | 0.01 | 0.02 | 0.07 | 0.04 | 0.05 | 0.10 | 0.12 |
| SEQID-00308 | P25152 | — | 1 | 0.43 | 0.21 | 0.07 | 0.04 | 0.04 | 0.04 | 0.00 | 0.02 | 0.05 | 0.03 | 0.08 | 0.09 | 0.11 |
| SEQID-00309 | O32150 | — | 1 | 0.40 | 0.16 | 0.05 | 0.04 | 0.05 | 0.05 | 0.00 | 0.04 | 0.09 | 0.04 | 0.06 | 0.09 | 0.11 |
| SEQID-00310 | Q9K6A3 | — | 1 | 0.39 | 0.14 | 0.05 | 0.06 | 0.07 | 0.14 | 0.03 | 0.02 | 0.06 | 0.05 | 0.03 | 0.06 | 0.06 |
| SEQID-00311 | P42249 | — | 1 | 0.38 | 0.14 | 0.07 | 0.07 | 0.04 | 0.15 | 0.03 | 0.05 | 0.07 | 0.03 | 0.03 | 0.06 | 0.02 |
| SEQID-00312 | D3FTP5 | — | 1 | 0.47 | 0.23 | 0.03 | 0.14 | 0.05 | 0.05 | 0.03 | 0.06 | 0.09 | 0.04 | 0.06 | 0.10 | 0.03 |
| SEQID-00313 | P39844 | — | 1 | 0.49 | 0.23 | 0.05 | 0.04 | 0.04 | 0.04 | 0.00 | 0.03 | 0.07 | 0.05 | 0.05 | 0.11 | 0.10 |

TABLE 1-continued

| SEQID | Code | Range | Flag | V1 | V2 | V3 | V4 | V5 | V6 | V7 | V8 | V9 | V10 | V11 | V12 | V13 | V14 |
|---|---|---|---|---|---|---|---|---|---|---|---|---|---|---|---|---|---|
| SEQID-00314 | P38422 | — | — | 1 | 0.55 | 0.18 | 0.06 | 0.04 | 0.04 | 0.04 | 0.00 | 0.02 | 0.10 | 0.04 | 0.01 | 0.05 | 0.09 | 0.16 |
| SEQID-00315 | P96600 | — | — | 1 | 0.49 | 0.20 | 0.04 | 0.03 | 0.06 | 0.06 | 0.00 | 0.06 | 0.10 | 0.05 | 0.02 | 0.07 | 0.10 | 0.10 |
| SEQID-00316 | P39597 | — | — | 1 | 0.47 | 0.16 | 0.05 | 0.05 | 0.04 | 0.07 | 0.01 | 0.07 | 0.06 | 0.03 | 0.01 | 0.04 | 0.09 | 0.11 |
| SEQID-00317 | Q9K6W0 | — | — | 1 | 0.41 | 0.20 | 0.05 | 0.09 | 0.07 | 0.04 | 0.01 | 0.07 | 0.08 | 0.03 | 0.01 | 0.07 | 0.08 | 0.04 |
| SEQID-00318 | O05512 | — | — | 1 | 0.47 | 0.19 | 0.05 | 0.04 | 0.07 | 0.07 | 0.01 | 0.04 | 0.05 | 0.03 | 0.03 | 0.06 | 0.09 | 0.07 |
| SEQID-00319 | E6TXL6 | — | — | 1 | 0.48 | 0.21 | 0.05 | 0.05 | 0.06 | 0.07 | 0.01 | 0.05 | 0.07 | 0.03 | 0.04 | 0.06 | 0.08 | 0.07 |
| SEQID-00320 | Q9K742 | — | — | 1 | 0.42 | 0.18 | 0.04 | 0.14 | 0.04 | 0.06 | 0.01 | 0.02 | 0.13 | 0.03 | 0.03 | 0.06 | 0.08 | 0.06 |
| SEQID-00321 | P37548 | — | — | 1 | 0.49 | 0.22 | 0.03 | 0.08 | 0.04 | 0.09 | 0.00 | 0.02 | 0.07 | 0.03 | 0.05 | 0.07 | 0.08 | 0.07 |
| SEQID-00322 | O31526 | — | — | 1 | 0.43 | 0.18 | 0.04 | 0.07 | 0.03 | 0.06 | 0.01 | 0.04 | 0.04 | 0.03 | 0.02 | 0.04 | 0.08 | 0.10 |
| SEQID-00323 | O07544 | — | — | 1 | 0.46 | 0.20 | 0.03 | 0.07 | 0.02 | 0.02 | 0.02 | 0.03 | 0.10 | 0.03 | 0.03 | 0.04 | 0.09 | 0.07 |
| SEQID-00324 | O32123 | — | — | 1 | 0.44 | 0.16 | 0.03 | 0.07 | 0.02 | 0.04 | 0.01 | 0.08 | 0.03 | 0.04 | 0.04 | 0.04 | 0.09 | 0.10 |
| SEQID-00325 | P46784 | — | — | 1 | 0.42 | 0.18 | 0.02 | 0.07 | 0.03 | 0.04 | 0.00 | 0.06 | 0.10 | 0.02 | 0.04 | 0.04 | 0.08 | 0.06 |
| SEQID-00326 | 406713168 | — | — | 1 | 0.44 | 0.19 | 0.03 | 0.08 | 0.04 | 0.02 | 0.02 | 0.03 | 0.10 | 0.02 | 0.02 | 0.04 | 0.10 | 0.09 |
| SEQID-00327 | C3AUB3 | — | — | 1 | 0.53 | 0.25 | 0.04 | 0.04 | 0.05 | 0.03 | 0.00 | 0.09 | 0.10 | 0.03 | 0.02 | 0.09 | 0.10 | 0.05 |
| SEQID-00328 | 291571454 | — | — | 1 | 0.45 | 0.17 | 0.08 | 0.20 | 0.06 | 0.06 | 0.00 | 0.06 | 0.03 | 0.02 | 0.01 | 0.06 | 0.07 | 0.12 |
| SEQID-00329 | O82579 | — | — | 1 | 0.47 | 0.22 | 0.02 | 0.20 | 0.02 | 0.03 | 0.01 | 0.03 | 0.06 | 0.03 | 0.01 | 0.06 | 0.09 | 0.14 |
| SEQID-00330 | P0CX55 | — | — | 1 | 0.49 | 0.22 | 0.03 | 0.15 | 0.05 | 0.07 | 0.00 | 0.05 | 0.05 | 0.02 | 0.04 | 0.05 | 0.06 | 0.12 |
| SEQID-00331 | P00648 | — | — | 1 | 0.51 | 0.19 | 0.06 | 0.06 | 0.04 | 0.04 | 0.01 | 0.06 | 0.05 | 0.06 | 0.06 | 0.07 | 0.10 | 0.08 |
| SEQID-00332 | 291572097 | — | — | 1 | 0.45 | 0.22 | 0.06 | 0.09 | 0.03 | 0.03 | 0.01 | 0.03 | 0.04 | 0.03 | 0.03 | 0.06 | 0.08 | 0.10 |
| SEQID-00333 | C3B4Y1 | — | — | 1 | 0.52 | 0.23 | 0.02 | 0.15 | 0.03 | 0.05 | 0.00 | 0.05 | 0.07 | 0.03 | 0.03 | 0.05 | 0.13 | 0.04 |
| SEQID-00334 | C6TFG0 | — | — | 1 | 0.42 | 0.21 | 0.04 | 0.06 | 0.06 | 0.06 | 0.01 | 0.03 | 0.05 | 0.02 | 0.03 | 0.07 | 0.11 | 0.10 |
| SEQID-00335 | 291571495 | — | — | 1 | 0.38 | 0.22 | 0.05 | 0.18 | 0.04 | 0.02 | 0.00 | 0.04 | 0.03 | 0.04 | 0.05 | 0.03 | 0.11 | 0.03 |
| SEQID-00336 | B4FL64 | — | — | 1 | 0.46 | 0.15 | 0.06 | 0.19 | 0.05 | 0.07 | 0.00 | 0.05 | 0.07 | 0.02 | 0.04 | 0.03 | 0.11 | 0.05 |
| SEQID-00337 | I1K8X7 | — | — | 1 | 0.46 | 0.19 | 0.05 | 0.06 | 0.02 | 0.02 | 0.01 | 0.03 | 0.07 | 0.03 | 0.03 | 0.04 | 0.07 | 0.18 |
| SEQID-00338 | P07170 | — | — | 1 | 0.47 | 0.21 | 0.06 | 0.10 | 0.03 | 0.07 | 0.00 | 0.07 | 0.05 | 0.04 | 0.03 | 0.04 | 0.08 | 0.09 |
| SEQID-00339 | F0TI61 | — | — | 1 | 0.47 | 0.21 | 0.04 | 0.11 | 0.04 | 0.09 | 0.00 | 0.09 | 0.06 | 0.03 | 0.03 | 0.07 | 0.10 | 0.10 |
| SEQID-00340 | 406715507 | — | — | 1 | 0.41 | 0.23 | 0.06 | 0.06 | 0.05 | 0.06 | 0.00 | 0.09 | 0.09 | 0.04 | 0.05 | 0.06 | 0.11 | 0.09 |
| SEQID-00341 | P29311 | — | — | 1 | 0.39 | 0.18 | 0.06 | 0.15 | 0.03 | 0.03 | 0.00 | 0.03 | 0.07 | 0.03 | 0.02 | 0.10 | 0.07 | 0.06 |
| SEQID-00342 | P33673 | — | — | 1 | 0.47 | 0.15 | 0.02 | 0.06 | 0.03 | 0.04 | 0.01 | 0.08 | 0.13 | 0.03 | 0.03 | 0.05 | 0.09 | 0.07 |
| SEQID-00343 | I1LLC0 | — | — | 1 | 0.46 | 0.22 | 0.04 | 0.10 | 0.04 | 0.07 | 0.02 | 0.04 | 0.05 | 0.04 | 0.01 | 0.04 | 0.08 | 0.10 |
| SEQID-00344 | 291571381 | — | — | 1 | 0.39 | 0.22 | 0.05 | 0.11 | 0.03 | 0.07 | 0.00 | 0.05 | 0.10 | 0.04 | 0.05 | 0.06 | 0.09 | 0.10 |
| SEQID-00345 | 291567248 | — | — | 1 | 0.42 | 0.21 | 0.07 | 0.20 | 0.02 | 0.08 | 0.00 | 0.08 | 0.06 | 0.02 | 0.03 | 0.05 | 0.09 | 0.04 |
| SEQID-00346 | 291569666 | — | — | 1 | 0.45 | 0.21 | 0.05 | 0.07 | 0.06 | 0.06 | 0.02 | 0.08 | 0.07 | 0.03 | 0.02 | 0.05 | 0.10 | 0.06 |
| SEQID-00347 | H8XE54 | — | — | 1 | 0.48 | 0.18 | 0.07 | 0.03 | 0.05 | 0.05 | 0.01 | 0.06 | 0.10 | 0.04 | 0.03 | 0.06 | 0.09 | 0.07 |
| SEQID-00348 | B5DG39 | — | — | 1 | 0.59 | 0.29 | 0.09 | 0.05 | 0.03 | 0.05 | 0.01 | 0.03 | 0.07 | 0.05 | 0.06 | 0.03 | 0.09 | 0.13 |
| SEQID-00349 | 291567247 | — | — | 1 | 0.45 | 0.21 | 0.03 | 0.05 | 0.03 | 0.05 | 0.01 | 0.04 | 0.08 | 0.05 | 0.05 | 0.05 | 0.11 | 0.10 |
| SEQID-00350 | P28675 | — | — | 1 | 0.49 | 0.21 | 0.06 | 0.09 | 0.04 | 0.07 | 0.02 | 0.04 | 0.07 | 0.05 | 0.05 | 0.05 | 0.10 | 0.05 |
| SEQID-00351 | I1MJC7 | — | — | 1 | 0.52 | 0.27 | 0.06 | 0.06 | 0.03 | 0.03 | 0.00 | 0.02 | 0.08 | 0.06 | 0.01 | 0.07 | 0.14 | 0.08 |
| SEQID-00352 | B4G0K4 | — | — | 1 | 0.54 | 0.27 | 0.03 | 0.04 | 0.07 | 0.03 | 0.00 | 0.01 | 0.09 | 0.05 | 0.01 | 0.05 | 0.13 | 0.11 |
| SEQID-00353 | P45741 | — | — | 1 | 0.43 | 0.26 | 0.06 | 0.03 | 0.02 | 0.03 | 0.01 | 0.07 | 0.05 | 0.03 | 0.01 | 0.05 | 0.12 | 0.12 |
| SEQID-00354 | B7TJ13 | — | — | 1 | 0.52 | 0.23 | 0.06 | 0.05 | 0.05 | 0.05 | 0.00 | 0.07 | 0.05 | 0.05 | 0.02 | 0.05 | 0.10 | 0.06 |
| SEQID-00355 | P50448 | — | — | 1 | 0.51 | 0.24 | 0.04 | 0.03 | 0.07 | 0.06 | 0.02 | 0.06 | 0.06 | 0.03 | 0.03 | 0.07 | 0.10 | 0.12 |
| SEQID-00356 | I1MBR7 | — | — | 1 | 0.50 | 0.27 | 0.05 | 0.05 | 0.05 | 0.05 | 0.01 | 0.03 | 0.09 | 0.04 | 0.02 | 0.10 | 0.14 | 0.06 |
| SEQID-00357 | 291570796 | — | — | 1 | 0.48 | 0.28 | 0.05 | 0.05 | 0.05 | 0.05 | 0.01 | 0.06 | 0.09 | 0.04 | 0.02 | 0.07 | 0.12 | 0.09 |
| SEQID-00358 | 291569660 | — | — | 1 | 0.47 | 0.18 | 0.03 | 0.09 | 0.03 | 0.05 | 0.02 | 0.08 | 0.08 | 0.04 | 0.04 | 0.05 | 0.11 | 0.07 |
| SEQID-00359 | 291566695 | — | — | 1 | 0.42 | 0.23 | 0.05 | 0.14 | 0.03 | 0.03 | 0.01 | 0.03 | 0.07 | 0.05 | 0.04 | 0.05 | 0.08 | 0.06 |
| SEQID-00360 | Q42795 | — | — | 1 | 0.45 | 0.21 | 0.04 | 0.05 | 0.04 | 0.06 | 0.01 | 0.05 | 0.07 | 0.03 | 0.03 | 0.07 | 0.11 | 0.04 |
| SEQID-00361 | C5IWV2 | — | — | 1 | 0.44 | 0.20 | 0.04 | 0.10 | 0.04 | 0.04 | 0.01 | 0.07 | 0.09 | 0.04 | 0.03 | 0.05 | 0.06 | 0.07 |
| SEQID-00362 | P11412 | — | — | 1 | 0.47 | 0.21 | 0.04 | 0.07 | 0.04 | 0.05 | 0.00 | 0.03 | 0.05 | 0.03 | 0.02 | 0.05 | 0.09 | 0.10 |
| SEQID-00363 | P69328 | 25:640 | — | 1 | 0.42 | 0.17 | 0.07 | 0.04 | 0.04 | 0.08 | 0.01 | 0.00 | 0.09 | 0.04 | 0.01 | 0.04 | 0.07 | 0.02 |
| SEQID-00364 | F1NXK1 | 1220:1292 | — | 0 | 0.33 | 0.07 | 0.02 | 0.05 | 0.00 | 0.06 | 0.00 | 0.03 | 0.35 | 0.02 | 0.03 | 0.04 | 0.00 | 0.12 |
| SEQID-00365 | P02702 | 81:162 | — | 1 | 0.44 | 0.10 | 0.01 | 0.11 | 0.06 | 0.05 | 0.03 | 0.04 | 0.08 | 0.02 | 0.04 | 0.02 | 0.05 | 0.08 |
| SEQID-00366 | P38158 | 118:186 | — | 0 | 0.48 | 0.07 | 0.03 | 0.09 | 0.07 | 0.06 | 0.00 | 0.02 | 0.06 | 0.03 | 0.00 | 0.01 | 0.04 | 0.09 |

TABLE 1-continued

| SEQID | Code | | Range | | | | | | | | | | | | | | |
|---|---|---|---|---|---|---|---|---|---|---|---|---|---|---|---|---|---|
| SEQID-00367 | Q12329 | — | 69:133 | 0 | 0.11 | 0.01 | 0.02 | 0.07 | 0.12 | 0.01 | 0.09 | 0.12 | 0.05 | 0.02 | 0.00 | 0.00 | 0.00 |
| SEQID-00368 | I3LP30 | — | 84:159 | 1 | 0.51 | 0.29 | 0.02 | 0.06 | 0.04 | 0.00 | 0.01 | 0.17 | 0.00 | 0.10 | 0.17 | 0.07 |
| SEQID-00369 | F1MZX6 | — | 1169:1337 | 0 | 0.48 | 0.23 | 0.06 | 0.03 | 0.12 | 0.03 | 0.00 | 0.20 | 0.12 | 0.05 | 0.03 | 0.17 | 0.11 |
| SEQID-00370 | I3KZL6 | — | 1621:1693 | 1 | 0.37 | 0.23 | 0.03 | 0.08 | 0.04 | 0.07 | 0.00 | 0.17 | 0.14 | 0.02 | 0.04 | 0.16 | 0.06 |
| SEQID-00371 | K7TNK3 | — | 1070:1154 | 1 | 0.36 | 0.18 | 0.05 | 0.01 | 0.08 | 0.04 | 0.01 | 0.16 | 0.24 | 0.05 | 0.03 | 0.12 | 0.05 |
| SEQID-00372 | 291570621 | | 821:890 | 1 | 0.40 | 0.21 | 0.02 | 0.03 | 0.13 | 0.05 | 0.00 | 0.12 | 0.11 | 0.02 | 0.07 | 0.11 | 0.05 |
| SEQID-00373 | 291572019 | | 775:851 | 1 | 0.37 | 0.21 | 0.02 | 0.01 | 0.12 | 0.06 | 0.01 | 0.11 | 0.10 | 0.03 | 0.09 | 0.09 | 0.04 |
| SEQID-00374 | P38427 | — | 534:617 | 1 | 0.44 | 0.21 | 0.04 | 0.02 | 0.17 | 0.06 | 0.00 | 0.11 | 0.05 | 0.00 | 0.04 | 0.09 | 0.05 |
| SEQID-00375 | A6QP89 | — | 288:356 | 0 | 0.45 | 0.21 | 0.03 | 0.01 | 0.19 | 0.06 | 0.01 | 0.03 | 0.06 | 0.03 | 0.06 | 0.08 | 0.13 |
| SEQID-00376 | I1JDH6 | — | 29:142 | 1 | 0.48 | 0.25 | 0.04 | 0.02 | 0.17 | 0.06 | 0.00 | 0.05 | 0.09 | 0.05 | 0.08 | 0.08 | 0.10 |
| SEQID-00377 | 406710335 | | 6:235 | 0 | 0.37 | 0.17 | 0.03 | 0.03 | 0.03 | 0.03 | 0.01 | 0.25 | 0.09 | 0.01 | 0.02 | 0.11 | 0.10 |
| SEQID-00378 | I3JTN2 | — | 3518:3693 | 1 | 0.38 | 0.17 | 0.04 | 0.02 | 0.02 | 0.04 | 0.01 | 0.16 | 0.19 | 0.01 | 0.04 | 0.09 | 0.06 |
| SEQID-00379 | F1NPH8 | — | 520:646 | 1 | 0.39 | 0.20 | 0.05 | 0.07 | 0.03 | 0.03 | 0.02 | 0.25 | 0.14 | 0.02 | 0.01 | 0.14 | 0.10 |
| SEQID-00380 | F1NPH8 | — | 673:746 | 1 | 0.43 | 0.25 | 0.04 | 0.02 | 0.11 | 0.02 | 0.02 | 0.06 | 0.15 | 0.04 | 0.03 | 0.20 | 0.08 |
| SEQID-00381 | G3MYN5 | — | 12:124 | 1 | 0.46 | 0.25 | 0.06 | 0.04 | 0.15 | 0.06 | 0.02 | 0.03 | 0.20 | 0.02 | 0.03 | 0.18 | 0.07 |
| SEQID-00382 | G3MYN5 | — | 88:158 | 1 | 0.50 | 0.23 | 0.03 | 0.01 | 0.19 | 0.08 | 0.02 | 0.03 | 0.13 | 0.02 | 0.03 | 0.14 | 0.12 |
| SEQID-00383 | C6TFG0 | — | 19:88 | 0 | 0.36 | 0.22 | 0.03 | 0.05 | 0.24 | 0.03 | 0.00 | 0.00 | 0.03 | 0.00 | 0.01 | 0.17 | 0.17 |
| SEQID-00384 | C6TFG0 | — | 42:140 | 1 | 0.46 | 0.25 | 0.04 | 0.06 | 0.21 | 0.06 | 0.01 | 0.01 | 0.12 | 0.03 | 0.03 | 0.15 | 0.06 |
| SEQID-00385 | P0C0X0 | — | | 0 | 0.47 | 0.27 | 0.02 | 0.07 | 0.21 | 0.03 | 0.00 | 0.04 | 0.10 | 0.02 | 0.04 | 0.09 | 0.05 |
| SEQID-00386 | 291568762 | | | 0 | 0.39 | 0.26 | 0.03 | 0.02 | 0.08 | 0.05 | 0.01 | 0.02 | 0.10 | 0.00 | 0.04 | 0.12 | 0.07 |
| SEQID-00387 | B4FKR5 | — | 1:169 | 1 | 0.49 | 0.25 | 0.05 | 0.02 | 0.07 | 0.08 | 0.00 | 0.10 | 0.08 | 0.03 | 0.02 | 0.08 | 0.05 |
| SEQID-00388 | B4FKR5 | — | | 1 | 0.49 | 0.25 | 0.05 | 0.07 | 0.07 | 0.03 | 0.02 | 0.04 | 0.08 | 0.05 | 0.01 | 0.08 | 0.13 |
| SEQID-00389 | 291567798 | | | 0 | 0.44 | 0.26 | 0.04 | 0.05 | 0.13 | 0.08 | 0.00 | 0.05 | 0.08 | 0.05 | 0.01 | 0.08 | 0.13 |
| SEQID-00390 | P39824 | — | 37:306 | 1 | 0.43 | 0.22 | 0.07 | 0.07 | 0.06 | 0.02 | 0.02 | 0.04 | 0.06 | 0.06 | 0.01 | 0.08 | 0.11 |
| SEQID-00391 | P39844 | — | 30:491 | 1 | 0.46 | 0.22 | 0.05 | 0.05 | 0.04 | 0.04 | 0.01 | 0.05 | 0.08 | 0.03 | 0.08 | 0.09 | 0.10 |
| SEQID-00392 | P96600 | — | 19:350 | 1 | 0.48 | 0.20 | 0.03 | 0.04 | 0.03 | 0.06 | 0.00 | 0.03 | 0.10 | 0.05 | 0.02 | 0.11 | 0.10 |
| SEQID-00393 | P39597 | — | 29:416 | 1 | 0.47 | 0.17 | 0.05 | 0.05 | 0.05 | 0.05 | 0.00 | 0.07 | 0.06 | 0.03 | 0.04 | 0.09 | 0.10 |
| SEQID-00394 | O05512 | — | 27:362 | 0 | 0.45 | 0.17 | 0.05 | 0.07 | 0.04 | 0.05 | 0.01 | 0.07 | 0.06 | 0.05 | 0.04 | 0.09 | 0.11 |
| SEQID-00395 | P45741 | — | 31:409 | 1 | 0.41 | 0.22 | 0.06 | 0.03 | 0.24 | 0.08 | 0.00 | 0.02 | 0.05 | 0.04 | 0.03 | 0.08 | 0.06 |
| SEQID-00396 | P25959 | — | 29:124 | 1 | 0.45 | 0.21 | 0.01 | 0.03 | 0.06 | 0.03 | 0.01 | 0.10 | 0.12 | 0.03 | 0.02 | 0.11 | 0.09 |
| SEQID-00397 | P54450 | — | 45:250 | 1 | 0.50 | 0.18 | 0.03 | 0.08 | 0.10 | 0.06 | 0.01 | 0.03 | 0.05 | 0.02 | 0.04 | 0.10 | 0.13 |
| SEQID-00398 | P37965 | — | 27:293 | 1 | 0.52 | 0.21 | 0.04 | 0.04 | 0.04 | 0.04 | 0.00 | 0.05 | 0.07 | 0.04 | 0.06 | 0.08 | 0.13 |
| SEQID-00399 | O34966 | — | 31:319 | 1 | 0.49 | 0.19 | 0.05 | 0.05 | 0.00 | 0.06 | 0.00 | 0.05 | 0.12 | 0.03 | 0.05 | 0.11 | 0.13 |
| SEQID-00400 | P54427 | — | 24:267 | 1 | 0.52 | 0.19 | 0.03 | 0.04 | 0.07 | 0.04 | 0.00 | 0.05 | 0.08 | 0.02 | 0.05 | 0.08 | 0.10 |
| SEQID-00401 | P39632 | — | 31:154 | 1 | 0.51 | 0.25 | 0.05 | 0.06 | 0.05 | 0.07 | 0.00 | 0.02 | 0.07 | 0.01 | 0.06 | 0.11 | 0.07 |
| SEQID-00402 | O34348 | — | 29:315 | 1 | 0.50 | 0.22 | 0.05 | 0.05 | 0.04 | 0.09 | 0.02 | 0.05 | 0.09 | 0.03 | 0.03 | 0.08 | 0.14 |
| SEQID-00403 | P25152 | — | 25:455 | 1 | 0.46 | 0.20 | 0.05 | 0.07 | 0.11 | 0.06 | 0.00 | 0.04 | 0.06 | 0.03 | 0.07 | 0.12 | 0.14 |
| SEQID-00404 | P71014 | — | 29:181 | 1 | 0.49 | 0.18 | 0.04 | 0.06 | 0.06 | 0.05 | 0.01 | 0.02 | 0.10 | 0.04 | 0.05 | 0.06 | 0.11 |
| SEQID-00405 | P94522 | — | 33:323 | 1 | 0.43 | 0.17 | 0.05 | 0.04 | 0.04 | 0.03 | 0.02 | 0.03 | 0.06 | 0.06 | 0.04 | 0.12 | 0.08 |
| SEQID-00406 | P54507 | — | 28:261 | 1 | 0.48 | 0.20 | 0.04 | 0.04 | 0.04 | 0.06 | 0.00 | 0.03 | 0.03 | 0.02 | 0.05 | 0.09 | 0.07 |
| SEQID-00407 | P00691 | — | 34:659 | 1 | 0.42 | 0.16 | 0.05 | 0.05 | 0.06 | 0.10 | 0.02 | 0.05 | 0.05 | 0.03 | 0.04 | 0.08 | 0.15 |
| SEQID-00408 | A2QLC7 | — | 19:265 | 1 | 0.41 | 0.19 | 0.06 | 0.08 | 0.05 | 0.07 | 0.00 | 0.04 | 0.04 | 0.02 | 0.06 | 0.06 | 0.06 |
| SEQID-00409 | A2QEJ9 | — | 17:443 | 1 | 0.44 | 0.16 | 0.05 | 0.05 | 0.08 | 0.07 | 0.02 | 0.02 | 0.08 | 0.03 | 0.06 | 0.09 | 0.02 |
| SEQID-00410 | A2QXG2 | — | 21:338 | 1 | 0.49 | 0.25 | 0.05 | 0.05 | 0.04 | 0.06 | 0.00 | 0.03 | 0.05 | 0.04 | 0.05 | 0.08 | 0.06 |
| SEQID-00411 | A2QUK3 | — | 20:392 | 1 | 0.42 | 0.19 | 0.05 | 0.04 | 0.11 | 0.06 | 0.00 | 0.05 | 0.06 | 0.02 | 0.08 | 0.12 | 0.04 |
| SEQID-00412 | A2QAC1 | — | 15:865 | 1 | 0.43 | 0.19 | 0.04 | 0.04 | 0.06 | 0.08 | 0.01 | 0.03 | 0.05 | 0.03 | 0.05 | 0.06 | 0.04 |
| SEQID-00413 | A2QII1 | — | 18:375 | 1 | 0.44 | 0.18 | 0.05 | 0.05 | 0.04 | 0.08 | 0.02 | 0.03 | 0.04 | 0.04 | 0.04 | 0.08 | 0.04 |
| SEQID-00414 | A2QAN3 | — | 19:1007 | 1 | 0.44 | 0.20 | 0.04 | 0.04 | 0.04 | 0.06 | 0.00 | 0.03 | 0.06 | 0.05 | 0.05 | 0.10 | 0.05 |
| SEQID-00415 | A2QWU9 | — | 21:931 | 1 | 0.45 | 0.22 | 0.04 | 0.06 | 0.06 | 0.07 | 0.00 | 0.05 | 0.05 | 0.04 | 0.04 | 0.08 | 0.04 |
| SEQID-00416 | A2QFE24 | — | 24:403 | 1 | 0.45 | 0.20 | 0.04 | 0.04 | 0.04 | 0.08 | 0.01 | 0.07 | 0.05 | 0.03 | 0.06 | 0.11 | 0.04 |
| SEQID-00417 | A2QFV7 | — | 20:327 | 1 | 0.47 | 0.16 | 0.07 | 0.03 | 0.03 | 0.07 | 0.01 | 0.03 | 0.05 | 0.02 | 0.05 | 0.07 | 0.08 |
| SEQID-00418 | A2RAR6 | — | 23:416 | 1 | 0.43 | 0.16 | 0.06 | 0.04 | 0.05 | 0.04 | 0.01 | 0.07 | 0.04 | 0.03 | 0.03 | 0.07 | 0.04 |
| SEQID-00419 | B0YIR9 | — | 20:860 | 1 | 0.39 | 0.18 | 0.06 | 0.07 | 0.06 | 0.07 | 0.01 | 0.04 | 0.07 | 0.01 | 0.04 | 0.08 | 0.04 |

TABLE 1-continued

| SEQID | ID | | | | | | | | | | | | | | |
|---|---|---|---|---|---|---|---|---|---|---|---|---|---|---|---|
| SEQID-00420 | A2QCV8 | — | 1 | 0.49 | 0.19 | 0.04 | 0.02 | 0.06 | 0.08 | 0.03 | 0.03 | 0.04 | 0.07 | 0.02 | 0.08 | 0.05 | 0.10 |
| SEQID-00421 | P56526 | — | 1 | 0.43 | 0.19 | 0.06 | 0.05 | 0.06 | 0.06 | 0.05 | 0.01 | 0.05 | 0.04 | 0.03 | 0.04 | 0.08 | 0.03 |
| SEQID-00422 | A2QUZ1 | 19:362 | 1 | 0.38 | 0.15 | 0.06 | 0.05 | 0.06 | 0.09 | 0.02 | 0.00 | 0.05 | 0.05 | 0.00 | 0.03 | 0.06 | 0.07 |
| SEQID-00423 | P00692 | 20.985 | 1 | 0.43 | 0.15 | 0.04 | 0.06 | 0.05 | 0.03 | 0.05 | 0.00 | 0.07 | 0.05 | 0.04 | 0.06 | 0.07 | 0.07 |
| SEQID-00424 | P0C1B3 | 20:458 | 1 | 0.43 | 0.19 | 0.05 | 0.03 | 0.06 | 0.09 | 0.02 | 0.01 | 0.03 | 0.05 | 0.02 | 0.05 | 0.07 | 0.05 |
| SEQID-00425 | P00723 | 32:514 | 1 | 0.47 | 0.19 | 0.03 | 0.05 | 0.06 | 0.07 | 0.03 | 0.00 | 0.09 | 0.03 | 0.03 | 0.06 | 0.08 | 0.09 |
| SEQID-00426 | O59952 | 22:499 | 0 | 0.42 | 0.20 | 0.05 | 0.07 | 0.07 | 0.05 | 0.03 | 0.02 | 0.05 | 0.04 | 0.02 | 0.06 | 0.08 | 0.03 |
| SEQID-00427 | D4PHA8 | — | 1 | 0.44 | 0.21 | 0.09 | 0.03 | 0.05 | 0.14 | 0.03 | 0.00 | 0.05 | 0.05 | 0.03 | 0.07 | 0.09 | 0.05 |
| SEQID-00428 | P19515 | 23:291 | 0 | 0.55 | 0.00 | 0.02 | 0.04 | 0.01 | 0.07 | 0.06 | 0.00 | 0.13 | 0.01 | 0.02 | 0.00 | 0.00 | 0.16 |
| SEQID-00429 | P06278 | 95:363 | 0 | 0.56 | 0.00 | 0.02 | 0.04 | 0.01 | 0.14 | 0.06 | 0.00 | 0.13 | 0.01 | 0.02 | 0.00 | 0.00 | 0.16 |
| SEQID-00430 | NA | — | 0 | 0.55 | 0.00 | 0.02 | 0.04 | 0.01 | 0.14 | 0.06 | 0.00 | 0.13 | 0.01 | 0.02 | 0.00 | 0.00 | 0.16 |
| SEQID-00431 | NA | — | 0 | 0.56 | 0.00 | 0.02 | 0.04 | 0.01 | 0.14 | 0.06 | 0.00 | 0.13 | 0.01 | 0.37 | 0.00 | 0.00 | 0.16 |
| SEQID-00432 | NA | — | 0 | 0.55 | 0.00 | 0.02 | 0.04 | 0.01 | 0.13 | 0.06 | 0.00 | 0.12 | 0.01 | 0.37 | 0.00 | 0.00 | 0.50 |
| SEQID-00433 | NA | — | 0 | 0.20 | 0.00 | 0.02 | 0.42 | 0.00 | 0.14 | 0.40 | 0.00 | 0.13 | 0.01 | 0.02 | 0.00 | 0.00 | 0.15 |
| SEQID-00434 | NA | — | 0 | 0.22 | 0.00 | 0.02 | 0.04 | 0.01 | 0.14 | 0.03 | 0.00 | 0.13 | 0.01 | 0.02 | 0.00 | 0.00 | 0.16 |
| SEQID-00435 | NA | — | 0 | 0.30 | 0.28 | 0.02 | 0.34 | 0.00 | 0.13 | 0.00 | 0.00 | 0.13 | 0.01 | 0.00 | 0.00 | 0.28 | 0.16 |
| SEQID-00436 | NA | — | 1 | 0.72 | 0.22 | 0.00 | 0.00 | 0.00 | 0.14 | 0.00 | 0.00 | 0.00 | 0.00 | 0.00 | 0.00 | 0.13 | 0.00 |
| SEQID-00437 | NA | — | 0 | 1.00 | 0.26 | 0.00 | 0.04 | 0.00 | 0.07 | 0.00 | 0.00 | 0.13 | 0.00 | 0.07 | 0.04 | 0.17 | 0.21 |
| SEQID-00438 | NA | — | 0 | 0.53 | 0.31 | 0.02 | 0.04 | 0.01 | 0.15 | 0.07 | 0.00 | 0.13 | 0.01 | 0.12 | 0.04 | 0.19 | 0.35 |
| SEQID-00439 | NA | — | 0 | 0.53 | 0.30 | 0.02 | 0.04 | 0.01 | 0.14 | 0.07 | 0.00 | 0.13 | 0.01 | 0.02 | 0.12 | 0.19 | 0.17 |
| SEQID-00440 | NA | — | 0 | 0.55 | 0.18 | 0.02 | 0.04 | 0.01 | 0.15 | 0.06 | 0.00 | 0.13 | 0.01 | 0.02 | 0.00 | 0.19 | 0.17 |
| SEQID-00441 | NA | — | 0 | 0.57 | 0.18 | 0.02 | 0.04 | 0.01 | 0.14 | 0.06 | 0.00 | 0.12 | 0.01 | 0.02 | 0.00 | 0.18 | 0.16 |
| SEQID-00442 | NA | — | 0 | 0.53 | 0.19 | 0.02 | 0.04 | 0.02 | 0.15 | 0.06 | 0.00 | 0.14 | 0.01 | 0.02 | 0.00 | 0.18 | 0.15 |
| SEQID-00443 | NA | — | 0 | 0.54 | 0.19 | 0.02 | 0.04 | 0.01 | 0.16 | 0.07 | 0.00 | 0.13 | 0.01 | 0.02 | 0.00 | 0.19 | 0.17 |
| SEQID-00444 | NA | — | 0 | 0.54 | 0.20 | 0.02 | 0.04 | 0.01 | 0.15 | 0.06 | 0.00 | 0.13 | 0.01 | 0.14 | 0.00 | 0.19 | 0.16 |
| SEQID-00445 | NA | — | 0 | 0.41 | 0.19 | 0.02 | 0.04 | 0.01 | 0.15 | 0.07 | 0.20 | 0.13 | 0.01 | 0.02 | 0.00 | 0.19 | 0.16 |
| SEQID-00446 | NA | — | 0 | 0.32 | 0.28 | 0.02 | 0.27 | 0.00 | 0.14 | 0.06 | 0.00 | 0.13 | 0.00 | 0.00 | 0.00 | 0.28 | 0.16 |
| SEQID-00447 | NA | — | 0 | 0.58 | 0.19 | 0.02 | 0.00 | 0.01 | 0.15 | 0.07 | 0.00 | 0.14 | 0.01 | 0.00 | 0.00 | 0.19 | 0.35 |
| SEQID-00448 | NA | — | 0 | 0.21 | 0.18 | 0.02 | 0.39 | 0.01 | 0.14 | 0.06 | 0.00 | 0.12 | 0.00 | 0.00 | 0.00 | 0.18 | 0.00 |
| SEQID-00449 | NA | — | 0 | 0.53 | 0.31 | 0.02 | 0.04 | 0.01 | 0.15 | 0.07 | 0.00 | 0.13 | 0.02 | 0.02 | 0.31 | 0.00 | 0.17 |
| SEQID-00450 | NA | — | 0 | 0.51 | 0.28 | 0.02 | 0.04 | 0.02 | 0.16 | 0.07 | 0.00 | 0.14 | 0.01 | 0.02 | 0.00 | 0.00 | 0.17 |
| SEQID-00451 | NA | — | 0 | 0.57 | 0.00 | 0.02 | 0.04 | 0.01 | 0.14 | 0.06 | 0.00 | 0.12 | 0.00 | 0.02 | 0.00 | 0.00 | 0.15 |
| SEQID-00452 | NA | — | 0 | 0.61 | 0.00 | 0.02 | 0.03 | 0.01 | 0.12 | 0.06 | 0.00 | 0.11 | 0.00 | 0.01 | 0.00 | 0.00 | 0.14 |
| SEQID-00453 | NA | — | 0 | 0.52 | 0.00 | 0.02 | 0.04 | 0.02 | 0.15 | 0.07 | 0.00 | 0.14 | 0.00 | 0.02 | 0.00 | 0.00 | 0.17 |
| SEQID-00454 | NA | — | 0 | 0.59 | 0.78 | 0.00 | 0.41 | 0.00 | 0.00 | 0.00 | 0.00 | 0.00 | 0.00 | 0.00 | 0.00 | 0.00 | 0.30 |
| SEQID-00455 | NA | — | 0 | 0.69 | 0.40 | 0.00 | 0.30 | 0.00 | 0.00 | 0.00 | 0.00 | 0.00 | 0.00 | 0.00 | 0.00 | 0.28 | 0.30 |
| SEQID-00456 | NA | — | 0 | 0.71 | 0.51 | 0.00 | 0.00 | 0.00 | 0.30 | 0.00 | 0.00 | 0.00 | 0.00 | 0.00 | 0.00 | 0.40 | 0.26 |
| SEQID-00457 | NA | — | 0 | 0.32 | 0.32 | 0.00 | 0.29 | 0.00 | 0.30 | 0.00 | 0.00 | 0.38 | 0.00 | 0.00 | 0.00 | 0.51 | 0.20 |
| SEQID-00458 | NA | — | 0 | 0.43 | 0.43 | 0.00 | 0.00 | 0.00 | 0.29 | 0.06 | 0.00 | 0.27 | 0.00 | 0.00 | 0.00 | 0.32 | 0.00 |
| SEQID-00459 | NA | — | 0 | 0.55 | 0.55 | 0.00 | 0.00 | 0.00 | 0.20 | 0.00 | 0.00 | 0.34 | 0.00 | 0.00 | 0.00 | 0.43 | 0.00 |
| SEQID-00460 | NA | — | 0 | 0.41 | 0.30 | 0.00 | 0.25 | 0.00 | 0.20 | 0.00 | 0.00 | 0.26 | 0.00 | 0.00 | 0.00 | 0.55 | 0.00 |
| SEQID-00461 | NA | — | 0 | 0.49 | 0.40 | 0.00 | 0.27 | 0.00 | 0.15 | 0.00 | 0.00 | 0.19 | 0.00 | 0.00 | 0.00 | 0.30 | 0.12 |
| SEQID-00462 | NA | — | 0 | 0.62 | 0.53 | 0.00 | 0.15 | 0.00 | 0.12 | 0.00 | 0.00 | 0.12 | 0.00 | 0.00 | 0.00 | 0.40 | 0.08 |
| SEQID-00463 | NA | — | 0 | 0.59 | 0.28 | 0.00 | 0.41 | 0.00 | 0.13 | 0.00 | 0.00 | 0.11 | 0.00 | 0.00 | 0.00 | 0.53 | 0.09 |
| SEQID-00464 | NA | — | 0 | 0.62 | 0.36 | 0.00 | 0.33 | 0.00 | 0.00 | 0.00 | 0.00 | 0.00 | 0.00 | 0.00 | 0.00 | 0.28 | 0.30 |
| SEQID-00465 | NA | — | 0 | 0.71 | 0.46 | 0.00 | 0.29 | 0.00 | 0.30 | 0.00 | 0.00 | 0.38 | 0.00 | 0.00 | 0.00 | 0.36 | 0.26 |
| SEQID-00466 | NA | — | 0 | 0.32 | 0.32 | 0.00 | 0.00 | 0.00 | 0.24 | 0.00 | 0.00 | 0.34 | 0.00 | 0.00 | 0.00 | 0.46 | 0.25 |
| SEQID-00467 | NA | — | 0 | 0.40 | 0.40 | 0.00 | 0.00 | 0.00 | 0.20 | 0.00 | 0.00 | 0.26 | 0.00 | 0.00 | 0.00 | 0.32 | 0.00 |
| SEQID-00468 | NA | — | 0 | 0.50 | 0.50 | 0.00 | 0.00 | 0.00 | 0.19 | 0.00 | 0.00 | 0.14 | 0.00 | 0.00 | 0.00 | 0.40 | 0.00 |
| SEQID-00469 | NA | — | 0 | 0.42 | 0.30 | 0.00 | 0.25 | 0.00 | 0.17 | 0.00 | 0.00 | 0.12 | 0.00 | 0.00 | 0.00 | 0.50 | 0.12 |
| SEQID-00470 | NA | — | 0 | 0.50 | 0.38 | 0.00 | 0.19 | 0.00 | 0.00 | 0.00 | 0.00 | 0.05 | 0.00 | 0.00 | 0.00 | 0.30 | 0.12 |
| SEQID-00471 | NA | — | 0 | 0.58 | 0.48 | 0.00 | 0.19 | 0.00 | 0.00 | 0.00 | 0.00 | 0.10 | 0.00 | 0.00 | 0.00 | 0.38 | 0.10 |
| SEQID-00472 | NA | — | 0 | 0.57 | 0.25 | 0.00 | 0.43 | 0.00 | 0.00 | 0.00 | 0.00 | 0.00 | 0.00 | 0.00 | 0.00 | 0.25 | 0.32 |

TABLE 1-continued

| | | | | | | | | | | | | | | |
|---|---|---|---|---|---|---|---|---|---|---|---|---|---|---|
| SEQID-00473 | NA | — | 0 | 0.75 | 0.37 | 0.00 | 0.00 | 0.00 | 0.00 | 0.00 | 0.00 | 0.00 | 0.00 | 0.37 | 0.38 |
| SEQID-00474 | NA | — | 0 | 0.67 | 0.46 | 0.00 | 0.24 | 0.00 | 0.00 | 0.00 | 0.00 | 0.00 | 0.00 | 0.46 | 0.22 |
| SEQID-00475 | NA | — | 0 | 0.28 | 0.28 | 0.00 | 0.32 | 0.00 | 0.00 | 0.00 | 0.00 | 0.00 | 0.00 | 0.28 | 0.00 |
| SEQID-00476 | NA | — | 0 | 0.00 | 0.40 | 0.00 | 0.00 | 0.00 | 0.00 | 0.00 | 0.00 | 0.00 | 0.00 | 0.40 | 0.00 |
| SEQID-00477 | NA | — | 0 | 0.49 | 0.49 | 0.00 | 0.24 | 0.00 | 0.00 | 0.00 | 0.00 | 0.00 | 0.00 | 0.49 | 0.00 |
| SEQID-00478 | NA | — | 0 | 0.40 | 0.17 | 0.00 | 0.00 | 0.00 | 0.00 | 0.00 | 0.22 | 0.00 | 0.00 | 0.27 | 0.13 |
| SEQID-00479 | NA | — | 0 | 0.52 | 0.37 | 0.00 | 0.24 | 0.00 | 0.00 | 0.00 | 0.29 | 0.00 | 0.00 | 0.37 | 0.15 |
| SEQID-00480 | NA | — | 0 | 0.62 | 0.48 | 0.07 | 0.29 | 0.00 | 0.00 | 0.00 | 0.20 | 0.00 | 0.00 | 0.48 | 0.14 |
| SEQID-00481 | K9HYS1 | — | 1 | 0.54 | 0.22 | 0.04 | 0.11 | 0.03 | 0.05 | 0.00 | 0.12 | 0.02 | 0.06 | 0.11 | 0.05 |
| SEQID-00482 | P39929 | — | 1 | 0.44 | 0.20 | 0.04 | 0.07 | 0.08 | 0.06 | 0.00 | 0.20 | 0.02 | 0.02 | 0.09 | 0.10 |
| SEQID-00483 | F1MLW7 | — | 1 | 0.42 | 0.19 | 0.04 | 0.05 | 0.03 | 0.04 | 0.03 | 0.39 | 0.05 | 0.01 | 0.08 | 0.05 |
| SEQID-00484 | P17891 | — | 1 | 0.38 | 0.19 | 0.04 | 0.04 | 0.03 | 0.03 | 0.00 | 0.22 | 0.02 | 0.01 | 0.08 | 0.11 |
| SEQID-00485 | G1K3R9 | — | 1 | 0.46 | 0.14 | 0.05 | 0.06 | 0.05 | 0.04 | 0.03 | 0.29 | 0.05 | 0.05 | 0.06 | 0.09 |
| SEQID-00486 | O78750 | — | 1 | 0.56 | 0.16 | 0.05 | 0.06 | 0.06 | 0.03 | 0.01 | 0.20 | 0.02 | 0.08 | 0.06 | 0.09 |
| SEQID-00487 | D5A2W2 | — | 1 | 0.61 | 0.27 | 0.02 | 0.04 | 0.02 | 0.03 | 0.01 | 0.12 | 0.04 | 0.08 | 0.14 | 0.03 |
| SEQID-00488 | K9HRR8 | — | 1 | 0.52 | 0.27 | 0.03 | 0.05 | 0.00 | 0.03 | 0.02 | 0.08 | 0.02 | 0.09 | 0.09 | 0.05 |
| SEQID-00489 | P07260 | — | 1 | 0.52 | 0.21 | 0.04 | 0.05 | 0.05 | 0.04 | 0.00 | 0.16 | 0.04 | 0.03 | 0.08 | 0.05 |
| SEQID-00490 | K1WPG5 | — | 1 | 0.52 | 0.20 | 0.03 | 0.04 | 0.04 | 0.03 | 0.03 | 0.03 | 0.03 | 0.06 | 0.09 | 0.10 |
| SEQID-00491 | D7SYA1 | — | 1 | 0.53 | 0.34 | 0.06 | 0.06 | 0.04 | 0.03 | 0.00 | 0.16 | 0.04 | 0.05 | 0.17 | 0.01 |
| SEQID-00492 | D7SLS3 | — | 1 | 0.46 | 0.15 | 0.05 | 0.19 | 0.05 | 0.03 | 0.01 | 0.03 | 0.04 | 0.01 | 0.07 | 0.18 |
| SEQID-00493 | A5PJM2 | — | 1 | 0.42 | 0.16 | 0.03 | 0.21 | 0.03 | 0.02 | 0.02 | 0.02 | 0.02 | 0.03 | 0.06 | 0.10 |
| SEQID-00494 | B9VGZ5 | — | 1 | 0.42 | 0.14 | 0.04 | 0.15 | 0.04 | 0.06 | 0.02 | 0.06 | 0.05 | 0.04 | 0.09 | 0.10 |
| SEQID-00495 | D7UC61 | — | 1 | 0.57 | 0.32 | 0.05 | 0.05 | 0.05 | 0.05 | 0.00 | 0.05 | 0.03 | 0.02 | 0.15 | 0.12 |
| SEQID-00496 | P52286 | — | 1 | 0.46 | 0.15 | 0.09 | 0.04 | 0.04 | 0.04 | 0.01 | 0.17 | 0.02 | 0.02 | 0.06 | 0.10 |
| SEQID-00497 | P49435 | — | 0 | 0.38 | 0.18 | 0.05 | 0.09 | 0.03 | 0.04 | 0.00 | 0.13 | 0.01 | 0.05 | 0.07 | 0.19 |
| SEQID-00498 | K1VXA7 | — | 1 | 0.50 | 0.26 | 0.03 | 0.03 | 0.04 | 0.09 | 0.01 | 0.11 | 0.04 | 0.01 | 0.14 | 0.06 |
| SEQID-00499 | B6UT23 | — | 1 | 0.49 | 0.30 | 0.05 | 0.09 | 0.05 | 0.04 | 0.04 | 0.08 | 0.04 | 0.07 | 0.15 | 0.09 |
| SEQID-00500 | Q67VZ0 | — | 1 | 0.34 | 0.17 | 0.18 | 0.12 | 0.01 | 0.05 | 0.06 | 0.05 | 0.03 | 0.03 | 0.08 | 0.06 |
| SEQID-00501 | K9HZV3 | — | 1 | 0.40 | 0.16 | 0.03 | 0.10 | 0.09 | 0.03 | 0.03 | 0.04 | 0.09 | 0.09 | 0.06 | 0.04 |
| SEQID-00502 | C6SZX7 | — | 0 | 0.50 | 0.16 | 0.03 | 0.04 | 0.04 | 0.03 | 0.00 | 0.05 | 0.05 | 0.02 | 0.06 | 0.01 |
| SEQID-00503 | B4FFR7 | — | 1 | 0.43 | 0.20 | 0.05 | 0.03 | 0.05 | 0.05 | 0.02 | 0.07 | 0.04 | 0.04 | 0.09 | 0.05 |
| SEQID-00504 | K9HEB9 | — | 1 | 0.49 | 0.14 | 0.07 | 0.14 | 0.03 | 0.07 | 0.01 | 0.06 | 0.04 | 0.05 | 0.05 | 0.22 |
| SEQID-00505 | Q3SYR8 | — | 1 | 0.47 | 0.21 | 0.06 | 0.07 | 0.02 | 0.02 | 0.02 | 0.03 | 0.03 | 0.05 | 0.06 | 0.06 |
| SEQID-00506 | K9I599 | — | 1 | 0.42 | 0.21 | 0.03 | 0.09 | 0.08 | 0.02 | 0.04 | 0.07 | 0.03 | 0.07 | 0.06 | 0.02 |
| SEQID-00507 | K9HG54 | — | 1 | 0.62 | 0.29 | 0.07 | 0.04 | 0.02 | 0.02 | 0.02 | 0.04 | 0.02 | 0.06 | 0.12 | 0.06 |
| SEQID-00508 | D7U394 | — | 1 | 0.51 | 0.14 | 0.05 | 0.11 | 0.06 | 0.06 | 0.00 | 0.07 | 0.08 | 0.11 | 0.06 | 0.05 |
| SEQID-00509 | Q3IJ07 | — | 1 | 0.54 | 0.25 | 0.05 | 0.10 | 0.09 | 0.03 | 0.02 | 0.07 | 0.07 | 0.03 | 0.07 | 0.10 |
| SEQID-00510 | G1NCP5 | — | 1 | 0.43 | 0.22 | 0.05 | 0.07 | 0.03 | 0.07 | 0.02 | 0.06 | 0.04 | 0.05 | 0.07 | 0.08 |
| SEQID-00511 | K1WAW9 | — | 1 | 0.44 | 0.13 | 0.03 | 0.04 | 0.03 | 0.03 | 0.00 | 0.07 | 0.04 | 0.04 | 0.11 | 0.19 |
| SEQID-00512 | Q8H920 | — | 1 | 0.52 | 0.15 | 0.04 | 0.06 | 0.05 | 0.01 | 0.02 | 0.16 | 0.03 | 0.05 | 0.06 | 0.10 |
| SEQID-00513 | P06673 | — | 0 | 3.44 | 0.73 | 0.16 | 0.06 | 0.02 | 0.04 | 0.00 | 0.08 | 0.06 | 0.02 | 0.07 | 0.22 |
| SEQID-00514 | D4ZPH7 | — | 1 | 0.40 | 0.70 | 0.05 | 0.06 | 0.03 | 0.02 | 0.02 | 0.05 | 0.03 | 0.03 | 0.16 | 0.14 |
| SEQID-00515 | Q08969 | — | 1 | 0.45 | 0.17 | 0.05 | 0.11 | 0.00 | 0.03 | 0.02 | 0.03 | 0.07 | 0.01 | 0.11 | 0.05 |
| SEQID-00516 | P04037 | — | 1 | 0.38 | 0.21 | 0.17 | 0.11 | 0.03 | 0.05 | 0.03 | 0.14 | 0.05 | 0.01 | 0.16 | 0.16 |
| SEQID-00517 | P04449 | — | 0 | 0.33 | 0.16 | 0.05 | 0.10 | 0.04 | 0.01 | 0.04 | 0.04 | 0.02 | 0.06 | 0.11 | 0.01 |
| SEQID-00518 | F0TTG9 | — | 1 | 0.46 | 0.26 | 0.07 | 0.07 | 0.02 | 0.00 | 0.17 | 0.08 | 0.04 | 0.01 | 0.07 | 0.01 |
| SEQID-00519 | B6UD91 | — | 1 | 0.25 | 0.05 | 0.01 | 0.01 | 0.06 | 0.03 | 0.06 | 0.08 | 0.07 | 0.06 | 0.04 | 0.12 |
| SEQID-00520 | P63246 | — | 1 | 0.46 | 0.22 | 0.03 | 0.10 | 0.09 | 0.00 | 0.17 | 0.17 | 0.04 | 0.01 | 0.11 | 0.03 |
| SEQID-00521 | P72505 | — | 1 | 0.49 | 0.13 | 0.07 | 0.07 | 0.03 | 0.02 | 0.04 | 0.04 | 0.04 | 0.03 | 0.11 | 0.07 |
| SEQID-00522 | O49817 | — | 1 | 0.52 | 0.73 | 0.03 | 0.14 | 0.00 | 0.00 | 0.05 | 0.07 | 0.03 | 0.04 | 0.04 | 0.22 |
| SEQID-00523 | K1X7Q4 | — | 1 | 0.38 | 0.70 | 0.16 | 0.08 | 0.04 | 0.04 | 0.03 | 0.07 | 0.06 | 0.06 | 0.04 | 0.14 |
| SEQID-00524 | P79395 | — | 0 | 0.45 | 0.17 | 0.05 | 0.08 | 0.02 | 0.02 | 0.02 | 0.14 | 0.05 | 0.04 | 0.11 | 0.05 |
| SEQID-00525 | O49817 | — | 1 | 0.41 | 0.23 | 0.17 | 0.11 | 0.03 | 0.03 | 0.03 | 0.04 | 0.02 | 0.01 | 0.16 | 0.16 |
| SEQID-00526 | P63246 | — | 0 | 0.40 | 0.03 | 0.05 | 0.07 | 0.02 | 0.01 | 0.01 | 0.03 | 0.01 | 0.01 | 0.09 | 0.06 |
| SEQID-00527 | P72505 | — | 0 | 0.51 | 0.19 | 0.09 | 0.04 | 0.04 | 0.00 | 0.00 | 0.04 | 0.04 | 0.08 | 0.01 | 0.16 |
| SEQID-00528 | K1X7Q4 | — | 1 | 0.48 | 0.19 | 0.10 | 0.05 | 0.05 | 0.02 | 0.00 | 0.08 | 0.02 | 0.00 | 0.12 | 0.04 |
| SEQID-00529 | P79395 | — | 0 | 0.48 | 0.19 | 0.03 | 0.06 | 0.06 | 0.03 | 0.00 | 0.08 | 0.02 | 0.04 | 0.06 | 0.10 |
| SEQID-00525 | P01095 | — | 0 | 0.64 | 0.25 | 0.02 | 0.00 | 0.07 | 0.07 | 0.00 | 0.11 | 0.02 | 0.08 | 0.07 | 0.17 |

| | | | | | | | | | | | | | | |
|---|---|---|---|---|---|---|---|---|---|---|---|---|---|---|
| SEQID-00526 | B1N67B | — | 0 | 0.41 | 0.13 | 0.05 | 0.17 | 0.03 | 0.01 | 0.10 | 0.02 | 0.08 | 0.04 | 0.02 | 0.01 | 0.07 | 0.03 |
| SEQID-00527 | D4ZQAB | — | 1 | 0.40 | 0.18 | 0.05 | 0.09 | 0.00 | 0.07 | 0.11 | 0.03 | 0.06 | 0.04 | 0.05 | 0.05 | 0.06 | 0.04 |
| SEQID-00528 | P38711 | — | 0 | 0.53 | 0.21 | 0.05 | 0.07 | 0.01 | 0.03 | 0.06 | 0.04 | 0.11 | 0.03 | 0.05 | 0.01 | 0.11 | 0.10 |
| SEQID-00529 | B2BN60 | | 0 | 0.38 | 0.14 | 0.02 | 0.11 | 0.06 | 0.04 | 0.00 | 0.05 | 0.00 | 0.05 | 0.00 | 0.07 | 0.01 | 0.05 |
| SEQID-00530 | Q10ST8 | — | 0 | 0.37 | 0.20 | 0.13 | 0.10 | 0.04 | 0.01 | 0.10 | 0.05 | 0.11 | 0.08 | 0.01 | 0.02 | 0.07 | 0.04 |
| SEQID-00531 | P14903 | | 0 | 0.55 | 0.25 | 0.03 | 0.03 | 0.04 | 0.04 | 0.06 | 0.05 | 0.00 | 0.01 | 0.00 | 0.06 | 0.15 | 0.08 |
| SEQID-00532 | D4ZX53 | — | 0 | 0.44 | 0.28 | 0.06 | 0.10 | 0.02 | 0.03 | 0.00 | 0.02 | 0.05 | 0.02 | 0.02 | 0.09 | 0.03 | 0.03 |
| SEQID-00533 | D4ZPG3 | — | 0 | 0.47 | 0.23 | 0.04 | 0.16 | 0.03 | 0.03 | 0.00 | 0.05 | 0.11 | 0.05 | 0.00 | 0.05 | 0.08 | 0.08 |
| SEQID-00534 | D4ZUU2 | — | 0 | 0.33 | 0.13 | 0.04 | 0.15 | 0.03 | 0.04 | 0.01 | 0.01 | 0.12 | 0.09 | 0.00 | 0.02 | 0.05 | 0.05 |
| SEQID-00535 | G5E604 | | 0 | 0.30 | 0.16 | 0.06 | 0.10 | 0.06 | 0.07 | 0.02 | 0.08 | 0.02 | 0.06 | 0.00 | 0.04 | 0.06 | 0.00 |
| SEQID-00536 | O82575 | — | 0 | 0.55 | 0.10 | 0.09 | 0.00 | 0.00 | 0.04 | 0.00 | 0.01 | 0.20 | 0.04 | 0.23 | 0.04 | 0.05 | 0.18 |
| SEQID-00537 | Q08245 | | 0 | 0.42 | 0.14 | 0.08 | 0.01 | 0.07 | 0.03 | 0.00 | 0.01 | 0.21 | 0.02 | 0.00 | 0.04 | 0.04 | 0.20 |
| SEQID-00538 | F1P2P7 | — | 0 | 0.49 | 0.18 | 0.06 | 0.04 | 0.04 | 0.05 | 0.02 | 0.04 | 0.14 | 0.03 | 0.08 | 0.04 | 0.09 | 0.08 |
| SEQID-00539 | Q9N109 | — | 0 | 0.53 | 0.30 | 0.05 | 0.06 | 0.06 | 0.06 | 0.01 | 0.07 | 0.07 | 0.03 | 0.02 | 0.09 | 0.12 | 0.09 |
| SEQID-00540 | K1W1H1 | | 0 | 0.41 | 0.21 | 0.05 | 0.23 | 0.02 | 0.03 | 0.00 | 0.03 | 0.05 | 0.05 | 0.01 | 0.06 | 0.08 | 0.08 |
| SEQID-00541 | K9I1Y2 | — | 1 | 0.48 | 0.29 | 0.01 | 0.14 | 0.06 | 0.05 | 0.00 | 0.03 | 0.12 | 0.05 | 0.04 | 0.02 | 0.08 | 0.07 |
| SEQID-00542 | K9HG97 | — | 0 | 0.41 | 0.23 | 0.08 | 0.09 | 0.04 | 0.03 | 0.02 | 0.04 | 0.08 | 0.08 | 0.03 | 0.04 | 0.12 | 0.13 |
| SEQID-00543 | K9HDT0 | — | 1 | 0.42 | 0.16 | 0.03 | 0.11 | 0.06 | 0.06 | 0.00 | 0.05 | 0.06 | 0.04 | 0.01 | 0.05 | 0.05 | 0.04 |
| SEQID-00544 | Q5XQ56 | — | 0 | 0.45 | 0.20 | 0.12 | 0.06 | 0.01 | 0.07 | 0.02 | 0.07 | 0.06 | 0.03 | 0.05 | 0.04 | 0.11 | 0.06 |
| SEQID-00545 | P00427 | — | 0 | 0.39 | 0.19 | 0.06 | 0.13 | 0.05 | 0.03 | 0.01 | 0.03 | 0.15 | 0.01 | 0.02 | 0.03 | 0.10 | 0.07 |
| SEQID-00546 | Q12513 | — | 0 | 0.39 | 0.20 | 0.04 | 0.07 | 0.09 | 0.11 | 0.00 | 0.04 | 0.12 | 0.03 | 0.02 | 0.08 | 0.07 | 0.08 |
| SEQID-00547 | E78SD7 | | 0 | 0.49 | 0.09 | 0.08 | 0.04 | 0.04 | 0.03 | 0.00 | 0.04 | 0.10 | 0.08 | 0.08 | 0.01 | 0.01 | 0.12 |
| SEQID-00548 | Q7YS10 | — | 1 | 0.59 | 0.27 | 0.03 | 0.00 | 0.03 | 0.05 | 0.02 | 0.09 | 0.12 | 0.04 | 0.03 | 0.08 | 0.13 | 0.11 |
| SEQID-00549 | P21306 | — | 0 | 0.40 | 0.15 | 0.12 | 0.07 | 0.05 | 0.02 | 0.00 | 0.04 | 0.04 | 0.06 | 0.06 | 0.05 | 0.07 | 0.08 |
| SEQID-00550 | D4ZT86 | — | 0 | 0.49 | 0.38 | 0.09 | 0.06 | 0.01 | 0.05 | 0.00 | 0.02 | 0.10 | 0.02 | 0.00 | 0.09 | 0.10 | 0.05 |
| SEQID-00551 | B6S149 | — | 0 | 0.41 | 0.18 | 0.05 | 0.21 | 0.03 | 0.00 | 0.09 | 0.03 | 0.06 | 0.04 | 0.05 | 0.00 | 0.11 | 0.01 |
| SEQID-00552 | P50263 | — | 0 | 0.45 | 0.03 | 0.03 | 0.04 | 0.12 | 0.10 | 0.00 | 0.06 | 0.06 | 0.06 | 0.01 | 0.01 | 0.01 | 0.16 |
| SEQID-00553 | K6FQ38 | — | 0 | 0.39 | 0.05 | 0.08 | 0.06 | 0.00 | 0.07 | 0.00 | 0.01 | 0.15 | 0.00 | 0.05 | 0.01 | 0.00 | 0.23 |
| SEQID-00554 | K9I8HS | — | 1 | 0.38 | 0.16 | 0.09 | 0.17 | 0.06 | 0.03 | 0.00 | 0.04 | 0.05 | 0.04 | 0.01 | 0.06 | 0.01 | 0.12 |
| SEQID-00555 | D4ZXX9 | — | 0 | 0.45 | 0.26 | 0.03 | 0.17 | 0.02 | 0.02 | 0.04 | 0.07 | 0.09 | 0.04 | 0.03 | 0.12 | 0.04 | 0.08 |
| SEQID-00556 | B4FEE7 | | 0 | 0.33 | 0.13 | 0.08 | 0.22 | 0.02 | 0.05 | 0.05 | 0.03 | 0.12 | 0.06 | 0.01 | 0.18 | 0.02 | 0.03 |
| SEQID-00557 | G3MXD9 | — | 0 | 0.47 | 0.27 | 0.03 | 0.06 | 0.05 | 0.04 | 0.00 | 0.04 | 0.03 | 0.04 | 0.06 | 0.03 | 0.14 | 0.04 |
| SEQID-00558 | P53849 | — | 0 | 0.36 | 0.09 | 0.02 | 0.07 | 0.06 | 0.05 | 0.02 | 0.06 | 0.07 | 0.02 | 0.00 | 0.02 | 0.08 | 0.10 |
| SEQID-00559 | P0C030 | — | 0 | 0.50 | 0.26 | 0.03 | 0.07 | 0.02 | 0.08 | 0.13 | 0.05 | 0.10 | 0.04 | 0.02 | 0.03 | 0.03 | 0.11 |
| SEQID-00560 | Q6PY61 | | 0 | 0.55 | 0.10 | 0.03 | 0.02 | 0.02 | 0.13 | 0.00 | 0.07 | 0.12 | 0.07 | 0.18 | 0.11 | 0.11 | 0.26 |
| SEQID-00561 | D5A2Z0 | — | 1 | 0.68 | 0.36 | 0.02 | 0.22 | 0.03 | 0.02 | 0.01 | 0.01 | 0.03 | 0.06 | 0.03 | 0.08 | 0.01 | 0.04 |
| SEQID-00562 | F0TIX0 | — | 0 | 0.40 | 0.18 | 0.03 | 0.16 | 0.05 | 0.03 | 0.00 | 0.02 | 0.11 | 0.06 | 0.03 | 0.18 | 0.14 | 0.02 |
| SEQID-00563 | Q65XV6 | — | 0 | 0.50 | 0.21 | 0.07 | 0.06 | 0.08 | 0.19 | 0.01 | 0.04 | 0.05 | 0.03 | 0.01 | 0.03 | 0.08 | 0.13 |
| SEQID-00564 | B6T878 | — | 1 | 0.51 | 0.17 | 0.07 | 0.06 | 0.04 | 0.07 | 0.02 | 0.00 | 0.11 | 0.07 | 0.04 | 0.08 | 0.06 | 0.09 |
| SEQID-00565 | O7UCH9 | — | 1 | 0.56 | 0.28 | 0.09 | 0.05 | 0.02 | 0.03 | 0.00 | 0.02 | 0.05 | 0.03 | 0.02 | 0.07 | 0.06 | 0.22 |
| SEQID-00566 | M1B8F8 | — | 0 | 0.38 | 0.15 | 0.06 | 0.04 | 0.04 | 0.05 | 0.01 | 0.01 | 0.06 | 0.03 | 0.04 | 0.09 | 0.13 | 0.10 |
| SEQID-00567 | B4FUW2 | — | 1 | 0.42 | 0.17 | 0.04 | 0.02 | 0.04 | 0.03 | 0.11 | 0.05 | 0.07 | 0.06 | 0.03 | 0.05 | 0.07 | 0.03 |
| SEQID-00568 | B4FUS2 | — | 1 | 0.51 | 0.20 | 0.03 | 0.22 | 0.04 | 0.02 | 0.00 | 0.04 | 0.04 | 0.04 | 0.04 | 0.03 | 0.07 | 0.10 |
| SEQID-00569 | P02701 | — | 1 | 0.56 | 0.22 | 0.02 | 0.16 | 0.05 | 0.03 | 0.00 | 0.03 | 0.05 | 0.03 | 0.03 | 0.04 | 0.09 | 0.12 |
| SEQID-00570 | P40185 | — | 0 | 0.48 | 0.23 | 0.03 | 0.07 | 0.07 | 0.03 | 0.00 | 0.03 | 0.06 | 0.04 | 0.02 | 0.05 | 0.11 | 0.07 |
| SEQID-00571 | P02074 | — | 0 | 0.54 | 0.25 | 0.07 | 0.05 | 0.09 | 0.03 | 0.00 | 0.04 | 0.07 | 0.01 | 0.03 | 0.04 | 0.08 | 0.08 |
| SEQID-00572 | M0ZHK8 | — | 0 | 0.54 | 0.17 | 0.08 | 0.06 | 0.05 | 0.05 | 0.00 | 0.02 | 0.10 | 0.05 | 0.06 | 0.00 | 0.13 | 0.07 |
| SEQID-00573 | Q9M3H6 | — | 0 | 0.54 | 0.17 | 0.06 | 0.05 | 0.02 | 0.02 | 0.00 | 0.02 | 0.10 | 0.03 | 0.02 | 0.07 | 0.05 | 0.23 |
| SEQID-00574 | F0TIG5 | | 0 | 0.44 | 0.19 | 0.08 | 0.05 | 0.05 | 0.03 | 0.00 | 0.02 | 0.10 | 0.02 | 0.02 | 0.04 | 0.04 | 0.23 |
| SEQID-00575 | B6SIA2 | — | 0 | 0.33 | 0.13 | 0.04 | 0.14 | 0.03 | 0.04 | 0.00 | 0.03 | 0.03 | 0.05 | 0.04 | 0.04 | 0.07 | 0.12 |
| SEQID-00576 | K9HNE7 | — | 1 | 0.42 | 0.21 | 0.03 | 0.22 | 0.06 | 0.04 | 0.05 | 0.03 | 0.04 | 0.04 | 0.05 | 0.04 | 0.01 | 0.09 |
| SEQID-00577 | P02294 | — | 0 | 0.47 | 0.16 | 0.08 | 0.07 | 0.02 | 0.02 | 0.06 | 0.04 | 0.00 | 0.04 | 0.03 | 0.06 | 0.05 | 0.04 |
| SEQID-00578 | B6T2K5 | — | 0 | 0.54 | 0.22 | 0.05 | 0.15 | 0.01 | 0.02 | 0.00 | 0.04 | 0.06 | 0.01 | 0.02 | 0.05 | 0.13 | 0.21 |

TABLE 1-continued

| | | | | | | | | | | | | | | |
|---|---|---|---|---|---|---|---|---|---|---|---|---|---|---|
| SEQID-00579 | B4FGQ6 | — | 0 | 0.47 | 0.19 | 0.03 | 0.17 | 0.02 | 0.01 | 0.01 | 0.06 | 0.04 | 0.03 | 0.02 | 0.04 | 0.07 | 0.18 |
| SEQID-00580 | F0TGC0 | — | 1 | 0.49 | 0.15 | 0.02 | 0.16 | 0.04 | 0.04 | 0.00 | 0.04 | 0.02 | 0.03 | 0.02 | 0.04 | 0.07 | 0.16 |
| SEQID-00581 | D4ZPH2 | — | 0 | 0.51 | 0.21 | 0.02 | 0.12 | 0.03 | 0.04 | 0.00 | 0.04 | 0.07 | 0.03 | 0.03 | 0.04 | 0.04 | 0.15 |
| SEQID-00582 | K9I7W3 | — | 1 | 0.54 | 0.18 | 0.05 | 0.07 | 0.04 | 0.08 | 0.00 | 0.03 | 0.02 | 0.05 | 0.03 | 0.06 | 0.06 | 0.17 |
| SEQID-00583 | B6SGX0 | — | 0 | 0.56 | 0.18 | 0.05 | 0.16 | 0.01 | 0.02 | 0.00 | 0.01 | 0.06 | 0.04 | 0.04 | 0.03 | 0.09 | 0.21 |
| SEQID-00584 | G3UV10 | — | 1 | 0.50 | 0.18 | 0.05 | 0.05 | 0.03 | 0.05 | 0.02 | 0.00 | 0.09 | 0.06 | 0.02 | 0.12 | 0.04 | 0.08 |
| SEQID-00585 | Q5BYT2 | — | 0 | 0.44 | 0.06 | 0.02 | 0.00 | 0.03 | 0.10 | 0.00 | 0.13 | 0.08 | 0.10 | 0.04 | 0.03 | 0.01 | 0.21 |
| SEQID-00586 | K1VX49 | — | 0 | 0.44 | 0.09 | 0.05 | 0.10 | 0.01 | 0.04 | 0.00 | 0.02 | 0.06 | 0.03 | 0.10 | 0.02 | 0.06 | 0.15 |
| SEQID-00587 | P38910 | — | 0 | 0.51 | 0.29 | 0.06 | 0.04 | 0.05 | 0.07 | 0.00 | 0.07 | 0.07 | 0.04 | 0.03 | 0.07 | 0.11 | 0.12 |
| SEQID-00588 | K9HK97 | — | 0 | 0.44 | 0.20 | 0.04 | 0.17 | 0.04 | 0.07 | 0.00 | 0.03 | 0.06 | 0.05 | 0.02 | 0.07 | 0.06 | 0.11 |
| SEQID-00589 | Q12497 | — | 0 | 0.42 | 0.12 | 0.03 | 0.13 | 0.03 | 0.10 | 0.00 | 0.06 | 0.07 | 0.03 | 0.03 | 0.02 | 0.08 | 0.13 |
| SEQID-00590 | F0TEQ9 | — | 0 | 0.49 | 0.20 | 0.10 | 0.06 | 0.04 | 0.05 | 0.01 | 0.04 | 0.12 | 0.03 | 0.01 | 0.03 | 0.06 | 0.16 |
| SEQID-00591 | P01098 | — | 0 | 0.37 | 0.18 | 0.04 | 0.14 | 0.09 | 0.03 | 0.01 | 0.06 | 0.10 | 0.05 | 0.03 | 0.06 | 0.10 | 0.11 |
| SEQID-00592 | B6SPL7 | — | 0 | 0.53 | 0.21 | 0.07 | 0.02 | 0.01 | 0.05 | 0.02 | 0.04 | 0.10 | 0.05 | 0.00 | 0.06 | 0.04 | 0.12 |
| SEQID-00593 | D5A0N7 | — | 1 | 0.49 | 0.20 | 0.05 | 0.08 | 0.01 | 0.04 | 0.00 | 0.08 | 0.07 | 0.04 | 0.03 | 0.01 | 0.06 | 0.03 |
| SEQID-00594 | K4CBP6 | — | 0 | 0.44 | 0.14 | 0.05 | 0.01 | 0.03 | 0.06 | 0.00 | 0.08 | 0.07 | 0.03 | 0.04 | 0.11 | 0.06 | 0.04 |
| SEQID-00595 | K7WJX3 | — | 0 | 0.44 | 0.10 | 0.06 | 0.16 | 0.04 | 0.01 | 0.00 | 0.09 | 0.07 | 0.03 | 0.03 | 0.03 | 0.06 | 0.03 |
| SEQID-00596 | Q2I2W0 | — | 0 | 0.44 | 0.16 | 0.05 | 0.16 | 0.04 | 0.01 | 0.00 | 0.09 | 0.06 | 0.05 | 0.03 | 0.01 | 0.06 | 0.04 |
| SEQID-00597 | I1K5S4 | — | 0 | 0.45 | 0.18 | 0.03 | 0.09 | 0.04 | 0.08 | 0.09 | 0.02 | 0.03 | 0.03 | 0.01 | 0.01 | 0.09 | 0.03 |
| SEQID-00598 | P82381 | — | 1 | 0.49 | 0.20 | 0.06 | 0.19 | 0.00 | 0.00 | 0.11 | 0.05 | 0.05 | 0.05 | 0.03 | 0.03 | 0.12 | 0.08 |
| SEQID-00599 | K9HN29 | — | 1 | 0.50 | 0.22 | 0.04 | 0.12 | 0.04 | 0.05 | 0.10 | 0.02 | 0.06 | 0.03 | 0.05 | 0.01 | 0.03 | 0.06 |
| SEQID-00600 | G1NGA7 | — | 1 | 0.50 | 0.21 | 0.06 | 0.06 | 0.02 | 0.08 | 0.03 | 0.00 | 0.05 | 0.04 | 0.04 | 0.05 | 0.08 | 0.07 |
| SEQID-00601 | K9HJD1 | — | 1 | 0.40 | 0.14 | 0.06 | 0.06 | 0.03 | 0.02 | 0.01 | 0.04 | 0.06 | 0.04 | 0.01 | 0.05 | 0.09 | 0.06 |
| SEQID-00602 | F0TGH0 | — | 1 | 0.36 | 0.12 | 0.06 | 0.05 | 0.08 | 0.05 | 0.02 | 0.09 | 0.09 | 0.05 | 0.06 | 0.04 | 0.07 | 0.08 |
| SEQID-00603 | Q04491 | — | 0 | 0.41 | 0.20 | 0.07 | 0.01 | 0.05 | 0.01 | 0.00 | 0.09 | 0.03 | 0.02 | 0.00 | 0.04 | 0.06 | 0.09 |
| SEQID-00604 | K9HHN3 | — | 1 | 0.51 | 0.22 | 0.05 | 0.04 | 0.04 | 0.06 | 0.00 | 0.03 | 0.09 | 0.04 | 0.01 | 0.05 | 0.08 | 0.19 |
| SEQID-00605 | K9I605 | — | 0 | 0.48 | 0.20 | 0.08 | 0.05 | 0.05 | 0.07 | 0.00 | 0.04 | 0.04 | 0.04 | 0.05 | 0.03 | 0.09 | 0.08 |
| SEQID-00606 | C6T9B1 | — | 0 | 0.51 | 0.26 | 0.04 | 0.05 | 0.02 | 0.04 | 0.00 | 0.04 | 0.04 | 0.04 | 0.04 | 0.03 | 0.09 | 0.09 |
| SEQID-00607 | K1WSX8 | — | 1 | 0.48 | 0.20 | 0.06 | 0.07 | 0.05 | 0.04 | 0.00 | 0.04 | 0.10 | 0.05 | 0.03 | 0.10 | 0.11 | 0.09 |
| SEQID-00608 | Q3ZBI6 | — | 1 | 0.38 | 0.11 | 0.07 | 0.10 | 0.02 | 0.03 | 0.01 | 0.08 | 0.08 | 0.05 | 0.12 | 0.06 | 0.09 | 0.05 |
| SEQID-00609 | P39015 | — | 0 | 0.34 | 0.10 | 0.03 | 0.03 | 0.01 | 0.04 | 0.00 | 0.02 | 0.10 | 0.01 | 0.02 | 0.02 | 0.07 | 0.07 |
| SEQID-00610 | P38886 | — | 0 | 0.36 | 0.12 | 0.08 | 0.10 | 0.12 | 0.06 | 0.12 | 0.17 | 0.07 | 0.05 | 0.04 | 0.01 | 0.06 | 0.04 |
| SEQID-00611 | Q9FWV6 | — | 0 | 0.41 | 0.20 | 0.05 | 0.07 | 0.06 | 0.03 | 0.00 | 0.04 | 0.08 | 0.02 | 0.00 | 0.02 | 0.05 | 0.14 |
| SEQID-00612 | Q6YTX5 | — | 1 | 0.50 | 0.26 | 0.11 | 0.07 | 0.02 | 0.06 | 0.00 | 0.04 | 0.10 | 0.03 | 0.04 | 0.06 | 0.09 | 0.01 |
| SEQID-00613 | K1WS36 | — | 1 | 0.42 | 0.25 | 0.16 | 0.06 | 0.02 | 0.04 | 0.00 | 0.01 | 0.07 | 0.07 | 0.04 | 0.03 | 0.14 | 0.05 |
| SEQID-00614 | K9H9H7 | — | 1 | 0.36 | 0.19 | 0.08 | 0.08 | 0.07 | 0.04 | 0.00 | 0.13 | 0.06 | 0.03 | 0.04 | 0.00 | 0.12 | 0.08 |
| SEQID-00615 | F6HMP1 | — | 0 | 0.57 | 0.16 | 0.08 | 0.09 | 0.03 | 0.08 | 0.00 | 0.05 | 0.13 | 0.02 | 0.00 | 0.04 | 0.11 | 0.08 |
| SEQID-00616 | P05745 | — | 0 | 0.40 | 0.03 | 0.08 | 0.09 | 0.00 | 0.02 | 0.00 | 0.02 | 0.02 | 0.05 | 0.05 | 0.09 | 0.12 | 0.06 |
| SEQID-00617 | D4ZMN8 | — | 1 | 0.49 | 0.20 | 0.01 | 0.05 | 0.00 | 0.08 | 0.00 | 0.07 | 0.22 | 0.18 | 0.10 | 0.06 | 0.02 | 0.14 |
| SEQID-00618 | C6SWA6 | — | 0 | 0.44 | 0.16 | 0.07 | 0.17 | 0.05 | 0.05 | 0.00 | 0.00 | 0.06 | 0.04 | 0.01 | 0.08 | 0.06 | 0.16 |
| SEQID-00619 | FB334983.1 | — | 1 | 0.46 | 0.26 | 0.10 | 0.07 | 0.05 | 0.03 | 0.00 | 0.05 | 0.11 | 0.07 | 0.01 | 0.06 | 0.02 | 0.10 |
| SEQID-00620 | P48589 | — | 1 | 0.48 | 0.20 | 0.08 | 0.11 | 0.04 | 0.02 | 0.02 | 0.02 | 0.06 | 0.02 | 0.01 | 0.04 | 0.11 | 0.17 |
| SEQID-00621 | M1B1K7 | — | 1 | 0.51 | 0.16 | 0.09 | 0.06 | 0.04 | 0.05 | 0.00 | 0.00 | 0.11 | 0.07 | 0.04 | 0.06 | 0.05 | 0.23 |
| SEQID-00622 | Q0DT04 | — | 1 | 0.50 | 0.30 | 0.06 | 0.06 | 0.04 | 0.02 | 0.00 | 0.04 | 0.15 | 0.02 | 0.06 | 0.04 | 0.11 | 0.07 |
| SEQID-00623 | O65819 | — | 1 | 0.39 | 0.22 | 0.08 | 0.11 | 0.06 | 0.05 | 0.01 | 0.10 | 0.06 | 0.03 | 0.05 | 0.05 | 0.11 | 0.10 |
| SEQID-00624 | D4ZX3 | — | 1 | 0.40 | 0.18 | 0.09 | 0.09 | 0.00 | 0.08 | 0.00 | 0.04 | 0.06 | 0.04 | 0.04 | 0.04 | 0.04 | 0.04 |
| SEQID-00625 | C6SY27 | — | 0 | 0.54 | 0.17 | 0.08 | 0.05 | 0.02 | 0.03 | 0.00 | 0.03 | 0.09 | 0.03 | 0.02 | 0.09 | 0.05 | 0.23 |
| SEQID-00626 | F0TIT3 | — | 0 | 0.49 | 0.21 | 0.11 | 0.01 | 0.00 | 0.05 | 0.01 | 0.05 | 0.18 | 0.04 | 0.10 | 0.07 | 0.10 | 0.14 |
| SEQID-00627 | Q6ZGV5 | — | 1 | 0.52 | 0.24 | 0.05 | 0.14 | 0.03 | 0.08 | 0.00 | 0.00 | 0.04 | 0.01 | 0.01 | 0.06 | 0.07 | 0.17 |
| SEQID-00628 | P38701 | — | 1 | 0.46 | 0.26 | 0.05 | 0.09 | 0.06 | 0.06 | 0.00 | 0.04 | 0.07 | 0.04 | 0.01 | 0.12 | 0.06 | 0.11 |
| SEQID-00629 | P39939 | — | 1 | 0.48 | 0.20 | 0.05 | 0.11 | 0.04 | 0.04 | 0.00 | 0.02 | 0.12 | 0.07 | 0.02 | 0.06 | 0.02 | 0.10 |
| SEQID-00630 | G3N028 | — | 1 | 0.51 | 0.25 | 0.01 | 0.14 | 0.05 | 0.05 | 0.01 | 0.01 | 0.11 | 0.03 | 0.02 | 0.06 | 0.11 | 0.17 |
| SEQID-00631 | F0TIJ3 | — | 0 | 0.50 | 0.16 | 0.08 | 0.07 | 0.07 | 0.02 | 0.00 | 0.10 | 0.04 | 0.04 | 0.01 | 0.05 | 0.05 | 0.15 |
| | | | | 0.37 | 0.16 | 0.03 | 0.19 | 0.04 | 0.03 | 0.03 | 0.01 | 0.04 | 0.01 | 0.06 | 0.05 | 0.03 | 0.13 |
| | | | | 0.35 | 0.16 | 0.03 | 0.06 | 0.04 | 0.03 | 0.03 | 0.07 | 0.04 | 0.02 | 0.02 | 0.05 | 0.06 | 0.14 |
| | | | | 0.38 | 0.20 | 0.04 | 0.21 | 0.04 | 0.09 | 0.01 | 0.02 | 0.06 | 0.01 | 0.07 | 0.06 | 0.10 |

TABLE 1-continued

| SEQID | Accession | Range | | | | | | | | | | | | | | |
|---|---|---|---|---|---|---|---|---|---|---|---|---|---|---|---|---|
| SEQID-00632 | P38804 | — | 0 | 0.47 | 0.20 | 0.05 | 0.03 | 0.07 | 0.04 | 0.00 | 0.02 | 0.14 | 0.06 | 0.00 | 0.05 | 0.08 | 0.13 |
| SEQID-00633 | P22943 | — | 0 | 0.35 | 0.10 | 0.08 | 0.09 | 0.00 | 0.11 | 0.00 | 0.07 | 0.12 | 0.06 | 0.02 | 0.01 | 0.03 | 0.16 |
| SEQID-00634 | Q3E792 | — | 0 | 0.50 | 0.21 | 0.08 | 0.04 | 0.00 | 0.04 | 0.00 | 0.05 | 0.05 | 0.02 | 0.03 | 0.08 | 0.08 | 0.19 |
| SEQID-00635 | P41056 | — | 1 | 0.46 | 0.20 | 0.05 | 0.09 | 0.14 | 0.00 | 0.00 | 0.03 | 0.04 | 0.04 | 0.03 | 0.06 | 0.06 | 0.09 |
| SEQID-00636 | HC499955.1 | — | 1 | 0.47 | 0.23 | 0.04 | 0.14 | 0.22 | 0.03 | 0.00 | 0.02 | 0.04 | 0.07 | 0.02 | 0.07 | 0.08 | 0.11 |
| SEQID-00637 | B6SGI4 | — | 1 | 0.42 | 0.07 | 0.06 | 0.22 | 0.02 | 0.00 | 0.00 | 0.02 | 0.04 | 0.05 | 0.04 | 0.04 | 0.02 | 0.12 |
| SEQID-00638 | D4ZUU9 | — | 0 | 0.48 | 0.21 | 0.06 | 0.11 | 0.04 | 0.03 | 0.04 | 0.04 | 0.02 | 0.02 | 0.00 | 0.04 | 0.07 | 0.14 |
| SEQID-00639 | P0CX26 | — | 1 | 0.46 | 0.16 | 0.08 | 0.15 | 0.03 | 0.01 | 0.05 | 0.04 | 0.14 | 0.05 | 0.01 | 0.04 | 0.03 | 0.16 |
| SEQID-00640 | F0T1H8 | — | 0 | 0.47 | 0.19 | 0.01 | 0.13 | 0.06 | 0.05 | 0.00 | 0.02 | 0.04 | 0.01 | 0.03 | 0.04 | 0.02 | 0.14 |
| SEQID-00641 | P01097 | — | 0 | 0.39 | 0.14 | 0.04 | 0.17 | 0.01 | 0.00 | 0.04 | 0.03 | 0.06 | 0.03 | 0.01 | 0.02 | 0.09 | 0.10 |
| SEQID-00642 | Q01519 | — | 1 | 0.45 | 0.11 | 0.04 | 0.03 | 0.06 | 0.11 | 0.00 | 0.08 | 0.12 | 0.02 | 0.04 | 0.03 | 0.03 | 0.09 |
| SEQID-00643 | D4P880 | — | 0 | 0.57 | 0.24 | 0.02 | 0.09 | 0.02 | 0.06 | 0.04 | 0.03 | 0.05 | 0.03 | 0.04 | 0.05 | 0.13 | 0.15 |
| SEQID-00644 | D5A1R0 | — | 0 | 0.42 | 0.22 | 0.06 | 0.09 | 0.07 | 0.04 | 0.03 | 0.04 | 0.09 | 0.04 | 0.00 | 0.05 | 0.03 | 0.09 |
| SEQID-00645 | P37299 | — | 1 | 0.56 | 0.20 | 0.03 | 0.04 | 0.03 | 0.04 | 0.01 | 0.01 | 0.03 | 0.05 | 0.05 | 0.01 | 0.17 | 0.07 |
| SEQID-00646 | B6UDM4 | — | 1 | 0.54 | 0.23 | 0.06 | 0.09 | 0.05 | 0.04 | 0.00 | 0.03 | 0.03 | 0.05 | 0.03 | 0.03 | 0.15 | 0.09 |
| SEQID-00647 | K1XDJ4 | — | 0 | 0.42 | 0.24 | 0.04 | 0.15 | 0.01 | 0.04 | 0.00 | 0.09 | 0.12 | 0.01 | 0.05 | 0.05 | 0.18 | 0.08 |
| SEQID-00648 | K1WP04 | — | 1 | 0.39 | 0.12 | 0.03 | 0.19 | 0.03 | 0.04 | 0.00 | 0.09 | 0.17 | 0.04 | 0.02 | 0.05 | 0.04 | 0.08 |
| SEQID-00649 | Q6H6I1 | — | 0 | 0.42 | 0.19 | 0.13 | 0.08 | 0.02 | 0.06 | 0.03 | 0.00 | 0.06 | 0.04 | 0.00 | 0.04 | 0.06 | 0.08 |
| SEQID-00650 | F1NXK2 | — | 1 | 0.50 | 0.23 | 0.04 | 0.11 | 0.02 | 0.08 | 0.00 | 0.01 | 0.07 | 0.05 | 0.01 | 0.05 | 0.03 | 0.05 |
| SEQID-00651 | B6UHQ3 | — | 1 | 0.39 | 0.19 | 0.17 | 0.03 | 0.01 | 0.05 | 0.02 | 0.00 | 0.09 | 0.04 | 0.04 | 0.08 | 0.03 | 0.07 |
| SEQID-00652 | P01064 | — | 0 | 0.23 | 0.08 | 0.00 | 0.03 | 0.02 | 0.13 | 0.16 | 0.05 | 0.04 | 0.01 | 0.01 | 0.02 | 0.13 | 0.02 |
| SEQID-00653 | E1UJV6 | — | 0 | 0.47 | 0.22 | 0.10 | 0.07 | 0.05 | 0.05 | 0.01 | 0.03 | 0.09 | 0.04 | 0.00 | 0.08 | 0.06 | 0.07 |
| SEQID-00654 | E1USS1 | — | 1 | 0.54 | 0.28 | 0.07 | 0.05 | 0.04 | 0.06 | 0.00 | 0.03 | 0.09 | 0.05 | 0.05 | 0.11 | 0.05 | 0.11 |
| SEQID-00655 | E1UU33 | — | 0 | 0.47 | 0.21 | 0.05 | 0.06 | 0.05 | 0.04 | 0.01 | 0.05 | 0.13 | 0.04 | 0.02 | 0.06 | 0.11 | 0.07 |
| SEQID-00656 | E1UV85 | — | 0 | 0.44 | 0.20 | 0.07 | 0.01 | 0.06 | 0.05 | 0.00 | 0.14 | 0.07 | 0.04 | 0.00 | 0.05 | 0.08 | 0.12 |
| SEQID-00657 | E1UR32 | — | 1 | 0.49 | 0.17 | 0.05 | 0.02 | 0.09 | 0.07 | 0.00 | 0.04 | 0.07 | 0.04 | 0.01 | 0.05 | 0.06 | 0.13 |
| SEQID-00658 | E1URC8 | — | 1 | 0.42 | 0.17 | 0.06 | 0.05 | 0.04 | 0.06 | 0.00 | 0.07 | 0.09 | 0.04 | 0.04 | 0.05 | 0.07 | 0.13 |
| SEQID-00659 | E1UV03 | — | 1 | 0.44 | 0.17 | 0.05 | 0.06 | 0.10 | 0.09 | 0.00 | 0.05 | 0.05 | 0.03 | 0.04 | 0.05 | 0.05 | 0.16 |
| SEQID-00660 | E1UKZ8 | — | 1 | 0.43 | 0.17 | 0.06 | 0.02 | 0.03 | 0.05 | 0.00 | 0.04 | 0.05 | 0.03 | 0.02 | 0.04 | 0.05 | 0.05 |
| SEQID-00661 | P00780 | — | 1 | 0.44 | 0.22 | 0.10 | 0.02 | 0.07 | 0.09 | 0.01 | 0.03 | 0.08 | 0.06 | 0.03 | 0.05 | 0.08 | 0.14 |
| SEQID-00662 | E1UMM6 | — | 1 | 0.43 | 0.17 | 0.04 | 0.04 | 0.04 | 0.05 | 0.00 | 0.02 | 0.04 | 0.06 | 0.01 | 0.06 | 0.06 | 0.08 |
| SEQID-00663 | QBGCB2 | — | 1 | 0.47 | 0.20 | 0.03 | 0.05 | 0.08 | 0.06 | 0.00 | 0.01 | 0.04 | 0.05 | 0.03 | 0.09 | 0.08 | 0.07 |
| SEQID-00664 | Q65EF5 | — | 1 | 0.50 | 0.19 | 0.05 | 0.05 | 0.12 | 0.06 | 0.00 | 0.04 | 0.07 | 0.05 | 0.03 | 0.09 | 0.05 | 0.08 |
| SEQID-00665 | D5DEH5 | — | 0 | 0.41 | 0.17 | 0.06 | 0.03 | 0.07 | 0.07 | 0.00 | 0.04 | 0.04 | 0.05 | 0.02 | 0.04 | 0.04 | 0.10 |
| SEQID-00666 | G2RXU3 | — | 1 | 0.46 | 0.24 | 0.07 | 0.05 | 0.05 | 0.05 | 0.00 | 0.03 | 0.04 | 0.06 | 0.01 | 0.07 | 0.06 | 0.09 |
| SEQID-00667 | E1UPU6 | — | 0 | 0.40 | 0.15 | 0.05 | 0.09 | 0.05 | 0.11 | 0.00 | 0.04 | 0.10 | 0.04 | 0.01 | 0.04 | 0.09 | 0.07 |
| SEQID-00668 | E1UQB7 | — | 1 | 0.52 | 0.16 | 0.06 | 0.01 | 0.03 | 0.10 | 0.00 | 0.05 | 0.07 | 0.04 | 0.01 | 0.03 | 0.07 | 0.10 |
| SEQID-00669 | P07170 | — | 1 | 0.48 | 0.21 | 0.06 | 0.06 | 0.04 | 0.09 | 0.00 | 0.06 | 0.09 | 0.03 | 0.01 | 0.03 | 0.08 | 0.23 |
| SEQID-00670 | P07170 | — | 1 | 0.48 | 0.21 | 0.06 | 0.05 | 0.04 | 0.09 | 0.00 | 0.06 | 0.06 | 0.04 | 0.03 | 0.07 | 0.10 | 0.10 |
| SEQID-00671 | P07170 | — | 1 | 0.46 | 0.21 | 0.06 | 0.05 | 0.04 | 0.09 | 0.00 | 0.06 | 0.06 | 0.04 | 0.03 | 0.07 | 0.10 | 0.10 |
| SEQID-00672 | P07170 | — | 1 | 0.47 | 0.21 | 0.06 | 0.05 | 0.04 | 0.09 | 0.00 | 0.06 | 0.06 | 0.04 | 0.03 | 0.07 | 0.10 | 0.10 |
| SEQID-00673 | P07170 | — | 1 | 0.47 | 0.21 | 0.06 | 0.05 | 0.04 | 0.09 | 0.00 | 0.06 | 0.06 | 0.04 | 0.03 | 0.07 | 0.10 | 0.10 |
| SEQID-00674 | P07170 | — | 1 | 0.47 | 0.21 | 0.07 | 0.05 | 0.04 | 0.09 | 0.00 | 0.06 | 0.06 | 0.04 | 0.03 | 0.07 | 0.10 | 0.10 |
| SEQID-00675 | P07170 | — | 1 | 0.47 | 0.21 | 0.06 | 0.05 | 0.04 | 0.09 | 0.00 | 0.06 | 0.06 | 0.04 | 0.03 | 0.07 | 0.10 | 0.10 |
| SEQID-00676 | P07170 | — | 1 | 0.47 | 0.21 | 0.06 | 0.05 | 0.04 | 0.09 | 0.00 | 0.06 | 0.06 | 0.04 | 0.03 | 0.07 | 0.10 | 0.10 |
| SEQID-00677 | P07170 | — | 1 | 0.48 | 0.21 | 0.06 | 0.05 | 0.04 | 0.09 | 0.00 | 0.06 | 0.06 | 0.04 | 0.03 | 0.07 | 0.10 | 0.11 |
| SEQID-00678 | P07170 | — | 1 | 0.48 | 0.21 | 0.06 | 0.05 | 0.04 | 0.09 | 0.00 | 0.06 | 0.06 | 0.04 | 0.03 | 0.07 | 0.10 | 0.10 |
| SEQID-00679 | P07170 | — | 1 | 0.48 | 0.21 | 0.06 | 0.05 | 0.04 | 0.09 | 0.00 | 0.06 | 0.06 | 0.04 | 0.03 | 0.07 | 0.10 | 0.10 |
| SEQID-00680 | P07170 | — | 1 | 0.47 | 0.21 | 0.06 | 0.05 | 0.04 | 0.09 | 0.00 | 0.06 | 0.06 | 0.04 | 0.03 | 0.07 | 0.10 | 0.10 |
| SEQID-00681 | P07170 | — | 1 | 0.43 | 0.16 | 0.05 | 0.05 | 0.04 | 0.07 | 0.00 | 0.05 | 0.06 | 0.04 | 0.03 | 0.06 | 0.06 | 0.10 |
| SEQID-00682 | P07170 | — | 1 | 0.43 | 0.17 | 0.05 | 0.05 | 0.09 | 0.03 | 0.00 | 0.05 | 0.04 | 0.04 | 0.03 | 0.06 | 0.06 | 0.10 |
| SEQID-00683 | P00691 | 34-659 | 1 | 0.43 | 0.16 | 0.05 | 0.05 | 0.09 | 0.03 | 0.00 | 0.05 | 0.04 | 0.04 | 0.03 | 0.06 | 0.06 | 0.06 |
| SEQID-00684 | P00691 | 34-659 | 1 | 0.44 | 0.17 | 0.05 | 0.05 | 0.09 | 0.07 | 0.00 | 0.05 | 0.04 | 0.05 | 0.03 | 0.06 | 0.06 | 0.06 |

TABLE 1-continued

| | | | | | | | | | | | | | | |
|---|---|---|---|---|---|---|---|---|---|---|---|---|---|---|
| SEQID-00685 | P00691 | 34-659 | 1 | 0.43 | 0.16 | 0.05 | 0.05 | 0.09 | 0.08 | 0.00 | 0.05 | 0.04 | 0.05 | 0.03 | 0.05 | 0.06 | 0.06 |
| SEQID-00686 | P00691 | 34-659 | 1 | 0.43 | 0.16 | 0.05 | 0.05 | 0.09 | 0.08 | 0.00 | 0.05 | 0.04 | 0.05 | 0.03 | 0.05 | 0.06 | 0.06 |
| SEQID-00687 | P00691 | 34-659 | 1 | 0.42 | 0.16 | 0.05 | 0.05 | 0.09 | 0.07 | 0.00 | 0.05 | 0.04 | 0.05 | 0.03 | 0.06 | 0.06 | 0.06 |
| SEQID-00688 | P00691 | 34-659 | 1 | 0.43 | 0.16 | 0.05 | 0.05 | 0.09 | 0.08 | 0.00 | 0.05 | 0.04 | 0.05 | 0.03 | 0.05 | 0.06 | 0.06 |
| SEQID-00689 | P00691 | 34-659 | 1 | 0.43 | 0.16 | 0.05 | 0.05 | 0.09 | 0.08 | 0.00 | 0.05 | 0.04 | 0.05 | 0.03 | 0.06 | 0.06 | 0.06 |
| SEQID-00690 | P00691 | 34-659 | 1 | 0.44 | 0.17 | 0.05 | 0.05 | 0.09 | 0.07 | 0.00 | 0.05 | 0.04 | 0.05 | 0.03 | 0.05 | 0.06 | 0.06 |
| SEQID-00691 | P00691 | 34-659 | 1 | 0.44 | 0.17 | 0.05 | 0.05 | 0.09 | 0.07 | 0.00 | 0.05 | 0.04 | 0.05 | 0.03 | 0.05 | 0.07 | 0.06 |
| SEQID-00692 | P00691 | 34-659 | 1 | 0.44 | 0.17 | 0.05 | 0.05 | 0.09 | 0.07 | 0.00 | 0.05 | 0.04 | 0.05 | 0.03 | 0.06 | 0.06 | 0.06 |
| SEQID-00693 | P00691 | 34-659 | 1 | 0.43 | 0.16 | 0.05 | 0.05 | 0.09 | 0.08 | 0.00 | 0.05 | 0.04 | 0.05 | 0.03 | 0.05 | 0.06 | 0.06 |
| SEQID-00694 | P00691 | 34-659 | 1 | 0.44 | 0.16 | 0.05 | 0.05 | 0.09 | 0.08 | 0.00 | 0.05 | 0.04 | 0.05 | 0.03 | 0.06 | 0.06 | 0.06 |
| SEQID-00695 | P00691 | 34-659 | 1 | 0.43 | 0.16 | 0.05 | 0.05 | 0.09 | 0.08 | 0.00 | 0.05 | 0.04 | 0.05 | 0.03 | 0.05 | 0.06 | 0.06 |
| SEQID-00696 | P00691 | 34-659 | 1 | 0.44 | 0.17 | 0.05 | 0.05 | 0.09 | 0.07 | 0.00 | 0.05 | 0.04 | 0.05 | 0.03 | 0.06 | 0.06 | 0.06 |
| SEQID-00697 | P00691 | 34-659 | 1 | 0.43 | 0.17 | 0.05 | 0.05 | 0.09 | 0.07 | 0.00 | 0.05 | 0.04 | 0.05 | 0.03 | 0.05 | 0.06 | 0.06 |
| SEQID-00698 | P00691 | 34-659 | 1 | 0.44 | 0.17 | 0.05 | 0.05 | 0.09 | 0.07 | 0.00 | 0.05 | 0.04 | 0.05 | 0.03 | 0.06 | 0.06 | 0.06 |
| SEQID-00699 | P00691 | 34-659 | 1 | 0.43 | 0.16 | 0.05 | 0.05 | 0.09 | 0.08 | 0.00 | 0.05 | 0.04 | 0.05 | 0.03 | 0.05 | 0.06 | 0.06 |
| SEQID-00700 | P00691 | 34-659 | 1 | 0.44 | 0.16 | 0.05 | 0.05 | 0.09 | 0.08 | 0.00 | 0.05 | 0.04 | 0.05 | 0.03 | 0.06 | 0.06 | 0.06 |
| SEQID-00701 | P00691 | 34-659 | 1 | 0.44 | 0.17 | 0.05 | 0.05 | 0.09 | 0.07 | 0.00 | 0.05 | 0.04 | 0.05 | 0.03 | 0.05 | 0.06 | 0.06 |
| SEQID-00702 | P00691 | 34-659 | 1 | 0.44 | 0.17 | 0.05 | 0.05 | 0.09 | 0.07 | 0.00 | 0.06 | 0.04 | 0.05 | 0.03 | 0.06 | 0.06 | 0.06 |
| SEQID-00703 | P00691 | 34-659 | 1 | 0.43 | 0.16 | 0.05 | 0.05 | 0.09 | 0.06 | 0.00 | 0.06 | 0.04 | 0.05 | 0.03 | 0.06 | 0.06 | 0.06 |
| SEQID-00704 | P00691 | 34-659 | 1 | 0.43 | 0.16 | 0.05 | 0.06 | 0.09 | 0.08 | 0.00 | 0.06 | 0.04 | 0.05 | 0.03 | 0.05 | 0.06 | 0.06 |
| SEQID-00705 | P00691 | 34-659 | 1 | 0.44 | 0.17 | 0.05 | 0.05 | 0.09 | 0.07 | 0.00 | 0.05 | 0.04 | 0.05 | 0.03 | 0.05 | 0.06 | 0.06 |
| SEQID-00706 | P00691 | 34-659 | 1 | 0.42 | 0.16 | 0.05 | 0.05 | 0.09 | 0.08 | 0.00 | 0.05 | 0.04 | 0.05 | 0.03 | 0.06 | 0.06 | 0.06 |
| SEQID-00707 | P00691 | 34-659 | 1 | 0.42 | 0.16 | 0.05 | 0.05 | 0.09 | 0.08 | 0.00 | 0.06 | 0.04 | 0.05 | 0.03 | 0.05 | 0.06 | 0.06 |
| SEQID-00708 | P00691 | 34-659 | 1 | 0.42 | 0.16 | 0.05 | 0.05 | 0.09 | 0.08 | 0.00 | 0.06 | 0.04 | 0.05 | 0.03 | 0.05 | 0.06 | 0.06 |
| SEQID-00709 | P00691 | 34-659 | 1 | 0.42 | 0.16 | 0.05 | 0.05 | 0.09 | 0.07 | 0.00 | 0.05 | 0.04 | 0.04 | 0.03 | 0.05 | 0.06 | 0.06 |
| SEQID-00710 | P00691 | 34-659 | 1 | 0.42 | 0.16 | 0.05 | 0.05 | 0.09 | 0.08 | 0.00 | 0.05 | 0.04 | 0.05 | 0.03 | 0.05 | 0.06 | 0.06 |
| SEQID-00711 | P00691 | 34-659 | 1 | 0.42 | 0.16 | 0.05 | 0.05 | 0.09 | 0.07 | 0.00 | 0.05 | 0.04 | 0.04 | 0.03 | 0.05 | 0.06 | 0.06 |
| SEQID-00712 | P00691 | 34-659 | 1 | 0.42 | 0.16 | 0.05 | 0.05 | 0.09 | 0.08 | 0.00 | 0.05 | 0.04 | 0.05 | 0.03 | 0.06 | 0.06 | 0.06 |
| SEQID-00713 | P00691 | 34-659 | 1 | 0.42 | 0.16 | 0.05 | 0.05 | 0.09 | 0.08 | 0.00 | 0.05 | 0.04 | 0.05 | 0.03 | 0.06 | 0.06 | 0.06 |
| SEQID-00714 | P00691 | 34-659 | 1 | 0.43 | 0.16 | 0.05 | 0.05 | 0.09 | 0.08 | 0.00 | 0.05 | 0.04 | 0.05 | 0.03 | 0.06 | 0.06 | 0.06 |
| SEQID-00715 | P00691 | 34-659 | 1 | 0.43 | 0.16 | 0.05 | 0.05 | 0.09 | 0.08 | 0.00 | 0.05 | 0.04 | 0.05 | 0.03 | 0.06 | 0.06 | 0.06 |
| SEQID-00716 | E7Q2B6 | — | 1 | 0.46 | 0.20 | 0.06 | 0.07 | 0.04 | 0.09 | 0.01 | 0.06 | 0.07 | 0.03 | 0.02 | 0.07 | 0.06 | 0.10 |
| SEQID-00717 | E1BKT9 | — | 1 | 0.41 | 0.20 | 0.03 | 0.10 | 0.04 | 0.06 | 0.01 | 0.09 | 0.12 | 0.02 | 0.02 | 0.06 | 0.10 | 0.09 |
| SEQID-00718 | W5Q7Z7 | — | 1 | 0.42 | 0.20 | 0.03 | 0.10 | 0.04 | 0.06 | 0.01 | 0.09 | 0.12 | 0.02 | 0.02 | 0.06 | 0.11 | 0.10 |
| SEQID-00719 | F1RW75 | — | 1 | 0.41 | 0.20 | 0.04 | 0.10 | 0.04 | 0.05 | 0.02 | 0.09 | 0.12 | 0.02 | 0.02 | 0.05 | 0.10 | 0.10 |
| SEQID-00720 | Q8SPI1 | — | 1 | 0.45 | 0.20 | 0.06 | 0.07 | 0.05 | 0.06 | 0.02 | 0.06 | 0.07 | 0.03 | 0.02 | 0.04 | 0.13 | 0.10 |
| SEQID-00721 | Q6PVZ5 | — | 1 | 0.38 | 0.19 | 0.05 | 0.10 | 0.04 | 0.04 | 0.00 | 0.05 | 0.09 | 0.10 | 0.01 | 0.04 | 0.10 | 0.05 |
| SEQID-00722 | E7Q6N3 | — | 0 | 0.53 | 0.26 | 0.01 | 0.07 | 0.02 | 0.07 | 0.00 | 0.08 | 0.08 | 0.04 | 0.01 | 0.09 | 0.12 | 0.11 |
| SEQID-00723 | E7Q6P3 | — | 0 | 0.43 | 0.23 | 0.05 | 0.03 | 0.04 | 0.08 | 0.02 | 0.07 | 0.10 | 0.04 | 0.02 | 0.08 | 0.11 | 0.09 |
| SEQID-00724 | E7Q142 | — | 1 | 0.53 | 0.20 | 0.03 | 0.10 | 0.07 | 0.05 | 0.01 | 0.04 | 0.04 | 0.03 | 0.02 | 0.06 | 0.11 | 0.03 |
| SEQID-00725 | Q28161 | — | 1 | 0.38 | 0.16 | 0.05 | 0.07 | 0.04 | 0.05 | 0.03 | 0.04 | 0.07 | 0.06 | 0.03 | 0.06 | 0.10 | 0.06 |
| SEQID-00726 | P53478 | — | 1 | 0.47 | 0.20 | 0.05 | 0.10 | 0.06 | 0.06 | 0.01 | 0.06 | 0.05 | 0.04 | 0.03 | 0.10 | 0.07 | 0.06 |
| SEQID-00727 | A25W69 | — | 1 | 0.45 | 0.21 | 0.04 | 0.07 | 0.02 | 0.09 | 0.01 | 0.04 | 0.09 | 0.04 | 0.01 | 0.08 | 0.10 | 0.11 |
| SEQID-00728 | F1S3U9 | — | 1 | 0.51 | 0.21 | 0.04 | 0.03 | 0.03 | 0.08 | 0.01 | 0.08 | 0.08 | 0.03 | 0.01 | 0.06 | 0.06 | 0.11 |
| SEQID-00729 | E7Q765 | — | 1 | 0.40 | 0.18 | 0.04 | 0.05 | 0.05 | 0.06 | 0.02 | 0.05 | 0.05 | 0.04 | 0.03 | 0.09 | 0.09 | 0.11 |
| SEQID-00730 | E7Q9J9 | — | 1 | 0.51 | 0.23 | 0.04 | 0.03 | 0.03 | 0.06 | 0.00 | 0.04 | 0.17 | 0.02 | 0.03 | 0.05 | 0.06 | 0.09 |
| SEQID-00731 | F1SGG1 | — | 1 | 0.40 | 0.23 | 0.05 | 0.04 | 0.07 | 0.06 | 0.02 | 0.04 | 0.07 | 0.04 | 0.03 | 0.07 | 0.09 | 0.10 |
| SEQID-00732 | Q03763 | — | 1 | 0.43 | 0.22 | 0.01 | 0.11 | 0.05 | 0.05 | 0.00 | 0.07 | 0.12 | 0.03 | 0.02 | 0.05 | 0.13 | 0.06 |
| SEQID-00733 | F1STM4 | — | 1 | 0.52 | 0.20 | 0.05 | 0.07 | 0.04 | 0.07 | 0.02 | 0.03 | 0.07 | 0.06 | 0.02 | 0.07 | 0.11 | 0.04 |
| SEQID-00734 | E7Q5T7 | — | 1 | 0.42 | 0.19 | 0.03 | 0.03 | 0.04 | 0.04 | 0.01 | 0.04 | 0.07 | 0.06 | 0.03 | 0.07 | 0.06 | 0.11 |
| SEQID-00735 | E7Q880 | — | 1 | 0.44 | 0.21 | 0.06 | 0.06 | 0.07 | 0.08 | 0.00 | 0.04 | 0.16 | 0.01 | 0.02 | 0.05 | 0.11 | 0.11 |
| SEQID-00736 | K4BLT8 | — | 1 | 0.48 | 0.25 | 0.03 | 0.05 | 0.04 | 0.05 | 0.01 | 0.10 | 0.09 | 0.01 | 0.03 | 0.06 | 0.09 | 0.07 |
| SEQID-00737 | F1SFT0 | — | 0 | 0.28 | 0.09 | 0.02 | 0.04 | 0.02 | 0.03 | 0.18 | 0.11 | 0.00 | 0.04 | 0.00 | 0.01 | 0.02 | 0.06 |

TABLE 1-continued

| | | | | | | | | | | | | | | |
|---|---|---|---|---|---|---|---|---|---|---|---|---|---|---|
| SEQID-00738 | I3LK01 | — | 1 | 0.38 | 0.20 | 0.06 | 0.11 | 0.04 | 0.03 | 0.03 | 0.06 | 0.13 | 0.03 | 0.02 | 0.05 | 0.09 | 0.07 |
| SEQID-00739 | ASD984 | — | 1 | 0.48 | 0.23 | 0.07 | 0.08 | 0.04 | 0.06 | 0.02 | 0.03 | 0.08 | 0.04 | 0.03 | 0.08 | 0.08 | 0.08 |
| SEQID-00740 | E7Q1Q3 | — | 0 | 0.48 | 0.23 | 0.03 | 0.06 | 0.03 | 0.07 | 0.01 | 0.04 | 0.11 | 0.02 | 0.02 | 0.07 | 0.11 | 0.12 |
| SEQID-00741 | E7Q1V1 | — | 1 | 0.39 | 0.21 | 0.02 | 0.10 | 0.07 | 0.06 | 0.00 | 0.08 | 0.09 | 0.02 | 0.03 | 0.06 | 0.12 | 0.05 |
| SEQID-00742 | I1N6A2 | — | 1 | 0.43 | 0.22 | 0.05 | 0.11 | 0.04 | 0.06 | 0.00 | 0.06 | 0.10 | 0.03 | 0.02 | 0.07 | 0.10 | 0.07 |
| SEQID-00743 | P35323 | — | 0 | 0.29 | 0.08 | 0.01 | 0.00 | 0.00 | 0.00 | 0.09 | 0.06 | 0.08 | 0.00 | 0.03 | 0.01 | 0.00 | 0.14 |
| SEQID-00744 | F1SAM0 | — | 1 | 0.46 | 0.20 | 0.03 | 0.05 | 0.04 | 0.07 | 0.03 | 0.05 | 0.08 | 0.03 | 0.03 | 0.05 | 0.09 | 0.08 |
| SEQID-00745 | F1SGS9 | — | 1 | 0.43 | 0.16 | 0.05 | 0.08 | 0.06 | 0.04 | 0.01 | 0.07 | 0.06 | 0.03 | 0.05 | 0.04 | 0.06 | 0.06 |
| SEQID-00746 | I3LR13 | — | 1 | 0.40 | 0.19 | 0.04 | 0.11 | 0.02 | 0.05 | 0.01 | 0.04 | 0.09 | 0.03 | 0.04 | 0.02 | 0.12 | 0.02 |
| SEQID-00747 | P0C522 | — | 0 | 0.42 | 0.25 | 0.07 | 0.09 | 0.04 | 0.04 | 0.01 | 0.06 | 0.08 | 0.04 | 0.01 | 0.07 | 0.10 | 0.06 |
| SEQID-00748 | Q6KB38 | — | 1 | 0.46 | 0.23 | 0.05 | 0.09 | 0.03 | 0.03 | 0.01 | 0.07 | 0.06 | 0.03 | 0.02 | 0.05 | 0.12 | 0.06 |
| SEQID-00749 | Q2KJ64 | — | 1 | 0.51 | 0.24 | 0.03 | 0.05 | 0.02 | 0.04 | 0.01 | 0.07 | 0.06 | 0.03 | 0.03 | 0.05 | 0.07 | 0.07 |
| SEQID-00750 | F1MUE4 | — | 1 | 0.49 | 0.24 | 0.04 | 0.07 | 0.03 | 0.05 | 0.01 | 0.05 | 0.08 | 0.05 | 0.02 | 0.06 | 0.16 | 0.10 |
| SEQID-00751 | E1BLN6 | — | 1 | 0.23 | 0.12 | 0.02 | 0.11 | 0.01 | 0.02 | 0.10 | 0.10 | 0.12 | 0.01 | 0.01 | 0.02 | 0.04 | 0.08 |
| SEQID-00752 | E7Q207 | — | 1 | 0.48 | 0.20 | 0.06 | 0.07 | 0.04 | 0.04 | 0.00 | 0.03 | 0.06 | 0.03 | 0.05 | 0.05 | 0.08 | 0.03 |
| SEQID-00753 | E7QAF4 | — | 1 | 0.51 | 0.28 | 0.03 | 0.04 | 0.07 | 0.08 | 0.01 | 0.04 | 0.07 | 0.03 | 0.03 | 0.09 | 0.15 | 0.11 |
| SEQID-00754 | D7TRY0 | — | 1 | 0.37 | 0.13 | 0.04 | 0.06 | 0.05 | 0.05 | 0.00 | 0.03 | 0.19 | 0.03 | 0.01 | 0.03 | 0.05 | 0.09 |
| SEQID-00755 | Q9SWB6 | — | 0 | 0.50 | 0.20 | 0.05 | 0.04 | 0.04 | 0.04 | 0.02 | 0.04 | 0.06 | 0.03 | 0.02 | 0.06 | 0.09 | 0.14 |
| SEQID-00756 | W5P481 | — | 1 | 0.24 | 0.10 | 0.07 | 0.08 | 0.02 | 0.02 | 0.00 | 0.01 | 0.12 | 0.15 | 0.09 | 0.00 | 0.15 | 0.09 |
| SEQID-00757 | W5PVF9 | — | 1 | 0.37 | 0.15 | 0.04 | 0.09 | 0.05 | 0.05 | 0.01 | 0.05 | 0.06 | 0.15 | 0.03 | 0.04 | 0.11 | 0.05 |
| SEQID-00758 | F15GP9 | — | 1 | 0.41 | 0.19 | 0.03 | 0.10 | 0.05 | 0.06 | 0.02 | 0.04 | 0.08 | 0.03 | 0.04 | 0.07 | 0.04 | 0.06 |
| SEQID-00759 | F15II1 | — | 1 | 0.45 | 0.17 | 0.03 | 0.02 | 0.06 | 0.04 | 0.01 | 0.05 | 0.07 | 0.05 | 0.03 | 0.04 | 0.07 | 0.04 |
| SEQID-00760 | Q3SYU2 | — | 1 | 0.46 | 0.22 | 0.05 | 0.07 | 0.03 | 0.03 | 0.01 | 0.05 | 0.13 | 0.05 | 0.02 | 0.06 | 0.05 | 0.13 |
| SEQID-00761 | F1MWJ0 | — | 1 | 0.30 | 0.18 | 0.02 | 0.03 | 0.05 | 0.06 | 0.02 | 0.04 | 0.08 | 0.04 | 0.01 | 0.06 | 0.09 | 0.09 |
| SEQID-00762 | P02075 | — | 0 | 0.56 | 0.23 | 0.07 | 0.04 | 0.02 | 0.02 | 0.03 | 0.08 | 0.01 | 0.12 | 0.02 | 0.05 | 0.07 | 0.04 |
| SEQID-00763 | P60706 | — | 1 | 0.47 | 0.20 | 0.05 | 0.08 | 0.06 | 0.05 | 0.01 | 0.05 | 0.06 | 0.04 | 0.08 | 0.00 | 0.12 | 0.10 |
| SEQID-00764 | P01966 | — | 0 | 0.56 | 0.23 | 0.09 | 0.09 | 0.02 | 0.03 | 0.00 | 0.06 | 0.03 | 0.04 | 0.03 | 0.08 | 0.07 | 0.06 |
| SEQID-00765 | F1MKE9 | — | 1 | 0.43 | 0.19 | 0.05 | 0.03 | 0.04 | 0.08 | 0.00 | 0.08 | 0.04 | 0.03 | 0.09 | 0.00 | 0.15 | 0.09 |
| SEQID-00766 | Q3H7U1 | — | 1 | 0.43 | 0.17 | 0.04 | 0.07 | 0.03 | 0.07 | 0.02 | 0.05 | 0.12 | 0.15 | 0.03 | 0.04 | 0.11 | 0.07 |
| SEQID-00767 | O64937 | — | 1 | 0.52 | 0.21 | 0.04 | 0.06 | 0.04 | 0.06 | 0.01 | 0.02 | 0.09 | 0.03 | 0.03 | 0.03 | 0.08 | 0.04 |
| SEQID-00768 | K7LZH1 | — | 1 | 0.45 | 0.21 | 0.04 | 0.07 | 0.05 | 0.08 | 0.01 | 0.04 | 0.08 | 0.04 | 0.03 | 0.07 | 0.06 | 0.13 |
| SEQID-00769 | O77642 | — | 1 | 0.38 | 0.18 | 0.06 | 0.07 | 0.03 | 0.06 | 0.02 | 0.04 | 0.10 | 0.04 | 0.01 | 0.08 | 0.07 | 0.09 |
| SEQID-00770 | P28752 | — | 1 | 0.44 | 0.21 | 0.07 | 0.07 | 0.04 | 0.07 | 0.03 | 0.04 | 0.16 | 0.03 | 0.01 | 0.04 | 0.10 | 0.08 |
| SEQID-00771 | F6H7U7 | — | 1 | 0.43 | 0.21 | 0.05 | 0.08 | 0.05 | 0.06 | 0.02 | 0.05 | 0.09 | 0.03 | 0.04 | 0.06 | 0.08 | 0.05 |
| SEQID-00772 | F6HN28 | — | 1 | 0.44 | 0.21 | 0.06 | 0.09 | 0.03 | 0.06 | 0.01 | 0.05 | 0.11 | 0.04 | 0.02 | 0.05 | 0.11 | 0.09 |
| SEQID-00773 | W5PC91 | — | 1 | 0.42 | 0.19 | 0.05 | 0.09 | 0.03 | 0.08 | 0.01 | 0.04 | 0.12 | 0.02 | 0.03 | 0.06 | 0.11 | 0.06 |
| SEQID-00774 | C7IZV3 | — | 1 | 0.44 | 0.20 | 0.04 | 0.15 | 0.04 | 0.04 | 0.03 | 0.08 | 0.14 | 0.03 | 0.03 | 0.04 | 0.12 | 0.08 |
| SEQID-00775 | E1C4S8 | — | 1 | 0.42 | 0.19 | 0.06 | 0.08 | 0.04 | 0.05 | 0.00 | 0.03 | 0.05 | 0.04 | 0.05 | 0.06 | 0.08 | 0.06 |
| SEQID-00776 | G3MXL3 | — | 1 | 0.37 | 0.18 | 0.05 | 0.08 | 0.05 | 0.06 | 0.02 | 0.10 | 0.08 | 0.04 | 0.05 | 0.02 | 0.11 | 0.10 |
| SEQID-00777 | F1SKJ1 | — | 1 | 0.42 | 0.19 | 0.06 | 0.09 | 0.03 | 0.07 | 0.01 | 0.06 | 0.15 | 0.12 | 0.01 | 0.04 | 0.09 | 0.06 |
| SEQID-00778 | F1SSA6 | — | 1 | 0.42 | 0.19 | 0.06 | 0.09 | 0.04 | 0.05 | 0.02 | 0.08 | 0.16 | 0.02 | 0.02 | 0.04 | 0.11 | 0.11 |
| SEQID-00779 | F1SSS0 | — | 1 | 0.48 | 0.23 | 0.05 | 0.05 | 0.05 | 0.04 | 0.01 | 0.04 | 0.08 | 0.04 | 0.02 | 0.07 | 0.11 | 0.11 |
| SEQID-00780 | P02663 | — | 1 | 0.47 | 0.18 | 0.03 | 0.04 | 0.02 | 0.02 | 0.01 | 0.08 | 0.12 | 0.04 | 0.01 | 0.05 | 0.09 | 0.08 |
| SEQID-00781 | G1NEY4 | — | 1 | 0.38 | 0.19 | 0.05 | 0.10 | 0.04 | 0.04 | 0.00 | 0.05 | 0.09 | 0.00 | 0.02 | 0.04 | 0.07 | 0.12 |
| SEQID-00782 | P02543 | — | 1 | 0.37 | 0.19 | 0.04 | 0.13 | 0.04 | 0.06 | 0.00 | 0.03 | 0.13 | 0.10 | 0.01 | 0.04 | 0.10 | 0.06 |
| SEQID-00783 | K4CAJ3 | — | 1 | 0.45 | 0.20 | 0.04 | 0.10 | 0.04 | 0.04 | 0.02 | 0.04 | 0.10 | 0.01 | 0.04 | 0.06 | 0.12 | 0.05 |
| SEQID-00784 | E7Q2C6 | — | 1 | 0.47 | 0.25 | 0.05 | 0.05 | 0.04 | 0.06 | 0.01 | 0.04 | 0.09 | 0.03 | 0.02 | 0.07 | 0.08 | 0.06 |
| SEQID-00785 | P68103 | — | 1 | 0.51 | 0.21 | 0.06 | 0.05 | 0.04 | 0.06 | 0.01 | 0.03 | 0.07 | 0.05 | 0.03 | 0.07 | 0.11 | 0.10 |
| SEQID-00786 | Q04619 | — | 1 | 0.47 | 0.20 | 0.03 | 0.06 | 0.05 | 0.07 | 0.01 | 0.03 | 0.15 | 0.02 | 0.02 | 0.06 | 0.06 | 0.12 |
| SEQID-00787 | P31691 | — | 1 | 0.45 | 0.18 | 0.06 | 0.08 | 0.05 | 0.05 | 0.02 | 0.04 | 0.03 | 0.12 | 0.02 | 0.04 | 0.08 | 0.12 |
| SEQID-00788 | P00929 | — | 0 | 0.45 | 0.26 | 0.07 | 0.07 | 0.02 | 0.06 | 0.01 | 0.06 | 0.08 | 0.07 | 0.02 | 0.05 | 0.08 | 0.08 |
| SEQID-00789 | Q0IWN2 | — | 1 | 0.47 | 0.21 | 0.08 | 0.09 | 0.04 | 0.04 | 0.01 | 0.03 | 0.11 | 0.05 | 0.03 | 0.04 | 0.10 | 0.05 |
| SEQID-00790 | P0C276 | — | 0 | 0.48 | 0.22 | 0.02 | 0.11 | 0.05 | 0.05 | 0.04 | 0.07 | 0.06 | 0.03 | 0.03 | 0.03 | 0.10 | 0.15 |

TABLE 1-continued

| | | | | | | | | | | | | | | | |
|---|---|---|---|---|---|---|---|---|---|---|---|---|---|---|---|
| SEQID-00791 | E1B9D0 | — | 1 | 0.38 | 0.21 | 0.07 | 0.14 | 0.02 | 0.05 | 0.01 | 0.05 | 0.08 | 0.04 | 0.03 | 0.02 | 0.14 | 0.02 |
| SEQID-00792 | E1BXJ2 | — | 1 | 0.47 | 0.21 | 0.03 | 0.03 | 0.05 | 0.05 | 0.01 | 0.07 | 0.10 | 0.02 | 0.03 | 0.06 | 0.11 | 0.03 |
| SEQID-00793 | I1JFH4 | — | 1 | 0.50 | 0.20 | 0.05 | 0.03 | 0.03 | 0.05 | 0.01 | 0.03 | 0.11 | 0.02 | 0.03 | 0.04 | 0.09 | 0.09 |
| SEQID-00794 | I1NGL1 | — | 1 | 0.42 | 0.24 | 0.04 | 0.08 | 0.05 | 0.06 | 0.03 | 0.03 | 0.09 | 0.03 | 0.03 | 0.05 | 0.11 | 0.08 |
| SEQID-00795 | I3JQE4 | — | 1 | 0.48 | 0.23 | 0.06 | 0.05 | 0.03 | 0.05 | 0.02 | 0.06 | 0.08 | 0.03 | 0.05 | 0.05 | 0.13 | 0.08 |
| SEQID-00796 | W5NX33 | — | 1 | 0.47 | 0.22 | 0.02 | 0.07 | 0.10 | 0.05 | 0.02 | 0.04 | 0.08 | 0.02 | 0.01 | 0.06 | 0.10 | 0.05 |
| SEQID-00797 | E7Q6A3 | — | 1 | 0.46 | 0.23 | 0.04 | 0.05 | 0.05 | 0.05 | 0.02 | 0.05 | 0.06 | 0.05 | 0.05 | 0.05 | 0.13 | 0.05 |
| SEQID-00798 | E7Q9U4 | — | 1 | 0.45 | 0.21 | 0.04 | 0.04 | 0.05 | 0.06 | 0.01 | 0.05 | 0.10 | 0.05 | 0.01 | 0.06 | 0.08 | 0.12 |
| SEQID-00799 | E7Q306 | — | 1 | 0.43 | 0.22 | 0.04 | 0.05 | 0.07 | 0.07 | 0.01 | 0.03 | 0.06 | 0.04 | 0.03 | 0.05 | 0.10 | 0.07 |
| SEQID-00800 | E7BQS1 | — | 1 | 0.46 | 0.16 | 0.03 | 0.04 | 0.06 | 0.02 | 0.01 | 0.04 | 0.12 | 0.05 | 0.03 | 0.05 | 0.06 | 0.09 |
| SEQID-00801 | I1LP26 | — | 1 | 0.48 | 0.17 | 0.03 | 0.05 | 0.05 | 0.08 | 0.01 | 0.04 | 0.07 | 0.02 | 0.03 | 0.05 | 0.07 | 0.12 |
| SEQID-00802 | Q14BH5 | — | 1 | 0.38 | 0.20 | 0.05 | 0.09 | 0.05 | 0.08 | 0.02 | 0.07 | 0.10 | 0.04 | 0.01 | 0.05 | 0.10 | 0.17 |
| SEQID-00803 | P04653 | — | 1 | 0.42 | 0.21 | 0.04 | 0.04 | 0.03 | 0.05 | 0.00 | 0.05 | 0.11 | 0.02 | 0.02 | 0.06 | 0.11 | 0.08 |
| SEQID-00804 | E7QAF7 | — | 1 | 0.48 | 0.21 | 0.06 | 0.05 | 0.06 | 0.03 | 0.01 | 0.08 | 0.09 | 0.01 | 0.01 | 0.07 | 0.08 | 0.08 |
| SEQID-00805 | P11839 | — | 1 | 0.50 | 0.26 | 0.02 | 0.02 | 0.02 | 0.07 | 0.00 | 0.11 | 0.10 | 0.04 | 0.01 | 0.05 | 0.12 | 0.12 |
| SEQID-00806 | E7Q3D2 | — | 1 | 0.47 | 0.21 | 0.04 | 0.05 | 0.02 | 0.02 | 0.00 | 0.04 | 0.08 | 0.01 | 0.02 | 0.05 | 0.12 | 0.07 |
| SEQID-00807 | E7Q6T4 | — | 1 | 0.50 | 0.24 | 0.03 | 0.07 | 0.06 | 0.05 | 0.01 | 0.03 | 0.07 | 0.04 | 0.03 | 0.08 | 0.07 | 0.06 |
| SEQID-00808 | E7QA23 | — | 1 | 0.42 | 0.19 | 0.03 | 0.06 | 0.03 | 0.10 | 0.01 | 0.03 | 0.14 | 0.02 | 0.02 | 0.08 | 0.10 | 0.11 |
| SEQID-00809 | P02669 | — | 1 | 0.41 | 0.19 | 0.03 | 0.06 | 0.08 | 0.05 | 0.03 | 0.05 | 0.07 | 0.02 | 0.02 | 0.06 | 0.09 | 0.07 |
| SEQID-00810 | E7Q742 | — | 1 | 0.48 | 0.24 | 0.07 | 0.04 | 0.04 | 0.07 | 0.00 | 0.09 | 0.07 | 0.01 | 0.03 | 0.06 | 0.06 | 0.05 |
| SEQID-00811 | E7Q4K4 | — | 1 | 0.48 | 0.22 | 0.03 | 0.06 | 0.03 | 0.02 | 0.00 | 0.04 | 0.05 | 0.03 | 0.02 | 0.07 | 0.10 | 0.06 |
| SEQID-00812 | E7Q3Y5 | — | 1 | 0.47 | 0.22 | 0.04 | 0.03 | 0.06 | 0.10 | 0.00 | 0.04 | 0.06 | 0.04 | 0.03 | 0.05 | 0.12 | 0.07 |
| SEQID-00813 | O22493 | — | 1 | 0.48 | 0.20 | 0.04 | 0.05 | 0.05 | 0.04 | 0.00 | 0.03 | 0.15 | 0.01 | 0.02 | 0.06 | 0.13 | 0.12 |
| SEQID-00814 | Q69IM0 | — | 1 | 0.48 | 0.24 | 0.07 | 0.08 | 0.09 | 0.02 | 0.01 | 0.04 | 0.09 | 0.05 | 0.03 | 0.05 | 0.08 | 0.08 |
| SEQID-00815 | P00698 | — | 1 | 0.42 | 0.20 | 0.06 | 0.12 | 0.10 | 0.07 | 0.06 | 0.05 | 0.02 | 0.02 | 0.01 | 0.05 | 0.10 | 0.05 |
| SEQID-00816 | E7Q1A8 | — | 1 | 0.48 | 0.20 | 0.04 | 0.03 | 0.07 | 0.05 | 0.01 | 0.04 | 0.07 | 0.02 | 0.04 | 0.06 | 0.10 | 0.10 |
| SEQID-00817 | E7Q2C3 | — | 1 | 0.50 | 0.17 | 0.04 | 0.06 | 0.06 | 0.08 | 0.00 | 0.05 | 0.09 | 0.02 | 0.04 | 0.08 | 0.12 | 0.08 |
| SEQID-00818 | E7Q315 | — | 1 | 0.51 | 0.25 | 0.02 | 0.01 | 0.08 | 0.07 | 0.01 | 0.04 | 0.04 | 0.02 | 0.05 | 0.09 | 0.11 | 0.08 |
| SEQID-00819 | E7Q0X9 | — | 1 | 0.44 | 0.21 | 0.07 | 0.08 | 0.08 | 0.08 | 0.03 | 0.05 | 0.07 | 0.03 | 0.03 | 0.06 | 0.11 | 0.08 |
| SEQID-00820 | P62796 | — | 0 | 0.48 | 0.24 | 0.03 | 0.04 | 0.09 | 0.07 | 0.00 | 0.06 | 0.05 | 0.01 | 0.02 | 0.06 | 0.10 | 0.09 |
| SEQID-00821 | E7Q903 | — | 1 | 0.34 | 0.09 | 0.04 | 0.19 | 0.02 | 0.03 | 0.06 | 0.02 | 0.06 | 0.09 | 0.01 | 0.03 | 0.08 | 0.12 |
| SEQID-00822 | E7QA30 | — | 1 | 0.48 | 0.21 | 0.03 | 0.07 | 0.10 | 0.08 | 0.00 | 0.10 | 0.06 | 0.05 | 0.01 | 0.07 | 0.04 | 0.08 |
| SEQID-00823 | Q69IM0 | — | 1 | 0.48 | 0.22 | 0.04 | 0.05 | 0.04 | 0.04 | 0.00 | 0.03 | 0.15 | 0.02 | 0.01 | 0.07 | 0.09 | 0.12 |
| SEQID-00824 | F6HQQ4 | — | 1 | 0.50 | 0.24 | 0.07 | 0.09 | 0.07 | 0.02 | 0.01 | 0.04 | 0.09 | 0.05 | 0.03 | 0.07 | 0.08 | 0.08 |
| SEQID-00825 | F6HHW7 | — | 1 | 0.47 | 0.19 | 0.04 | 0.08 | 0.04 | 0.04 | 0.02 | 0.05 | 0.06 | 0.02 | 0.04 | 0.08 | 0.09 | 0.07 |
| SEQID-00826 | E7Q876 | — | 1 | 0.48 | 0.22 | 0.04 | 0.05 | 0.05 | 0.05 | 0.01 | 0.04 | 0.07 | 0.04 | 0.04 | 0.05 | 0.08 | 0.08 |
| SEQID-00827 | E7Q4C4 | — | 1 | 0.42 | 0.16 | 0.02 | 0.04 | 0.07 | 0.08 | 0.00 | 0.07 | 0.11 | 0.01 | 0.02 | 0.07 | 0.11 | 0.13 |
| SEQID-00828 | E7Q7F8 | — | 1 | 0.42 | 0.16 | 0.03 | 0.04 | 0.08 | 0.08 | 0.00 | 0.08 | 0.10 | 0.03 | 0.03 | 0.04 | 0.06 | 0.08 |
| SEQID-00829 | K9HAR9 | — | 1 | 0.45 | 0.21 | 0.04 | 0.04 | 0.06 | 0.06 | 0.01 | 0.04 | 0.06 | 0.03 | 0.03 | 0.04 | 0.09 | 0.08 |
| SEQID-00830 | F1MPS8 | — | 1 | 0.45 | 0.22 | 0.05 | 0.06 | 0.03 | 0.07 | 0.02 | 0.03 | 0.08 | 0.05 | 0.02 | 0.06 | 0.10 | 0.07 |
| SEQID-00831 | K7K247 | — | 1 | 0.44 | 0.19 | 0.03 | 0.09 | 0.04 | 0.07 | 0.01 | 0.10 | 0.14 | 0.02 | 0.03 | 0.04 | 0.11 | 0.12 |
| SEQID-00832 | K9HJK7 | — | 1 | 0.43 | 0.12 | 0.04 | 0.08 | 0.04 | 0.05 | 0.01 | 0.07 | 0.15 | 0.01 | 0.03 | 0.03 | 0.07 | 0.19 |
| SEQID-00833 | K9HV52 | — | 1 | 0.47 | 0.22 | 0.05 | 0.09 | 0.05 | 0.06 | 0.01 | 0.04 | 0.08 | 0.03 | 0.03 | 0.05 | 0.10 | 0.05 |
| SEQID-00834 | E1C4H7 | — | 1 | 0.42 | 0.19 | 0.05 | 0.11 | 0.03 | 0.04 | 0.03 | 0.03 | 0.10 | 0.05 | 0.03 | 0.06 | 0.04 | 0.04 |
| SEQID-00835 | E1BTL7 | — | 1 | 0.44 | 0.22 | 0.05 | 0.07 | 0.04 | 0.03 | 0.02 | 0.06 | 0.08 | 0.04 | 0.04 | 0.04 | 0.12 | 0.05 |
| SEQID-00836 | I1N1P3 | — | 1 | 0.42 | 0.19 | 0.03 | 0.09 | 0.05 | 0.05 | 0.02 | 0.08 | 0.06 | 0.02 | 0.02 | 0.05 | 0.06 | 0.07 |
| SEQID-00837 | W5PEW5 | — | 1 | 0.43 | 0.21 | 0.05 | 0.08 | 0.04 | 0.04 | 0.01 | 0.05 | 0.08 | 0.03 | 0.04 | 0.05 | 0.09 | 0.11 |
| SEQID-00838 | B0JEU3 | — | 1 | 0.42 | 0.20 | 0.03 | 0.06 | 0.04 | 0.04 | 0.01 | 0.10 | 0.18 | 0.01 | 0.02 | 0.03 | 0.13 | 0.11 |
| SEQID-00839 | P00724 | — | 1 | 0.35 | 0.16 | 0.03 | 0.12 | 0.06 | 0.06 | 0.02 | 0.13 | 0.11 | 0.04 | 0.02 | 0.04 | 0.07 | 0.06 |
| SEQID-00840 | P00724 | — | 1 | 0.45 | 0.16 | 0.03 | 0.03 | 0.09 | 0.07 | 0.01 | 0.04 | 0.06 | 0.04 | 0.01 | 0.04 | 0.07 | 0.05 |
| SEQID-00841 | K9HWU9 | — | 1 | 0.43 | 0.20 | 0.04 | 0.03 | 0.04 | 0.05 | 0.01 | 0.04 | 0.06 | 0.03 | 0.01 | 0.04 | 0.07 | 0.05 |
| SEQID-00842 | Q653V7 | — | 1 | 0.45 | 0.21 | 0.05 | 0.10 | 0.05 | 0.04 | 0.01 | 0.07 | 0.05 | 0.06 | 0.03 | 0.05 | 0.10 | 0.03 |
| SEQID-00843 | K5HXA6 | — | 1 | 0.46 | 0.17 | 0.05 | 0.06 | 0.05 | 0.05 | 0.02 | 0.07 | 0.05 | 0.05 | 0.03 | 0.05 | 0.07 | 0.04 |
| | P23776 | — | 1 | 0.43 | 0.19 | 0.04 | 0.05 | 0.06 | 0.09 | 0.02 | 0.05 | 0.07 | 0.03 | 0.03 | 0.06 | 0.09 | 0.04 |

TABLE 1-continued

| SEQID | ID | | | | | | | | | | | | | | |
|---|---|---|---|---|---|---|---|---|---|---|---|---|---|---|---|
| SEQID-00844 | F1MM32 | — | 1 | 0.46 | 0.20 | 0.06 | 0.10 | 0.03 | 0.03 | 0.02 | 0.04 | 0.06 | 0.04 | 0.03 | 0.03 | 0.05 |
| SEQID-00845 | P80025 | — | 1 | 0.46 | 0.20 | 0.04 | 0.09 | 0.05 | 0.06 | 0.02 | 0.05 | 0.06 | 0.03 | 0.04 | 0.04 | 0.06 |
| SEQID-00846 | Q67UF5 | — | 1 | 0.46 | 0.21 | 0.08 | 0.03 | 0.04 | 0.05 | 0.02 | 0.04 | 0.10 | 0.01 | 0.03 | 0.10 | 0.11 |
| SEQID-00847 | Q95114 | — | 1 | 0.45 | 0.18 | 0.04 | 0.07 | 0.06 | 0.05 | 0.04 | 0.06 | 0.05 | 0.03 | 0.05 | 0.09 | 0.04 |
| SEQID-00848 | F1MGU7 | — | 1 | 0.44 | 0.17 | 0.03 | 0.04 | 0.06 | 0.07 | 0.02 | 0.06 | 0.06 | 0.03 | 0.06 | 0.07 | 0.08 |
| SEQID-00849 | P15703 | — | 1 | 0.46 | 0.17 | 0.06 | 0.02 | 0.06 | 0.08 | 0.01 | 0.05 | 0.06 | 0.03 | 0.04 | 0.06 | 0.06 |
| SEQID-00850 | P53334 | — | 1 | 0.39 | 0.18 | 0.10 | 0.02 | 0.05 | 0.06 | 0.01 | 0.06 | 0.05 | 0.01 | 0.02 | 0.05 | 0.04 |
| SEQID-00851 | B4FBO6 | — | 1 | 0.38 | 0.17 | 0.07 | 0.07 | 0.04 | 0.04 | 0.03 | 0.06 | 0.04 | 0.03 | 0.04 | 0.05 | 0.04 |
| SEQID-00852 | E0CQY0 | — | 1 | 0.45 | 0.16 | 0.06 | 0.05 | 0.03 | 0.07 | 0.02 | 0.05 | 0.01 | 0.02 | 0.04 | 0.05 | 0.05 |
| SEQID-00853 | P01888 | — | 1 | 0.45 | 0.22 | 0.02 | 0.07 | 0.02 | 0.04 | 0.03 | 0.06 | 0.06 | 0.04 | 0.05 | 0.12 | 0.08 |
| SEQID-00854 | F1SU23 | — | 1 | 0.39 | 0.16 | 0.05 | 0.11 | 0.03 | 0.09 | 0.01 | 0.06 | 0.05 | 0.01 | 0.01 | 0.11 | 0.06 |
| SEQID-00855 | Q3SZR3 | — | 1 | 0.47 | 0.19 | 0.06 | 0.05 | 0.04 | 0.05 | 0.02 | 0.04 | 0.11 | 0.03 | 0.06 | 0.09 | 0.09 |
| SEQID-00856 | Q9MZ06 | — | 1 | 0.47 | 0.18 | 0.03 | 0.08 | 0.05 | 0.04 | 0.04 | 0.05 | 0.09 | 0.02 | 0.03 | 0.10 | 0.11 |
| SEQID-00857 | Q3ZCH5 | — | 1 | 0.38 | 0.15 | 0.06 | 0.09 | 0.02 | 0.06 | 0.01 | 0.05 | 0.08 | 0.03 | 0.07 | 0.09 | 0.04 |
| SEQID-00858 | G1MZ49 | — | 0 | 0.48 | 0.25 | 0.04 | 0.07 | 0.07 | 0.09 | 0.02 | 0.03 | 0.06 | 0.03 | 0.07 | 0.14 | 0.07 |
| SEQID-00859 | P80195 | — | 1 | 0.50 | 0.23 | 0.04 | 0.05 | 0.07 | 0.07 | 0.01 | 0.05 | 0.07 | 0.04 | 0.07 | 0.14 | 0.10 |
| SEQID-00860 | P04272 | — | 1 | 0.45 | 0.21 | 0.04 | 0.08 | 0.03 | 0.09 | 0.00 | 0.04 | 0.12 | 0.01 | 0.06 | 0.10 | 0.11 |
| SEQID-00861 | P60712 | — | 0 | 0.47 | 0.20 | 0.05 | 0.08 | 0.02 | 0.06 | 0.01 | 0.04 | 0.08 | 0.03 | 0.08 | 0.05 | 0.06 |
| SEQID-00862 | P63258 | — | 0 | 0.47 | 0.20 | 0.05 | 0.07 | 0.02 | 0.07 | 0.01 | 0.04 | 0.09 | 0.03 | 0.08 | 0.07 | 0.06 |
| SEQID-00863 | I1M076 | — | 0 | 0.52 | 0.26 | 0.02 | 0.07 | 0.05 | 0.06 | 0.00 | 0.04 | 0.09 | 0.03 | 0.09 | 0.12 | 0.11 |
| SEQID-00864 | P27161 | — | 0 | 0.45 | 0.17 | 0.05 | 0.05 | 0.04 | 0.08 | 0.01 | 0.05 | 0.05 | 0.01 | 0.05 | 0.08 | 0.08 |
| SEQID-00865 | Q84MN0 | — | 0 | 0.45 | 0.19 | 0.03 | 0.05 | 0.05 | 0.11 | 0.01 | 0.05 | 0.17 | 0.04 | 0.05 | 0.09 | 0.06 |
| SEQID-00866 | Q948R0 | — | 0 | 0.40 | 0.19 | 0.05 | 0.05 | 0.02 | 0.12 | 0.01 | 0.04 | 0.16 | 0.00 | 0.05 | 0.08 | 0.03 |
| SEQID-00867 | O23320 | — | 0 | 0.47 | 0.21 | 0.04 | 0.10 | 0.05 | 0.11 | 0.01 | 0.05 | 0.16 | 0.02 | 0.04 | 0.08 | 0.08 |
| SEQID-00868 | Q95744 | — | 0 | 0.48 | 0.16 | 0.05 | 0.01 | 0.02 | 0.06 | 0.01 | 0.05 | 0.17 | 0.03 | 0.08 | 0.09 | 0.08 |
| SEQID-00869 | Q41420 | — | 1 | 0.46 | 0.19 | 0.04 | 0.03 | 0.06 | 0.12 | 0.02 | 0.06 | 0.11 | 0.03 | 0.04 | 0.09 | 0.07 |
| SEQID-00870 | Q2R1Z5 | — | 1 | 0.45 | 0.16 | 0.03 | 0.06 | 0.06 | 0.08 | 0.01 | 0.03 | 0.15 | 0.04 | 0.06 | 0.07 | 0.11 |
| SEQID-00871 | Q046AS | — | 0 | 0.48 | 0.22 | 0.06 | 0.06 | 0.05 | 0.12 | 0.01 | 0.03 | 0.13 | 0.01 | 0.06 | 0.06 | 0.09 |
| SEQID-00872 | P00571 | — | 0 | 0.49 | 0.22 | 0.03 | 0.08 | 0.05 | 0.08 | 0.02 | 0.04 | 0.11 | 0.02 | 0.07 | 0.09 | 0.11 |
| SEQID-00873 | P05081 | — | 0 | 0.50 | 0.22 | 0.03 | 0.07 | 0.01 | 0.06 | 0.01 | 0.04 | 0.11 | 0.03 | 0.05 | 0.10 | 0.12 |
| SEQID-00874 | A5PJA1 | — | 1 | 0.46 | 0.24 | 0.01 | 0.07 | 0.01 | 0.06 | 0.02 | 0.04 | 0.12 | 0.04 | 0.05 | 0.11 | 0.13 |
| SEQID-00875 | Q9TTU2 | — | 1 | 0.45 | 0.22 | 0.01 | 0.05 | 0.06 | 0.08 | 0.01 | 0.04 | 0.14 | 0.03 | 0.07 | 0.10 | 0.08 |
| SEQID-00876 | Q9U88 | — | 1 | 0.49 | 0.23 | 0.01 | 0.07 | 0.05 | 0.07 | 0.03 | 0.03 | 0.17 | 0.03 | 0.08 | 0.10 | 0.06 |
| SEQID-00877 | Q12055 | — | 1 | 0.40 | 0.20 | 0.02 | 0.07 | 0.06 | 0.06 | 0.01 | 0.03 | 0.11 | 0.04 | 0.05 | 0.10 | 0.08 |
| SEQID-00878 | Q2KIW9 | — | 1 | 0.44 | 0.20 | 0.03 | 0.03 | 0.04 | 0.12 | 0.02 | 0.05 | 0.10 | 0.01 | 0.07 | 0.07 | 0.07 |
| SEQID-00879 | Q52KE7 | — | 1 | 0.43 | 0.20 | 0.03 | 0.11 | 0.07 | 0.08 | 0.00 | 0.04 | 0.09 | 0.05 | 0.07 | 0.07 | 0.11 |
| SEQID-00880 | P54877 | — | 0 | 0.28 | 0.09 | 0.10 | 0.10 | 0.04 | 0.12 | 0.04 | 0.02 | 0.03 | 0.14 | 0.06 | 0.03 | 0.09 |
| SEQID-00881 | Q10980 | — | 0 | 0.21 | 0.01 | 0.07 | 0.13 | 0.07 | 0.07 | 0.21 | 0.03 | 0.03 | 0.10 | 0.00 | 0.00 | 0.02 |
| SEQID-00882 | Q08000 | — | 0 | 0.28 | 0.09 | 0.04 | 0.16 | 0.04 | 0.03 | 0.00 | 0.02 | 0.18 | 0.10 | 0.02 | 0.05 | 0.08 |
| SEQID-00883 | Q6H595 | — | 1 | 0.31 | 0.09 | 0.01 | 0.16 | 0.02 | 0.08 | 0.08 | 0.06 | 0.05 | 0.07 | 0.01 | 0.04 | 0.08 |
| SEQID-00884 | Q6Z461 | — | 0 | 0.26 | 0.10 | 0.11 | 0.17 | 0.02 | 0.09 | 0.03 | 0.05 | 0.05 | 0.07 | 0.03 | 0.05 | 0.05 |
| SEQID-00885 | Q3T0I4 | — | 1 | 0.31 | 0.13 | 0.12 | 0.19 | 0.05 | 0.05 | 0.00 | 0.07 | 0.03 | 0.11 | 0.07 | 0.07 | 0.05 |
| SEQID-00886 | P46202 | 96:211 | 1 | 0.60 | 0.23 | 0.07 | 0.07 | 0.04 | 0.08 | 0.01 | 0.06 | 0.06 | 0.02 | 0.05 | 0.11 | 0.17 |
| SEQID-00887 | Q03338 | 261:356 | 1 | 0.48 | 0.16 | 0.03 | 0.12 | 0.06 | 0.10 | 0.00 | 0.06 | 0.11 | 0.05 | 0.04 | 0.05 | 0.15 |
| SEQID-00888 | P40568 | 331:406 | 1 | 0.37 | 0.22 | 0.02 | 0.03 | 0.09 | 0.06 | 0.01 | 0.03 | 0.11 | 0.04 | 0.04 | 0.06 | 0.08 |
| SEQID-00889 | Q32LH1 | 21:116 | 1 | 0.38 | 0.17 | 0.04 | 0.12 | 0.04 | 0.26 | 0.00 | 0.14 | 0.18 | 0.00 | 0.01 | 0.06 | 0.06 |
| SEQID-00890 | Q29RL0 | 676:821 | 1 | 0.33 | 0.17 | 0.04 | 0.21 | 0.04 | 0.01 | 0.00 | 0.13 | 0.26 | 0.00 | 0.03 | 0.12 | 0.05 |
| SEQID-00891 | Q2TBK0 | 56:181 | 1 | 0.40 | 0.14 | 0.07 | 0.11 | 0.02 | 0.07 | 0.01 | 0.13 | 0.17 | 0.00 | 0.04 | 0.09 | 0.10 |
| SEQID-00892 | Q06698 | 146:226 | 1 | 0.47 | 0.16 | 0.04 | 0.11 | 0.03 | 0.03 | 0.00 | 0.08 | 0.21 | 0.00 | 0.04 | 0.07 | 0.09 |
| SEQID-00893 | P53061 | 251:321 | 1 | 0.56 | 0.18 | 0.01 | 0.05 | 0.06 | 0.08 | 0.02 | 0.04 | 0.07 | 0.00 | 0.03 | 0.09 | 0.13 |
| SEQID-00894 | Q9BF40 | — | 1 | 0.45 | 0.19 | 0.05 | 0.07 | 0.04 | 0.05 | 0.01 | 0.07 | 0.10 | 0.02 | 0.03 | 0.10 | 0.22 |
| SEQID-00895 | F1MRC2 | — | 1 | 0.45 | 0.19 | 0.05 | 0.07 | 0.05 | 0.05 | 0.01 | 0.07 | 0.15 | 0.02 | 0.05 | 0.10 | 0.12 |
| SEQID-00896 | F1N757 | — | 1 | 0.47 | 0.21 | 0.04 | 0.06 | 0.03 | 0.05 | 0.02 | 0.05 | 0.11 | 0.02 | 0.06 | 0.07 | 0.09 |

TABLE 1-continued

| | | | | | | | | | | | | | |
|---|---|---|---|---|---|---|---|---|---|---|---|---|---|
| SEQID-00897 | Q9BE39 | — | 1 | 0.45 | 0.19 | 0.05 | 0.08 | 0.05 | 0.05 | 0.01 | 0.07 | 0.15 | 0.02 | 0.02 | 0.05 | 0.11 | 0.12 |
| SEQID-00898 | P68138 | — | 1 | 0.47 | 0.20 | 0.05 | 0.08 | 0.03 | 0.06 | 0.01 | 0.03 | 0.09 | 0.03 | 0.03 | 0.08 | 0.07 | 0.06 |
| SEQID-00899 | P63258 | — | 1 | 0.47 | 0.20 | 0.05 | 0.07 | 0.02 | 0.06 | 0.01 | 0.04 | 0.09 | 0.02 | 0.03 | 0.04 | 0.07 | 0.06 |
| SEQID-00900 | F1MZX6 | — | 1 | 0.44 | 0.19 | 0.05 | 0.07 | 0.05 | 0.05 | 0.01 | 0.08 | 0.14 | 0.02 | 0.02 | 0.04 | 0.11 | 0.11 |
| SEQID-00901 | Q9XSC6 | — | 1 | 0.50 | 0.20 | 0.03 | 0.07 | 0.05 | 0.05 | 0.01 | 0.04 | 0.03 | 0.05 | 0.05 | 0.04 | 0.10 | 0.10 |
| SEQID-00902 | F1MJ28 | — | 1 | 0.46 | 0.21 | 0.05 | 0.10 | 0.05 | 0.06 | 0.02 | 0.04 | 0.06 | 0.04 | 0.03 | 0.06 | 0.09 | 0.07 |
| SEQID-00903 | Q32CS5 | — | 1 | 0.44 | 0.20 | 0.05 | 0.09 | 0.05 | 0.06 | 0.01 | 0.07 | 0.09 | 0.02 | 0.03 | 0.07 | 0.09 | 0.07 |
| SEQID-00904 | Q0II9 | — | 0 | 0.43 | 0.20 | 0.06 | 0.10 | 0.04 | 0.06 | 0.00 | 0.05 | 0.11 | 0.03 | 0.03 | 0.05 | 0.11 | 0.06 |
| SEQID-00905 | Q5KR49 | — | 1 | 0.40 | 0.18 | 0.03 | 0.07 | 0.02 | 0.06 | 0.01 | 0.05 | 0.22 | 0.02 | 0.01 | 0.04 | 0.11 | 0.15 |
| SEQID-00906 | Q32C09 | — | 1 | 0.47 | 0.22 | 0.07 | 0.06 | 0.05 | 0.08 | 0.01 | 0.03 | 0.08 | 0.05 | 0.02 | 0.06 | 0.09 | 0.10 |
| SEQID-00907 | A6QP89 | — | 1 | 0.46 | 0.19 | 0.05 | 0.06 | 0.04 | 0.07 | 0.01 | 0.03 | 0.11 | 0.02 | 0.02 | 0.07 | 0.06 | 0.11 |
| SEQID-00908 | Q5KR48 | — | 0 | 0.39 | 0.17 | 0.07 | 0.07 | 0.02 | 0.08 | 0.01 | 0.06 | 0.23 | 0.03 | 0.01 | 0.04 | 0.10 | 0.15 |
| SEQID-00909 | P10096 | — | 1 | 0.52 | 0.22 | 0.06 | 0.04 | 0.06 | 0.06 | 0.02 | 0.02 | 0.05 | 0.05 | 0.04 | 0.07 | 0.06 | 0.09 |
| SEQID-00910 | P19858 | — | 1 | 0.53 | 0.28 | 0.04 | 0.05 | 0.05 | 0.06 | 0.01 | 0.02 | 0.06 | 0.04 | 0.03 | 0.08 | 0.11 | 0.09 |
| SEQID-00911 | E1BF23 | — | 1 | 0.45 | 0.20 | 0.04 | 0.08 | 0.03 | 0.06 | 0.00 | 0.03 | 0.09 | 0.04 | 0.03 | 0.04 | 0.08 | 0.08 |
| SEQID-00912 | A0NJ5 | — | 0 | 0.44 | 0.17 | 0.08 | 0.03 | 0.06 | 0.05 | 0.01 | 0.03 | 0.11 | 0.03 | 0.01 | 0.04 | 0.08 | 0.12 |
| SEQID-00913 | P02769 | — | 1 | 0.46 | 0.19 | 0.05 | 0.06 | 0.02 | 0.07 | 0.05 | 0.04 | 0.14 | 0.04 | 0.03 | 0.03 | 0.11 | 0.11 |
| SEQID-00914 | Q0VCY0 | — | 1 | 0.49 | 0.25 | 0.06 | 0.07 | 0.04 | 0.06 | 0.02 | 0.03 | 0.11 | 0.03 | 0.02 | 0.07 | 0.10 | 0.06 |
| SEQID-00915 | A5D984 | — | 1 | 0.48 | 0.23 | 0.05 | 0.08 | 0.04 | 0.06 | 0.02 | 0.04 | 0.09 | 0.04 | 0.03 | 0.08 | 0.09 | 0.08 |
| SEQID-00916 | Q0BDP0 | — | 1 | 0.48 | 0.23 | 0.07 | 0.08 | 0.03 | 0.06 | 0.01 | 0.03 | 0.03 | 0.04 | 0.02 | 0.08 | 0.08 | 0.08 |
| SEQID-00917 | F1MR86 | — | 1 | 0.46 | 0.12 | 0.05 | 0.04 | 0.03 | 0.06 | 0.01 | 0.05 | 0.06 | 0.05 | 0.06 | 0.09 | 0.03 | 0.14 |
| SEQID-00918 | Q3SZX4 | — | 1 | 0.47 | 0.17 | 0.05 | 0.06 | 0.05 | 0.05 | 0.10 | 0.02 | 0.04 | 0.03 | 0.06 | 0.02 | 0.09 | 0.09 |
| SEQID-00919 | Q0IIG5 | — | 1 | 0.48 | 0.22 | 0.05 | 0.10 | 0.05 | 0.05 | 0.02 | 0.03 | 0.07 | 0.05 | 0.06 | 0.04 | 0.08 | 0.10 |
| SEQID-00920 | F1MQI3 | — | 1 | 0.47 | 0.17 | 0.04 | 0.06 | 0.02 | 0.08 | 0.01 | 0.05 | 0.07 | 0.03 | 0.04 | 0.05 | 0.08 | 0.13 |
| SEQID-00921 | Q32BD7 | — | 1 | 0.51 | 0.20 | 0.04 | 0.06 | 0.04 | 0.04 | 0.02 | 0.03 | 0.07 | 0.05 | 0.04 | 0.06 | 0.09 | 0.07 |
| SEQID-00922 | G3MYN5 | — | 1 | 0.47 | 0.20 | 0.05 | 0.14 | 0.05 | 0.06 | 0.01 | 0.06 | 0.12 | 0.03 | 0.03 | 0.02 | 0.12 | 0.15 |
| SEQID-00923 | E1BNV1 | — | 1 | 0.48 | 0.20 | 0.04 | 0.07 | 0.02 | 0.07 | 0.01 | 0.04 | 0.10 | 0.03 | 0.05 | 0.05 | 0.07 | 0.11 |
| SEQID-00924 | E1BE25 | — | 1 | 0.44 | 0.23 | 0.06 | 0.08 | 0.04 | 0.06 | 0.01 | 0.03 | 0.08 | 0.06 | 0.02 | 0.05 | 0.08 | 0.11 |
| SEQID-00925 | F1MV90 | — | 1 | 0.40 | 0.19 | 0.07 | 0.06 | 0.05 | 0.05 | 0.02 | 0.08 | 0.21 | 0.01 | 0.01 | 0.05 | 0.11 | 0.07 |
| SEQID-00926 | Q3TDP6 | — | 0 | 0.52 | 0.23 | 0.06 | 0.04 | 0.06 | 0.06 | 0.02 | 0.02 | 0.07 | 0.05 | 0.02 | 0.05 | 0.10 | 0.12 |
| SEQID-00927 | Q0P571 | — | 1 | 0.48 | 0.16 | 0.06 | 0.05 | 0.05 | 0.09 | 0.01 | 0.05 | 0.08 | 0.04 | 0.02 | 0.05 | 0.09 | 0.12 |
| SEQID-00928 | A5PJM2 | — | 1 | 0.41 | 0.15 | 0.04 | 0.15 | 0.02 | 0.06 | 0.01 | 0.05 | 0.10 | 0.01 | 0.04 | 0.06 | 0.05 | 0.11 |
| SEQID-00929 | Q5E956 | — | 1 | 0.48 | 0.22 | 0.08 | 0.05 | 0.08 | 0.06 | 0.02 | 0.05 | 0.14 | 0.04 | 0.02 | 0.02 | 0.09 | 0.12 |
| SEQID-00930 | P02510 | — | 1 | 0.48 | 0.19 | 0.03 | 0.11 | 0.03 | 0.05 | 0.00 | 0.02 | 0.08 | 0.02 | 0.06 | 0.06 | 0.08 | 0.10 |
| SEQID-00931 | Q8MKI3 | — | 1 | 0.37 | 0.13 | 0.05 | 0.13 | 0.05 | 0.06 | 0.00 | 0.06 | 0.09 | 0.06 | 0.03 | 0.06 | 0.07 | 0.06 |
| SEQID-00932 | Q32BP1 | — | 1 | 0.45 | 0.21 | 0.04 | 0.11 | 0.04 | 0.07 | 0.01 | 0.04 | 0.21 | 0.03 | 0.03 | 0.05 | 0.10 | 0.15 |
| SEQID-00933 | O62654 | — | 0 | 0.37 | 0.19 | 0.06 | 0.13 | 0.04 | 0.05 | 0.00 | 0.04 | 0.07 | 0.04 | 0.03 | 0.05 | 0.10 | 0.07 |
| SEQID-00934 | F1MPR3 | — | 1 | 0.50 | 0.24 | 0.05 | 0.06 | 0.04 | 0.05 | 0.00 | 0.08 | 0.14 | 0.04 | 0.04 | 0.04 | 0.10 | 0.05 |
| SEQID-00935 | P00929 | — | 1 | 0.45 | 0.26 | 0.08 | 0.07 | 0.02 | 0.08 | 0.03 | 0.03 | 0.09 | 0.02 | 0.02 | 0.07 | 0.09 | 0.07 |
| SEQID-00936 | Q32KV0 | — | 0 | 0.48 | 0.18 | 0.06 | 0.04 | 0.03 | 0.06 | 0.00 | 0.05 | 0.10 | 0.03 | 0.01 | 0.07 | 0.09 | 0.05 |
| SEQID-00937 | F1MHT1 | — | 1 | 0.45 | 0.21 | 0.04 | 0.09 | 0.06 | 0.05 | 0.01 | 0.04 | 0.10 | 0.03 | 0.02 | 0.06 | 0.08 | 0.10 |
| SEQID-00938 | Q04467 | — | 1 | 0.50 | 0.19 | 0.05 | 0.08 | 0.04 | 0.07 | 0.02 | 0.04 | 0.08 | 0.03 | 0.04 | 0.05 | 0.10 | 0.06 |
| SEQID-00939 | P19483 | — | 1 | 0.44 | 0.25 | 0.07 | 0.07 | 0.03 | 0.06 | 0.00 | 0.05 | 0.06 | 0.04 | 0.04 | 0.06 | 0.07 | 0.09 |
| SEQID-00940 | E18B91 | — | 1 | 0.42 | 0.23 | 0.05 | 0.10 | 0.05 | 0.07 | 0.03 | 0.05 | 0.07 | 0.05 | 0.01 | 0.08 | 0.10 | 0.07 |
| SEQID-00941 | P85100 | — | 0 | 0.46 | 0.15 | 0.06 | 0.09 | 0.04 | 0.06 | 0.02 | 0.06 | 0.14 | 0.01 | 0.02 | 0.05 | 0.10 | 0.12 |
| SEQID-00942 | Q14BH2 | — | 1 | 0.44 | 0.22 | 0.04 | 0.04 | 0.04 | 0.05 | 0.01 | 0.04 | 0.12 | 0.05 | 0.02 | 0.04 | 0.10 | 0.10 |
| SEQID-00943 | F1MME6 | — | 1 | 0.44 | 0.19 | 0.05 | 0.07 | 0.05 | 0.06 | 0.01 | 0.04 | 0.10 | 0.03 | 0.03 | 0.05 | 0.06 | 0.09 |
| SEQID-00944 | Q3SZE5 | — | 0 | 0.50 | 0.16 | 0.05 | 0.04 | 0.06 | 0.08 | 0.00 | 0.05 | 0.12 | 0.03 | 0.01 | 0.06 | 0.06 | 0.11 |
| SEQID-00945 | P00570 | — | 0 | 0.48 | 0.22 | 0.05 | 0.04 | 0.05 | 0.06 | 0.00 | 0.04 | 0.07 | 0.03 | 0.01 | 0.06 | 0.09 | 0.11 |
| SEQID-00946 | Q3T149 | — | 1 | 0.40 | 0.17 | 0.03 | 0.09 | 0.03 | 0.05 | 0.01 | 0.06 | 0.11 | 0.05 | 0.03 | 0.05 | 0.10 | 0.04 |
| SEQID-00947 | Q5EA88 | — | 0 | 0.52 | 0.25 | 0.05 | 0.10 | 0.05 | 0.04 | 0.03 | 0.05 | 0.10 | 0.04 | 0.04 | 0.05 | 0.07 | 0.09 |
| SEQID-00948 | Q32LG3 | — | 1 | 0.50 | 0.25 | 0.08 | 0.05 | 0.08 | 0.04 | 0.02 | 0.03 | 0.08 | 0.05 | 0.02 | 0.07 | 0.10 | 0.09 |
| SEQID-00949 | Q27965 | — | 1 | 0.45 | 0.21 | 0.06 | 0.08 | 0.05 | 0.07 | 0.01 | 0.05 | 0.09 | 0.04 | 0.02 | 0.07 | 0.08 | 0.09 |

TABLE 1-continued

| | | | | | | | | | | | | | | |
|---|---|---|---|---|---|---|---|---|---|---|---|---|---|---|
| SEQID-00950 | P02070 | — | 0 | 0.57 | 0.23 | 0.07 | 0.04 | 0.05 | 0.06 | 0.01 | 0.02 | 0.06 | 0.04 | 0.00 | 0.12 | 0.10 |
| SEQID-00951 | P12344 | — | 1 | 0.47 | 0.19 | 0.07 | 0.07 | 0.04 | 0.05 | 0.02 | 0.05 | 0.06 | 0.04 | 0.06 | 0.08 | 0.08 |
| SEQID-00952 | A4FV78 | — | 1 | 0.47 | 0.24 | 0.04 | 0.05 | 0.04 | 0.08 | 0.02 | 0.04 | 0.09 | 0.05 | 0.06 | 0.11 | 0.10 |
| SEQID-00953 | F1MJW7 | — | 1 | 0.35 | 0.17 | 0.06 | 0.07 | 0.03 | 0.06 | 0.04 | 0.04 | 0.16 | 0.05 | 0.04 | 0.09 | 0.05 |
| SEQID-00954 | E1BF59 | — | 1 | 0.37 | 0.20 | 0.07 | 0.13 | 0.01 | 0.04 | 0.04 | 0.01 | 0.14 | 0.03 | 0.03 | 0.12 | 0.06 |
| SEQID-00955 | P01966 | — | 0 | 0.56 | 0.23 | 0.09 | 0.03 | 0.02 | 0.06 | 0.09 | 0.09 | 0.07 | 0.02 | 0.00 | 0.15 | 0.09 |
| SEQID-00956 | Q8SQ24 | — | 1 | 0.41 | 0.16 | 0.03 | 0.06 | 0.02 | 0.06 | 0.01 | 0.06 | 0.04 | 0.03 | 0.04 | 0.09 | 0.08 |
| SEQID-00957 | Q5E9B1 | — | 1 | 0.53 | 0.29 | 0.04 | 0.04 | 0.05 | 0.04 | 0.00 | 0.04 | 0.07 | 0.03 | 0.08 | 0.11 | 0.09 |
| SEQID-00958 | P33097 | — | 1 | 0.46 | 0.20 | 0.05 | 0.03 | 0.05 | 0.05 | 0.01 | 0.04 | 0.05 | 0.02 | 0.05 | 0.09 | 0.06 |
| SEQID-00959 | P19120 | — | 1 | 0.46 | 0.20 | 0.05 | 0.06 | 0.05 | 0.07 | 0.01 | 0.04 | 0.09 | 0.01 | 0.07 | 0.11 | 0.10 |
| SEQID-00960 | Q148F8 | — | 1 | 0.37 | 0.22 | 0.11 | 0.10 | 0.00 | 0.04 | 0.04 | 0.05 | 0.04 | 0.05 | 0.03 | 0.11 | 0.06 |
| SEQID-00961 | QSMKH62 | — | 1 | 0.38 | 0.14 | 0.04 | 0.14 | 0.02 | 0.04 | 0.00 | 0.09 | 0.09 | 0.03 | 0.05 | 0.07 | 0.02 |
| SEQID-00962 | F1MPU4 | — | 1 | 0.33 | 0.16 | 0.05 | 0.08 | 0.06 | 0.04 | 0.01 | 0.04 | 0.22 | 0.02 | 0.04 | 0.07 | 0.14 |
| SEQID-00963 | F1MLX6 | — | 1 | 0.48 | 0.18 | 0.03 | 0.06 | 0.06 | 0.03 | 0.02 | 0.06 | 0.06 | 0.04 | 0.04 | 0.07 | 0.07 |
| SEQID-00964 | G3N3C9 | — | 1 | 0.37 | 0.14 | 0.07 | 0.07 | 0.03 | 0.04 | 0.01 | 0.04 | 0.05 | 0.03 | 0.04 | 0.09 | 0.09 |
| SEQID-00965 | Q9N0V4 | — | 1 | 0.50 | 0.22 | 0.03 | 0.08 | 0.04 | 0.07 | 0.03 | 0.06 | 0.08 | 0.02 | 0.04 | 0.06 | 0.06 |
| SEQID-00966 | P02722 | — | 1 | 0.51 | 0.21 | 0.07 | 0.08 | 0.03 | 0.05 | 0.01 | 0.02 | 0.02 | 0.01 | 0.06 | 0.12 | 0.09 |
| SEQID-00967 | Q3T145 | — | 1 | 0.51 | 0.25 | 0.06 | 0.04 | 0.04 | 0.04 | 0.01 | 0.04 | 0.06 | 0.05 | 0.07 | 0.08 | 0.09 |
| SEQID-00968 | P68252 | — | 1 | 0.39 | 0.19 | 0.06 | 0.06 | 0.06 | 0.06 | 0.01 | 0.05 | 0.13 | 0.04 | 0.07 | 0.10 | 0.11 |
| SEQID-00969 | P45879 | — | 1 | 0.50 | 0.19 | 0.05 | 0.07 | 0.04 | 0.05 | 0.01 | 0.05 | 0.06 | 0.02 | 0.04 | 0.10 | 0.08 |
| SEQID-00970 | P81948 | — | 1 | 0.44 | 0.20 | 0.05 | 0.04 | 0.04 | 0.07 | 0.03 | 0.04 | 0.09 | 0.04 | 0.06 | 0.10 | 0.10 |
| SEQID-00971 | E1BI98 | — | 1 | 0.37 | 0.18 | 0.05 | 0.09 | 0.03 | 0.08 | 0.02 | 0.03 | 0.08 | 0.08 | 0.04 | 0.07 | 0.05 |
| SEQID-00972 | P68432 | — | 0 | 0.43 | 0.18 | 0.08 | 0.18 | 0.01 | 0.03 | 0.01 | 0.01 | 0.06 | 0.02 | 0.05 | 0.07 | 0.07 |
| SEQID-00973 | Q5E946 | — | 0 | 0.49 | 0.26 | 0.07 | 0.06 | 0.01 | 0.01 | 0.01 | 0.03 | 0.10 | 0.02 | 0.05 | 0.09 | 0.11 |
| SEQID-00974 | Q77834 | — | 1 | 0.50 | 0.22 | 0.05 | 0.05 | 0.02 | 0.06 | 0.00 | 0.03 | 0.08 | 0.05 | 0.06 | 0.10 | 0.12 |
| SEQID-00975 | P62261 | — | 1 | 0.41 | 0.20 | 0.06 | 0.07 | 0.04 | 0.07 | 0.02 | 0.04 | 0.13 | 0.03 | 0.07 | 0.10 | 0.10 |
| SEQID-00976 | Q2KHU5 | — | 1 | 0.44 | 0.20 | 0.08 | 0.11 | 0.04 | 0.09 | 0.01 | 0.03 | 0.07 | 0.02 | 0.05 | 0.11 | 0.08 |
| SEQID-00977 | P31800 | — | 1 | 0.41 | 0.20 | 0.07 | 0.09 | 0.02 | 0.05 | 0.03 | 0.03 | 0.10 | 0.04 | 0.04 | 0.11 | 0.03 |
| SEQID-00978 | E1BE77 | — | 1 | 0.41 | 0.20 | 0.06 | 0.11 | 0.01 | 0.04 | 0.02 | 0.05 | 0.05 | 0.04 | 0.02 | 0.13 | 0.05 |
| SEQID-00979 | G2803 | — | 0 | 0.48 | 0.22 | 0.04 | 0.11 | 0.02 | 0.02 | 0.12 | 0.02 | 0.10 | 0.04 | 0.06 | 0.08 | 0.12 |
| SEQID-00980 | G3MZF7 | — | 0 | 0.45 | 0.15 | 0.05 | 0.19 | 0.02 | 0.03 | 0.02 | 0.00 | 0.05 | 0.02 | 0.06 | 0.06 | 0.06 |
| SEQID-00981 | A1A4R1 | — | 0 | 0.44 | 0.23 | 0.09 | 0.13 | 0.00 | 0.11 | 0.01 | 0.04 | 0.18 | 0.03 | 0.06 | 0.12 | 0.13 |
| SEQID-00982 | P62803 | — | 0 | 0.48 | 0.16 | 0.07 | 0.09 | 0.05 | 0.02 | 0.01 | 0.04 | 0.06 | 0.03 | 0.05 | 0.05 | 0.18 |
| SEQID-00983 | Q5E947 | — | 1 | 0.51 | 0.20 | 0.04 | 0.05 | 0.02 | 0.08 | 0.02 | 0.05 | 0.04 | 0.04 | 0.08 | 0.06 | 0.11 |
| SEQID-00984 | P13621 | — | 0 | 0.52 | 0.26 | 0.06 | 0.09 | 0.03 | 0.03 | 0.01 | 0.06 | 0.06 | 0.02 | 0.05 | 0.12 | 0.11 |
| SEQID-00985 | P28801 | — | 1 | 0.43 | 0.23 | 0.05 | 0.06 | 0.04 | 0.05 | 0.01 | 0.09 | 0.05 | 0.01 | 0.05 | 0.11 | 0.11 |
| SEQID-00986 | Q3SYR3 | — | 1 | 0.42 | 0.17 | 0.05 | 0.06 | 0.04 | 0.04 | 0.02 | 0.04 | 0.16 | 0.04 | 0.02 | 0.14 | 0.07 |
| SEQID-00987 | Q32BU0 | — | 1 | 0.46 | 0.17 | 0.04 | 0.09 | 0.04 | 0.03 | 0.01 | 0.04 | 0.06 | 0.04 | 0.05 | 0.09 | 0.10 |
| SEQID-00988 | P13272 | — | 1 | 0.43 | 0.22 | 0.06 | 0.10 | 0.02 | 0.05 | 0.02 | 0.03 | 0.06 | 0.03 | 0.05 | 0.07 | 0.07 |
| SEQID-00989 | Q32I6 | — | 1 | 0.34 | 0.10 | 0.03 | 0.07 | 0.01 | 0.06 | 0.02 | 0.07 | 0.06 | 0.05 | 0.04 | 0.08 | 0.04 |
| SEQID-00990 | Q3SYZ8 | — | 1 | 0.38 | 0.17 | 0.07 | 0.10 | 0.01 | 0.07 | 0.12 | 0.03 | 0.10 | 0.04 | 0.01 | 0.06 | 0.06 |
| SEQID-00991 | P04272 | — | 1 | 0.45 | 0.21 | 0.04 | 0.08 | 0.03 | 0.06 | 0.02 | 0.04 | 0.06 | 0.03 | 0.05 | 0.10 | 0.11 |
| SEQID-00992 | P23004 | — | 1 | 0.43 | 0.22 | 0.09 | 0.06 | 0.05 | 0.09 | 0.00 | 0.05 | 0.08 | 0.04 | 0.06 | 0.11 | 0.06 |
| SEQID-00993 | P11179 | — | 1 | 0.44 | 0.22 | 0.08 | 0.10 | 0.05 | 0.11 | 0.01 | 0.03 | 0.07 | 0.01 | 0.04 | 0.12 | 0.07 |
| SEQID-00994 | Q32PH8 | — | 1 | 0.50 | 0.22 | 0.05 | 0.06 | 0.03 | 0.02 | 0.01 | 0.05 | 0.08 | 0.03 | 0.06 | 0.06 | 0.12 |
| SEQID-00995 | Q29RK1 | — | 1 | 0.46 | 0.22 | 0.06 | 0.06 | 0.04 | 0.08 | 0.01 | 0.05 | 0.06 | 0.03 | 0.08 | 0.13 | 0.06 |
| SEQID-00996 | F1N690 | — | 1 | 0.44 | 0.21 | 0.08 | 0.07 | 0.04 | 0.06 | 0.01 | 0.04 | 0.10 | 0.01 | 0.03 | 0.07 | 0.07 |
| SEQID-00997 | P79134 | — | 1 | 0.45 | 0.20 | 0.06 | 0.09 | 0.04 | 0.09 | 0.02 | 0.03 | 0.06 | 0.04 | 0.05 | 0.10 | 0.09 |
| SEQID-00998 | P20004 | — | 1 | 0.47 | 0.22 | 0.06 | 0.06 | 0.04 | 0.07 | 0.01 | 0.03 | 0.10 | 0.05 | 0.07 | 0.07 | 0.08 |
| SEQID-00999 | Q76LV2 | — | 1 | 0.47 | 0.19 | 0.05 | 0.07 | 0.01 | 0.06 | 0.01 | 0.07 | 0.06 | 0.04 | 0.08 | 0.09 | 0.12 |
| SEQID-01000 | E1BCU2 | — | 1 | 0.42 | 0.19 | 0.03 | 0.06 | 0.04 | 0.06 | 0.04 | 0.04 | 0.15 | 0.04 | 0.04 | 0.08 | 0.07 |
| SEQID-01001 | P02789 | — | 1 | 0.45 | 0.18 | 0.04 | 0.10 | 0.03 | 0.07 | 0.01 | 0.05 | 0.10 | 0.03 | 0.04 | 0.08 | 0.10 |
| SEQID-01002 | E1BQC2 | — | 1 | 0.46 | 0.19 | 0.05 | 0.06 | 0.04 | 0.07 | 0.04 | 0.03 | 0.07 | 0.02 | 0.04 | 0.08 | 0.09 |

TABLE 1-continued

| | | | | | | | | | | | | | | | |
|---|---|---|---|---|---|---|---|---|---|---|---|---|---|---|---|
| SEQID-01003 | F1NZY2 | — | 1 | 0.42 | 0.17 | 0.03 | 0.04 | 0.05 | 0.06 | 0.09 | 0.04 | 0.07 | 0.03 | 0.05 | 0.07 |
| SEQID-01004 | P01014 | — | 1 | 0.52 | 0.21 | 0.04 | 0.04 | 0.06 | 0.04 | 0.01 | 0.01 | 0.10 | 0.03 | 0.06 | 0.07 |
| SEQID-01005 | P00698 | — | 1 | 0.42 | 0.20 | 0.06 | 0.12 | 0.10 | 0.05 | 0.06 | 0.02 | 0.02 | 0.05 | 0.10 | 0.05 |
| SEQID-01006 | P01005 | — | 0 | 0.41 | 0.16 | 0.05 | 0.04 | 0.07 | 0.09 | 0.09 | 0.01 | 0.07 | 0.05 | 0.07 | 0.07 |
| SEQID-01007 | F1NFY4 | — | 1 | 0.39 | 0.17 | 0.04 | 0.08 | 0.05 | 0.06 | 0.09 | 0.03 | 0.07 | 0.02 | 0.06 | 0.06 |
| SEQID-01008 | E1C546 | — | 1 | 0.49 | 0.23 | 0.04 | 0.05 | 0.05 | 0.06 | 0.02 | 0.06 | 0.07 | 0.04 | 0.09 | 0.07 |
| SEQID-01009 | F1NIV0 | — | 1 | 0.49 | 0.22 | 0.05 | 0.04 | 0.03 | 0.03 | 0.00 | 0.06 | 0.06 | 0.06 | 0.10 | 0.06 |
| SEQID-01010 | P01013 | — | 1 | 0.54 | 0.22 | 0.04 | 0.04 | 0.05 | 0.05 | 0.01 | 0.03 | 0.10 | 0.05 | 0.09 | 0.03 |
| SEQID-01011 | E1BTF4 | — | 1 | 0.53 | 0.24 | 0.05 | 0.05 | 0.05 | 0.05 | 0.02 | 0.03 | 0.08 | 0.03 | 0.13 | 0.10 |
| SEQID-01012 | F1N8Q8 | — | 1 | 0.43 | 0.18 | 0.03 | 0.12 | 0.03 | 0.06 | 0.02 | 0.02 | 0.11 | 0.03 | 0.11 | 0.04 |
| SEQID-01013 | E1C1X2 | — | 1 | 0.49 | 0.28 | 0.06 | 0.06 | 0.02 | 0.04 | 0.03 | 0.05 | 0.05 | 0.04 | 0.16 | 0.04 |
| SEQID-01014 | F1P2P7 | — | 0 | 0.49 | 0.18 | 0.06 | 0.04 | 0.04 | 0.05 | 0.02 | 0.05 | 0.14 | 0.03 | 0.09 | 0.08 |
| SEQID-01015 | O42273 | — | 1 | 0.50 | 0.29 | 0.07 | 0.06 | 0.05 | 0.05 | 0.08 | 0.05 | 0.06 | 0.03 | 0.16 | 0.04 |
| SEQID-01016 | F1NTK2 | — | 1 | 0.52 | 0.22 | 0.03 | 0.05 | 0.03 | 0.04 | 0.01 | 0.01 | 0.07 | 0.06 | 0.09 | 0.07 |
| SEQID-01017 | F1NBL0 | — | 1 | 0.42 | 0.17 | 0.03 | 0.05 | 0.06 | 0.06 | 0.08 | 0.04 | 0.11 | 0.06 | 0.06 | 0.06 |
| SEQID-01018 | P02701 | — | 1 | 0.56 | 0.22 | 0.03 | 0.05 | 0.07 | 0.05 | 0.04 | 0.04 | 0.07 | 0.05 | 0.11 | 0.07 |
| SEQID-01019 | P02752 | — | 1 | 0.39 | 0.12 | 0.04 | 0.05 | 0.04 | 0.03 | 0.07 | 0.06 | 0.05 | 0.04 | 0.06 | 0.07 |
| SEQID-01020 | P21760 | — | 1 | 0.46 | 0.19 | 0.07 | 0.10 | 0.01 | 0.04 | 0.02 | 0.01 | 0.11 | 0.02 | 0.10 | 0.08 |
| SEQID-01021 | F1NVN3 | — | 1 | 0.42 | 0.18 | 0.06 | 0.06 | 0.06 | 0.05 | 0.04 | 0.06 | 0.12 | 0.01 | 0.08 | 0.06 |
| SEQID-01022 | F1N9M9 | — | 1 | 0.57 | 0.21 | 0.03 | 0.02 | 0.06 | 0.05 | 0.09 | 0.04 | 0.06 | 0.04 | 0.06 | 0.07 |
| SEQID-01023 | F1NPI8 | — | 1 | 0.43 | 0.21 | 0.04 | 0.06 | 0.04 | 0.04 | 0.02 | 0.06 | 0.00 | 0.05 | 0.11 | 0.11 |
| SEQID-01024 | P01038 | — | 1 | 0.42 | 0.24 | 0.06 | 0.09 | 0.03 | 0.05 | 0.03 | 0.06 | 0.06 | 0.03 | 0.10 | 0.07 |
| SEQID-01025 | P41366 | — | 1 | 0.43 | 0.20 | 0.04 | 0.09 | 0.04 | 0.04 | 0.02 | 0.04 | 0.08 | 0.04 | 0.09 | 0.06 |
| SEQID-01026 | P02668 | — | 1 | 0.44 | 0.20 | 0.05 | 0.04 | 0.06 | 0.06 | 0.01 | 0.04 | 0.07 | 0.07 | 0.06 | 0.06 |
| SEQID-01027 | P02663 | — | 1 | 0.47 | 0.18 | 0.03 | 0.04 | 0.04 | 0.04 | 0.01 | 0.08 | 0.12 | 0.05 | 0.07 | 0.12 |
| SEQID-01028 | G5E5H7 | — | 1 | 0.50 | 0.26 | 0.06 | 0.02 | 0.06 | 0.06 | 0.04 | 0.06 | 0.10 | 0.06 | 0.15 | 0.10 |
| SEQID-01029 | P24627 | — | 1 | 0.44 | 0.19 | 0.06 | 0.07 | 0.05 | 0.05 | 0.05 | 0.05 | 0.07 | 0.02 | 0.11 | 0.09 |
| SEQID-01030 | F1MUT3 | — | 1 | 0.43 | 0.20 | 0.05 | 0.06 | 0.04 | 0.04 | 0.03 | 0.04 | 0.08 | 0.03 | 0.09 | 0.08 |
| SEQID-01031 | Q2UVX4 | — | 1 | 0.47 | 0.23 | 0.04 | 0.07 | 0.04 | 0.06 | 0.01 | 0.06 | 0.03 | 0.02 | 0.09 | 0.08 |
| SEQID-01032 | Q95I14 | — | 1 | 0.45 | 0.18 | 0.04 | 0.07 | 0.06 | 0.05 | 0.04 | 0.06 | 0.05 | 0.03 | 0.09 | 0.04 |
| SEQID-01033 | P18892 | — | 1 | 0.45 | 0.21 | 0.04 | 0.09 | 0.02 | 0.05 | 0.02 | 0.03 | 0.11 | 0.02 | 0.09 | 0.05 |
| SEQID-01034 | P81265 | — | 1 | 0.42 | 0.19 | 0.05 | 0.07 | 0.06 | 0.06 | 0.03 | 0.05 | 0.07 | 0.04 | 0.07 | 0.07 |
| SEQID-01035 | P80025 | — | 1 | 0.46 | 0.20 | 0.04 | 0.09 | 0.04 | 0.05 | 0.02 | 0.05 | 0.06 | 0.04 | 0.11 | 0.06 |
| SEQID-01036 | P80195 | — | 0 | 0.50 | 0.23 | 0.04 | 0.05 | 0.06 | 0.03 | 0.01 | 0.06 | 0.12 | 0.07 | 0.14 | 0.10 |
| SEQID-01037 | Q9TUM6-2 | — | 1 | 0.45 | 0.23 | 0.06 | 0.05 | 0.05 | 0.05 | 0.01 | 0.07 | 0.08 | 0.05 | 0.11 | 0.08 |
| SEQID-01038 | P11151 | — | 1 | 0.48 | 0.20 | 0.04 | 0.06 | 0.05 | 0.06 | 0.00 | 0.03 | 0.07 | 0.04 | 0.09 | 0.08 |
| SEQID-01039 | F1N726 | — | 1 | 0.41 | 0.21 | 0.05 | 0.07 | 0.03 | 0.03 | 0.03 | 0.04 | 0.05 | 0.04 | 0.09 | 0.03 |
| SEQID-01040 | Q29443 | — | 1 | 0.44 | 0.17 | 0.05 | 0.05 | 0.04 | 0.07 | 0.03 | 0.03 | 0.04 | 0.03 | 0.11 | 0.11 |
| SEQID-01041 | F1MLW7 | — | 1 | 0.42 | 0.19 | 0.03 | 0.04 | 0.03 | 0.05 | 0.03 | 0.03 | 0.07 | 0.03 | 0.08 | 0.05 |
| SEQID-01042 | G5EST5 | — | 1 | 0.48 | 0.22 | 0.03 | 0.04 | 0.03 | 0.03 | 0.02 | 0.04 | 0.07 | 0.04 | 0.08 | 0.05 |
| SEQID-01043 | G5ES13 | — | 1 | 0.46 | 0.19 | 0.04 | 0.05 | 0.04 | 0.02 | 0.03 | 0.04 | 0.04 | 0.04 | 0.08 | 0.06 |
| SEQID-01044 | Q3ZCH5 | — | 1 | 0.38 | 0.15 | 0.06 | 0.09 | 0.02 | 0.06 | 0.01 | 0.06 | 0.10 | 0.03 | 0.07 | 0.04 |
| SEQID-01045 | P26201 | — | 1 | 0.52 | 0.24 | 0.03 | 0.04 | 0.06 | 0.02 | 0.02 | 0.03 | 0.06 | 0.02 | 0.09 | 0.08 |
| SEQID-01046 | Q0P569 | — | 1 | 0.39 | 0.18 | 0.05 | 0.10 | 0.03 | 0.06 | 0.00 | 0.09 | 0.15 | 0.04 | 0.12 | 0.08 |
| SEQID-01047 | E1BGX8 | — | 1 | 0.41 | 0.17 | 0.06 | 0.12 | 0.04 | 0.06 | 0.03 | 0.04 | 0.05 | 0.01 | 0.09 | 0.03 |
| SEQID-01048 | F1MLW8 | — | 1 | 0.44 | 0.20 | 0.03 | 0.03 | 0.02 | 0.07 | 0.03 | 0.03 | 0.04 | 0.04 | 0.11 | 0.11 |
| SEQID-01049 | G3N0V0 | — | 1 | 0.46 | 0.18 | 0.03 | 0.06 | 0.03 | 0.07 | 0.03 | 0.02 | 0.06 | 0.03 | 0.11 | 0.07 |
| SEQID-01050 | F1MGU7 | — | 1 | 0.44 | 0.17 | 0.03 | 0.04 | 0.04 | 0.07 | 0.03 | 0.03 | 0.06 | 0.02 | 0.05 | 0.07 |
| SEQID-01051 | G5E604 | — | 1 | 0.30 | 0.17 | 0.03 | 0.10 | 0.06 | 0.04 | 0.02 | 0.06 | 0.06 | 0.06 | 0.07 | 0.08 |
| SEQID-01052 | F6R3I5 | — | 1 | 0.44 | 0.15 | 0.06 | 0.04 | 0.05 | 0.04 | 0.06 | 0.08 | 0.02 | 0.00 | 0.06 | 0.00 |
| SEQID-01053 | Q4GZT4 | — | 1 | 0.55 | 0.26 | 0.05 | 0.05 | 0.04 | 0.04 | 0.02 | 0.05 | 0.04 | 0.03 | 0.06 | 0.07 |
| SEQID-01054 | F1N647 | — | 1 | 0.45 | 0.23 | 0.04 | 0.07 | 0.04 | 0.04 | 0.02 | 0.03 | 0.06 | 0.04 | 0.13 | 0.04 |
| SEQID-01055 | G3MXB5 | — | 1 | 0.42 | 0.22 | 0.04 | 0.02 | 0.05 | 0.03 | 0.05 | 0.07 | 0.04 | 0.02 | 0.12 | 0.04 |

TABLE 1-continued

| | | | | | | | | | | | | | | | |
|---|---|---|---|---|---|---|---|---|---|---|---|---|---|---|---|
| SEQID-01056 | Q27960 | — | 1 | 0.56 | 0.28 | 0.04 | 0.04 | 0.04 | 0.03 | 0.04 | 0.03 | 0.03 | 0.01 | 0.09 | 0.12 | 0.07 |
| SEQID-01057 | G3N028 | — | 1 | 0.34 | 0.16 | 0.03 | 0.06 | 0.06 | 0.03 | 0.03 | 0.07 | 0.07 | 0.01 | 0.05 | 0.06 | 0.03 |
| SEQID-01058 | P10790 | — | 1 | 0.60 | 0.22 | 0.02 | 0.05 | 0.04 | 0.01 | 0.04 | 0.04 | 0.06 | 0.02 | 0.05 | 0.07 | 0.11 |
| SEQID-01059 | Q3SZR3 | — | 1 | 0.47 | 0.19 | 0.06 | 0.08 | 0.05 | 0.02 | 0.04 | 0.05 | 0.11 | 0.03 | 0.06 | 0.09 | 0.09 |
| SEQID-01060 | Q9MZ06 | — | 1 | 0.47 | 0.18 | 0.03 | 0.03 | 0.04 | 0.04 | 0.05 | 0.06 | 0.09 | 0.02 | 0.03 | 0.10 | 0.11 |
| SEQID-01061 | P02702 | — | 1 | 0.41 | 0.12 | 0.05 | 0.08 | 0.05 | 0.06 | 0.05 | 0.04 | 0.06 | 0.03 | 0.06 | 0.06 | 0.06 |
| SEQID-01062 | A2I7M9 | — | 1 | 0.50 | 0.36 | 0.04 | 0.07 | 0.04 | 0.00 | 0.05 | 0.05 | 0.09 | 0.02 | 0.07 | 0.14 | 0.10 |
| SEQID-01063 | Q9XSG3 | — | 1 | 0.48 | 0.19 | 0.05 | 0.05 | 0.04 | 0.05 | 0.04 | 0.04 | 0.08 | 0.03 | 0.03 | 0.07 | 0.06 |
| SEQID-01064 | A6QL27 | — | 1 | 0.42 | 0.17 | 0.04 | 0.08 | 0.04 | 0.02 | 0.04 | 0.03 | 0.06 | 0.03 | 0.05 | 0.06 | 0.08 |
| SEQID-01065 | F1MM32 | — | 1 | 0.46 | 0.20 | 0.06 | 0.10 | 0.03 | 0.05 | 0.03 | 0.04 | 0.05 | 0.02 | 0.03 | 0.10 | 0.05 |
| SEQID-01066 | A0NP2 | — | 0 | 0.51 | 0.28 | 0.08 | 0.06 | 0.06 | 0.02 | 0.04 | 0.04 | 0.06 | 0.03 | 0.05 | 0.15 | 0.07 |
| SEQID-01067 | P01888 | — | 1 | 0.45 | 0.22 | 0.02 | 0.07 | 0.08 | 0.04 | 0.04 | 0.04 | 0.05 | 0.04 | 0.05 | 0.12 | 0.08 |
| SEQID-01068 | G3MXD9 | — | 0 | 0.47 | 0.27 | 0.03 | 0.06 | 0.03 | 0.03 | 0.07 | 0.03 | 0.06 | 0.00 | 0.02 | 0.14 | 0.04 |
| SEQID-01069 | P10152 | — | 0 | 0.44 | 0.19 | 0.02 | 0.12 | 0.02 | 0.02 | 0.03 | 0.04 | 0.03 | 0.05 | 0.07 | 0.07 | 0.07 |
| SEQID-01070 | Q3SYR8 | — | 1 | 0.42 | 0.31 | 0.03 | 0.03 | 0.03 | 0.04 | 0.05 | 0.01 | 0.15 | 0.04 | 0.01 | 0.06 | 0.06 |
| SEQID-01071 | Q8SPP7 | — | 1 | 0.38 | 0.20 | 0.06 | 0.09 | 0.06 | 0.03 | 0.08 | 0.01 | 0.07 | 0.04 | 0.06 | 0.09 | 0.06 |
| SEQID-01072 | P30932 | — | 1 | 0.55 | 0.26 | 0.04 | 0.04 | 0.03 | 0.04 | 0.03 | 0.05 | 0.03 | 0.02 | 0.10 | 0.11 | 0.02 |
| SEQID-01073 | P0S037-2 | — | 1 | 0.42 | 0.21 | 0.04 | 0.09 | 0.05 | 0.04 | 0.02 | 0.05 | 0.07 | 0.03 | 0.05 | 0.10 | 0.07 |
| SEQID-01074 | P02676 | — | 1 | 0.41 | 0.15 | 0.02 | 0.08 | 0.06 | 0.02 | 0.02 | 0.06 | 0.05 | 0.02 | 0.04 | 0.06 | 0.05 |
| SEQID-01075 | Q2TBI0 | — | 1 | 0.51 | 0.27 | 0.04 | 0.09 | 0.07 | 0.04 | 0.02 | 0.06 | 0.09 | 0.02 | 0.04 | 0.14 | 0.05 |
| SEQID-01076 | Q8WML4 | — | 1 | 0.37 | 0.14 | 0.08 | 0.04 | 0.04 | 0.03 | 0.04 | 0.04 | 0.06 | 0.04 | 0.03 | 0.07 | 0.02 |
| SEQID-01077 | P04776 | — | 1 | 0.38 | 0.17 | 0.04 | 0.08 | 0.04 | 0.05 | 0.11 | 0.04 | 0.03 | 0.02 | 0.05 | 0.08 | 0.06 |
| SEQID-01078 | Q94LX2 | — | 1 | 0.35 | 0.17 | 0.04 | 0.11 | 0.03 | 0.05 | 0.02 | 0.01 | 0.15 | 0.02 | 0.02 | 0.09 | 0.07 |
| SEQID-01079 | Q4LER6 | — | 1 | 0.37 | 0.16 | 0.03 | 0.11 | 0.03 | 0.06 | 0.01 | 0.01 | 0.12 | 0.01 | 0.03 | 0.08 | 0.08 |
| SEQID-01080 | Q9SB11 | — | 1 | 0.35 | 0.17 | 0.04 | 0.09 | 0.04 | 0.04 | 0.02 | 0.09 | 0.14 | 0.01 | 0.04 | 0.10 | 0.05 |
| SEQID-01081 | K7LZA4 | — | 1 | 0.37 | 0.17 | 0.03 | 0.09 | 0.06 | 0.06 | 0.03 | 0.10 | 0.11 | 0.01 | 0.03 | 0.08 | 0.04 |
| SEQID-01082 | P11828 | — | 1 | 0.37 | 0.17 | 0.03 | 0.08 | 0.06 | 0.06 | 0.03 | 0.10 | 0.10 | 0.01 | 0.04 | 0.08 | 0.04 |
| SEQID-01083 | P04347 | — | 1 | 0.36 | 0.17 | 0.04 | 0.08 | 0.08 | 0.04 | 0.02 | 0.12 | 0.09 | 0.02 | 0.03 | 0.08 | 0.04 |
| SEQID-01084 | I1L360 | — | 1 | 0.46 | 0.17 | 0.03 | 0.09 | 0.06 | 0.04 | 0.03 | 0.10 | 0.12 | 0.04 | 0.04 | 0.08 | 0.08 |
| SEQID-01085 | B3TDK6 | — | 1 | 0.47 | 0.22 | 0.04 | 0.07 | 0.05 | 0.04 | 0.01 | 0.05 | 0.07 | 0.04 | 0.06 | 0.11 | 0.07 |
| SEQID-01086 | Q04672 | — | 1 | 0.46 | 0.18 | 0.03 | 0.09 | 0.04 | 0.05 | 0.01 | 0.03 | 0.12 | 0.03 | 0.05 | 0.08 | 0.08 |
| SEQID-01087 | I1JF86 | — | 1 | 0.48 | 0.19 | 0.03 | 0.08 | 0.04 | 0.04 | 0.01 | 0.04 | 0.12 | 0.04 | 0.05 | 0.10 | 0.08 |
| SEQID-01088 | P09439 | — | 1 | 0.47 | 0.23 | 0.04 | 0.07 | 0.05 | 0.04 | 0.01 | 0.04 | 0.07 | 0.03 | 0.06 | 0.10 | 0.07 |
| SEQID-01089 | I1LXD1 | — | 1 | 0.51 | 0.21 | 0.05 | 0.06 | 0.04 | 0.06 | 0.03 | 0.03 | 0.07 | 0.02 | 0.06 | 0.10 | 0.09 |
| SEQID-01090 | P01070 | — | 1 | 0.47 | 0.22 | 0.04 | 0.06 | 0.04 | 0.04 | 0.02 | 0.04 | 0.03 | 0.02 | 0.06 | 0.06 | 0.08 |
| SEQID-01091 | P08170 | — | 1 | 0.47 | 0.22 | 0.04 | 0.06 | 0.04 | 0.05 | 0.01 | 0.06 | 0.06 | 0.04 | 0.03 | 0.09 | 0.07 |
| SEQID-01092 | Q2IOH4 | — | 1 | 0.53 | 0.24 | 0.05 | 0.06 | 0.05 | 0.06 | 0.01 | 0.04 | 0.08 | 0.04 | 0.06 | 0.10 | 0.07 |
| SEQID-01093 | C6TZ5 | — | 1 | 0.48 | 0.22 | 0.06 | 0.06 | 0.05 | 0.04 | 0.04 | 0.08 | 0.06 | 0.05 | 0.07 | 0.09 | 0.10 |
| SEQID-01094 | C6TN36 | — | 1 | 0.52 | 0.24 | 0.05 | 0.05 | 0.05 | 0.05 | 0.01 | 0.06 | 0.08 | 0.02 | 0.06 | 0.06 | 0.08 |
| SEQID-01095 | K7KL44 | — | 1 | 0.55 | 0.23 | 0.05 | 0.04 | 0.04 | 0.04 | 0.01 | 0.10 | 0.05 | 0.03 | 0.07 | 0.08 | 0.10 |
| SEQID-01096 | I1KC70 | — | 1 | 0.53 | 0.24 | 0.06 | 0.05 | 0.05 | 0.04 | 0.01 | 0.03 | 0.06 | 0.03 | 0.07 | 0.06 | 0.09 |
| SEQID-01097 | I1NGF4 | — | 0 | 0.41 | 0.22 | 0.03 | 0.10 | 0.03 | 0.07 | 0.08 | 0.02 | 0.09 | 0.03 | 0.06 | 0.11 | 0.10 |
| SEQID-01098 | I1NSS0 | — | 1 | 0.48 | 0.22 | 0.06 | 0.06 | 0.06 | 0.05 | 0.04 | 0.04 | 0.08 | 0.05 | 0.06 | 0.08 | 0.05 |
| SEQID-01099 | I1N747 | — | 1 | 0.46 | 0.22 | 0.03 | 0.09 | 0.05 | 0.03 | 0.01 | 0.03 | 0.08 | 0.03 | 0.03 | 0.09 | 0.03 |
| SEQID-01100 | P29531 | — | 1 | 0.47 | 0.23 | 0.12 | 0.08 | 0.01 | 0.03 | 0.01 | 0.04 | 0.07 | 0.04 | 0.05 | 0.10 | 0.05 |
| SEQID-01101 | I1LE33 | — | 1 | 0.38 | 0.17 | 0.03 | 0.07 | 0.05 | 0.04 | 0.01 | 0.07 | 0.15 | 0.04 | 0.04 | 0.09 | 0.05 |
| SEQID-01102 | I1JHR6 | — | 1 | 0.44 | 0.23 | 0.03 | 0.12 | 0.05 | 0.05 | 0.05 | 0.05 | 0.09 | 0.03 | 0.04 | 0.09 | 0.07 |
| SEQID-01103 | P13917 | — | 1 | 0.47 | 0.22 | 0.04 | 0.05 | 0.04 | 0.03 | 0.03 | 0.10 | 0.08 | 0.05 | 0.04 | 0.11 | 0.08 |
| SEQID-01104 | I1MAE6 | — | 1 | 0.49 | 0.22 | 0.06 | 0.05 | 0.05 | 0.04 | 0.03 | 0.03 | 0.02 | 0.04 | 0.04 | 0.06 | 0.10 |
| SEQID-01105 | I1KUG6 | — | 1 | 0.47 | 0.22 | 0.05 | 0.06 | 0.05 | 0.02 | 0.01 | 0.03 | 0.09 | 0.03 | 0.06 | 0.07 | 0.08 |
| SEQID-01106 | I1MA91 | — | 1 | 0.49 | 0.21 | 0.05 | 0.06 | 0.05 | 0.05 | 0.03 | 0.02 | 0.09 | 0.03 | 0.06 | 0.07 | 0.06 |
| SEQID-01107 | Q8RVH5 | — | 1 | 0.48 | 0.21 | 0.04 | 0.04 | 0.04 | 0.06 | 0.01 | 0.10 | 0.02 | 0.06 | 0.04 | 0.11 | 0.04 |
| SEQID-01108 | I1KAJ4 | — | 1 | 0.49 | 0.22 | 0.06 | 0.05 | 0.05 | 0.04 | 0.03 | 0.02 | 0.08 | 0.04 | 0.06 | 0.06 | 0.07 |

TABLE 1-continued

| | | | | | | | | | | | | | | | | |
|---|---|---|---|---|---|---|---|---|---|---|---|---|---|---|---|---|
| SEQID-01109 | Q71EW8 | — | 1 | 0.49 | 0.23 | 0.06 | 0.06 | 0.04 | 0.06 | 0.00 | 0.03 | 0.08 | 0.03 | 0.02 | 0.06 | 0.10 | 0.08 |
| SEQID-01110 | P05046 | — | 1 | 0.52 | 0.25 | 0.05 | 0.03 | 0.07 | 0.06 | 0.00 | 0.03 | 0.04 | 0.02 | 0.02 | 0.05 | 0.12 | 0.06 |
| SEQID-01111 | P19594 | — | 1 | 0.43 | 0.15 | 0.02 | 0.08 | 0.04 | 0.09 | 0.06 | 0.08 | 0.12 | 0.02 | 0.04 | 0.07 | 0.08 | 0.10 |
| SEQID-01112 | K7MIY8 | — | 1 | 0.49 | 0.23 | 0.04 | 0.06 | 0.03 | 0.05 | 0.01 | 0.04 | 0.10 | 0.03 | 0.04 | 0.06 | 0.11 | 0.06 |
| SEQID-01113 | P25698 | — | 1 | 0.52 | 0.21 | 0.04 | 0.06 | 0.04 | 0.06 | 0.01 | 0.02 | 0.07 | 0.04 | 0.03 | 0.07 | 0.06 | 0.13 |
| SEQID-01114 | I7FST9 | — | 1 | 0.46 | 0.18 | 0.05 | 0.03 | 0.02 | 0.06 | 0.01 | 0.05 | 0.10 | 0.03 | 0.03 | 0.05 | 0.06 | 0.10 |
| SEQID-01115 | C6T7Y1 | — | 1 | 0.47 | 0.21 | 0.05 | 0.07 | 0.06 | 0.07 | 0.01 | 0.03 | 0.09 | 0.04 | 0.01 | 0.08 | 0.07 | 0.06 |
| SEQID-01116 | I1JPW5 | — | 1 | 0.47 | 0.23 | 0.07 | 0.04 | 0.02 | 0.04 | 0.02 | 0.04 | 0.08 | 0.04 | 0.08 | 0.05 | 0.10 | 0.10 |
| SEQID-01117 | I1LN49 | — | 1 | 0.48 | 0.18 | 0.03 | 0.08 | 0.03 | 0.05 | 0.01 | 0.05 | 0.09 | 0.03 | 0.01 | 0.06 | 0.10 | 0.06 |
| SEQID-01118 | C6TNT2 | — | 1 | 0.48 | 0.19 | 0.05 | 0.04 | 0.05 | 0.06 | 0.01 | 0.04 | 0.09 | 0.02 | 0.01 | 0.05 | 0.09 | 0.11 |
| SEQID-01119 | O64458 | — | 1 | 0.45 | 0.18 | 0.04 | 0.05 | 0.04 | 0.04 | 0.02 | 0.05 | 0.09 | 0.04 | 0.04 | 0.06 | 0.08 | 0.08 |
| SEQID-01120 | P01064 | — | 0 | 0.28 | 0.08 | 0.00 | 0.08 | 0.02 | 0.08 | 0.16 | 0.05 | 0.03 | 0.05 | 0.04 | 0.02 | 0.06 | 0.07 |
| SEQID-01121 | C6WV3 | — | 1 | 0.44 | 0.18 | 0.05 | 0.06 | 0.02 | 0.06 | 0.01 | 0.06 | 0.08 | 0.04 | 0.04 | 0.05 | 0.07 | 0.07 |
| SEQID-01122 | C6TKH0 | — | 1 | 0.45 | 0.20 | 0.07 | 0.04 | 0.07 | 0.06 | 0.03 | 0.02 | 0.06 | 0.04 | 0.03 | 0.05 | 0.08 | 0.08 |
| SEQID-01123 | I1JGP8 | — | 1 | 0.50 | 0.24 | 0.08 | 0.04 | 0.04 | 0.05 | 0.02 | 0.04 | 0.10 | 0.02 | 0.02 | 0.06 | 0.11 | 0.08 |
| SEQID-01124 | I1KU68 | — | 1 | 0.47 | 0.22 | 0.05 | 0.07 | 0.04 | 0.07 | 0.01 | 0.04 | 0.07 | 0.04 | 0.01 | 0.06 | 0.08 | 0.11 |
| SEQID-01125 | I1KAB7 | — | 1 | 0.47 | 0.20 | 0.05 | 0.03 | 0.05 | 0.07 | 0.01 | 0.05 | 0.11 | 0.03 | 0.03 | 0.05 | 0.08 | 0.10 |
| SEQID-01126 | I1NFS4 | — | 1 | 0.44 | 0.24 | 0.07 | 0.08 | 0.04 | 0.05 | 0.00 | 0.03 | 0.11 | 0.05 | 0.03 | 0.05 | 0.09 | 0.05 |
| SEQID-01127 | P25272 | — | 1 | 0.48 | 0.24 | 0.04 | 0.06 | 0.03 | 0.05 | 0.02 | 0.05 | 0.08 | 0.04 | 0.02 | 0.06 | 0.10 | 0.04 |
| SEQID-01128 | H2D553 | — | 1 | 0.47 | 0.25 | 0.08 | 0.05 | 0.06 | 0.07 | 0.01 | 0.05 | 0.07 | 0.04 | 0.01 | 0.07 | 0.09 | 0.04 |
| SEQID-01129 | I1J84 | — | 1 | 0.48 | 0.25 | 0.03 | 0.05 | 0.03 | 0.05 | 0.02 | 0.04 | 0.05 | 0.04 | 0.02 | 0.07 | 0.08 | 0.06 |
| SEQID-01130 | I1KTX8 | — | 1 | 0.49 | 0.26 | 0.03 | 0.05 | 0.02 | 0.06 | 0.00 | 0.02 | 0.06 | 0.05 | 0.02 | 0.05 | 0.13 | 0.09 |
| SEQID-01131 | I1KU21 | — | 1 | 0.08 | 0.21 | 0.05 | 0.04 | 0.03 | 0.06 | 0.02 | 0.03 | 0.07 | 0.04 | 0.02 | 0.06 | 0.08 | 0.13 |
| SEQID-01132 | I1L3K7 | — | 1 | 0.45 | 0.22 | 0.07 | 0.04 | 0.05 | 0.07 | 0.01 | 0.05 | 0.14 | 0.02 | 0.03 | 0.05 | 0.08 | 0.07 |
| SEQID-01133 | I1K3X9 | — | 1 | 0.44 | 0.21 | 0.05 | 0.07 | 0.04 | 0.06 | 0.00 | 0.03 | 0.06 | 0.05 | 0.09 | 0.06 | 0.08 | 0.06 |
| SEQID-01134 | I1LDR2 | — | 1 | 0.42 | 0.17 | 0.04 | 0.05 | 0.05 | 0.07 | 0.01 | 0.04 | 0.10 | 0.11 | 0.01 | 0.04 | 0.08 | 0.10 |
| SEQID-01135 | O48548 | — | 1 | 0.46 | 0.24 | 0.06 | 0.07 | 0.04 | 0.06 | 0.01 | 0.05 | 0.09 | 0.04 | 0.01 | 0.07 | 0.07 | 0.10 |
| SEQID-01136 | O22518 | — | 1 | 0.48 | 0.24 | 0.08 | 0.08 | 0.04 | 0.06 | 0.01 | 0.06 | 0.14 | 0.02 | 0.03 | 0.06 | 0.09 | 0.04 |
| SEQID-01137 | Q01915 | — | 0 | 0.42 | 0.19 | 0.07 | 0.09 | 0.03 | 0.07 | 0.02 | 0.04 | 0.09 | 0.02 | 0.02 | 0.08 | 0.11 | 0.04 |
| SEQID-01138 | Q42806 | — | 1 | 0.43 | 0.26 | 0.07 | 0.06 | 0.04 | 0.05 | 0.01 | 0.08 | 0.06 | 0.05 | 0.01 | 0.05 | 0.06 | 0.06 |
| SEQID-01139 | D6C4Z9 | — | 1 | 0.50 | 0.25 | 0.06 | 0.06 | 0.04 | 0.06 | 0.02 | 0.02 | 0.08 | 0.04 | 0.02 | 0.07 | 0.10 | 0.09 |
| SEQID-01140 | I1K3K3 | — | 1 | 0.49 | 0.21 | 0.05 | 0.04 | 0.04 | 0.06 | 0.02 | 0.03 | 0.07 | 0.02 | 0.02 | 0.08 | 0.10 | 0.13 |
| SEQID-01141 | K7LEQ5 | — | 1 | 0.48 | 0.23 | 0.06 | 0.04 | 0.05 | 0.07 | 0.01 | 0.03 | 0.14 | 0.05 | 0.03 | 0.08 | 0.08 | 0.07 |
| SEQID-01142 | P26413 | — | 0 | 0.40 | 0.07 | 0.03 | 0.06 | 0.06 | 0.09 | 0.00 | 0.06 | 0.06 | 0.11 | 0.09 | 0.03 | 0.01 | 0.06 |
| SEQID-01143 | C6TG91 | — | 1 | 0.45 | 0.20 | 0.06 | 0.07 | 0.06 | 0.07 | 0.01 | 0.04 | 0.10 | 0.04 | 0.01 | 0.07 | 0.07 | 0.10 |
| SEQID-01144 | I1NJ85 | — | 1 | 0.46 | 0.23 | 0.05 | 0.12 | 0.03 | 0.04 | 0.01 | 0.07 | 0.08 | 0.05 | 0.01 | 0.05 | 0.09 | 0.10 |
| SEQID-01145 | K7M3E5 | — | 1 | 0.48 | 0.24 | 0.07 | 0.05 | 0.04 | 0.07 | 0.01 | 0.06 | 0.05 | 0.04 | 0.03 | 0.07 | 0.09 | 0.07 |
| SEQID-01146 | Q9ZNZ1 | — | 0 | 0.51 | 0.25 | 0.07 | 0.05 | 0.06 | 0.03 | 0.01 | 0.02 | 0.09 | 0.04 | 0.02 | 0.06 | 0.10 | 0.08 |
| SEQID-01147 | P27066 | — | 1 | 0.43 | 0.18 | 0.02 | 0.08 | 0.03 | 0.05 | 0.06 | 0.09 | 0.14 | 0.05 | 0.04 | 0.09 | 0.06 | 0.10 |
| SEQID-01148 | C6SVX5 | — | 1 | 0.46 | 0.19 | 0.06 | 0.09 | 0.03 | 0.04 | 0.02 | 0.03 | 0.09 | 0.05 | 0.04 | 0.04 | 0.10 | 0.06 |
| SEQID-01149 | I1JUP4 | — | 1 | 0.45 | 0.16 | 0.06 | 0.14 | 0.04 | 0.04 | 0.03 | 0.08 | 0.04 | 0.08 | 0.04 | 0.04 | 0.06 | 0.11 |
| SEQID-01150 | I1K354 | — | 1 | 0.46 | 0.24 | 0.08 | 0.05 | 0.04 | 0.06 | 0.01 | 0.04 | 0.06 | 0.04 | 0.01 | 0.08 | 0.10 | 0.05 |
| SEQID-01151 | I1K5E6 | — | 1 | 0.50 | 0.23 | 0.06 | 0.06 | 0.04 | 0.05 | 0.02 | 0.04 | 0.08 | 0.04 | 0.02 | 0.06 | 0.10 | 0.08 |
| SEQID-01152 | I1KYW3 | — | 1 | 0.49 | 0.23 | 0.05 | 0.08 | 0.04 | 0.06 | 0.01 | 0.03 | 0.03 | 0.04 | 0.03 | 0.08 | 0.10 | 0.06 |
| SEQID-01153 | I1LKD3 | — | 1 | 0.46 | 0.21 | 0.04 | 0.05 | 0.03 | 0.04 | 0.02 | 0.03 | 0.05 | 0.04 | 0.02 | 0.08 | 0.09 | 0.07 |
| SEQID-01154 | I1LQR8 | — | 1 | 0.49 | 0.20 | 0.05 | 0.06 | 0.03 | 0.05 | 0.03 | 0.03 | 0.09 | 0.04 | 0.03 | 0.05 | 0.10 | 0.08 |
| SEQID-01155 | I1LUL9 | — | 1 | 0.46 | 0.19 | 0.06 | 0.06 | 0.05 | 0.06 | 0.01 | 0.03 | 0.02 | 0.05 | 0.07 | 0.09 | 0.09 | 0.02 |
| SEQID-01156 | I1M1V8 | — | 1 | 0.45 | 0.22 | 0.07 | 0.08 | 0.04 | 0.07 | 0.07 | 0.03 | 0.07 | 0.04 | 0.02 | 0.04 | 0.09 | 0.06 |
| SEQID-01157 | K7KTR9 | — | 1 | 0.46 | 0.23 | 0.07 | 0.05 | 0.05 | 0.04 | 0.01 | 0.04 | 0.06 | 0.05 | 0.03 | 0.07 | 0.08 | 0.05 |
| SEQID-01158 | Q8LIW0 | — | 1 | 0.52 | 0.23 | 0.06 | 0.06 | 0.03 | 0.06 | 0.02 | 0.03 | 0.02 | 0.04 | 0.02 | 0.08 | 0.11 | 0.03 |
| SEQID-01159 | Q9XEY1 | — | 1 | 0.42 | 0.18 | 0.04 | 0.12 | 0.04 | 0.10 | 0.01 | 0.04 | 0.05 | 0.05 | 0.04 | 0.07 | 0.09 | 0.12 |
| SEQID-01160 | P28759 | — | 1 | 0.49 | 0.20 | 0.05 | 0.03 | 0.06 | 0.05 | 0.00 | 0.04 | 0.08 | 0.03 | 0.03 | 0.04 | 0.06 | 0.09 |
| SEQID-01161 | C6SVT0 | — | 1 | 0.46 | 0.23 | 0.04 | 0.06 | 0.05 | 0.05 | 0.03 | 0.06 | 0.08 | 0.03 | 0.02 | 0.04 | 0.10 | 0.09 |

TABLE 1-continued

| | | | | | | | | | | | | | |
|---|---|---|---|---|---|---|---|---|---|---|---|---|---|
| SEQID-01162 | C6T9B1 | — | 1 | 0.48 | 0.20 | 0.06 | 0.07 | 0.05 | 0.08 | 0.01 | 0.02 | 0.08 | 0.05 | 0.06 | 0.09 | 0.05 |
| SEQID-01163 | C6TGW2 | — | 1 | 0.39 | 0.19 | 0.08 | 0.08 | 0.03 | 0.07 | 0.01 | 0.03 | 0.14 | 0.02 | 0.05 | 0.10 | 0.07 |
| SEQID-01164 | I1JXA0 | — | 1 | 0.43 | 0.21 | 0.04 | 0.10 | 0.04 | 0.08 | 0.01 | 0.03 | 0.11 | 0.02 | 0.06 | 0.08 | 0.07 |
| SEQID-01165 | I1K4Q5 | — | 1 | 0.52 | 0.21 | 0.05 | 0.07 | 0.03 | 0.04 | 0.01 | 0.03 | 0.06 | 0.03 | 0.04 | 0.03 | 0.18 |
| SEQID-01166 | I1K5M9 | — | 1 | 0.46 | 0.21 | 0.05 | 0.06 | 0.04 | 0.07 | 0.01 | 0.02 | 0.08 | 0.03 | 0.06 | 0.08 | 0.07 |
| SEQID-01167 | I1MAE7 | — | 1 | 0.47 | 0.19 | 0.05 | 0.09 | 0.03 | 0.06 | 0.00 | 0.02 | 0.10 | 0.03 | 0.03 | 0.10 | 0.07 |
| SEQID-01168 | K7K4G2 | — | 1 | 0.40 | 0.15 | 0.03 | 0.13 | 0.04 | 0.04 | 0.01 | 0.05 | 0.20 | 0.04 | 0.04 | 0.07 | 0.10 |
| SEQID-01169 | K7MX62 | — | 1 | 0.53 | 0.18 | 0.06 | 0.05 | 0.04 | 0.05 | 0.00 | 0.02 | 0.10 | 0.02 | 0.03 | 0.04 | 0.15 |
| SEQID-01170 | P05478 | — | 0 | 0.48 | 0.17 | 0.03 | 0.08 | 0.06 | 0.07 | 0.00 | 0.02 | 0.12 | 0.01 | 0.04 | 0.07 | 0.11 |
| SEQID-01171 | C6SY27 | — | 0 | 0.52 | 0.24 | 0.05 | 0.14 | 0.03 | 0.08 | 0.01 | 0.03 | 0.04 | 0.00 | 0.07 | 0.07 | 0.17 |
| SEQID-01172 | C6T9D7 | — | 1 | 0.46 | 0.20 | 0.05 | 0.07 | 0.05 | 0.05 | 0.01 | 0.04 | 0.08 | 0.04 | 0.05 | 0.08 | 0.04 |
| SEQID-01173 | I1JFX0 | — | 1 | 0.49 | 0.22 | 0.06 | 0.05 | 0.03 | 0.04 | 0.01 | 0.05 | 0.07 | 0.02 | 0.05 | 0.08 | 0.08 |
| SEQID-01174 | I1KGP0 | — | 1 | 0.49 | 0.22 | 0.04 | 0.11 | 0.06 | 0.03 | 0.01 | 0.03 | 0.10 | 0.02 | 0.07 | 0.10 | 0.14 |
| SEQID-01175 | I1KJI7 | — | 1 | 0.49 | 0.22 | 0.05 | 0.07 | 0.03 | 0.04 | 0.00 | 0.03 | 0.03 | 0.02 | 0.10 | 0.05 | 0.07 |
| SEQID-01176 | I1L8R1 | — | 1 | 0.46 | 0.19 | 0.07 | 0.12 | 0.04 | 0.04 | 0.01 | 0.04 | 0.05 | 0.03 | 0.05 | 0.07 | 0.13 |
| SEQID-01177 | I1L1D6 | — | 1 | 0.45 | 0.18 | 0.07 | 0.14 | 0.04 | 0.05 | 0.00 | 0.03 | 0.03 | 0.03 | 0.05 | 0.05 | 0.09 |
| SEQID-01178 | I1LWR4 | — | 1 | 0.45 | 0.20 | 0.06 | 0.07 | 0.05 | 0.05 | 0.00 | 0.04 | 0.11 | 0.02 | 0.06 | 0.08 | 0.08 |
| SEQID-01179 | I1M561 | — | 1 | 0.49 | 0.25 | 0.03 | 0.06 | 0.04 | 0.04 | 0.00 | 0.03 | 0.09 | 0.02 | 0.05 | 0.13 | 0.08 |
| SEQID-01180 | I1N5E4 | — | 1 | 0.45 | 0.24 | 0.06 | 0.06 | 0.04 | 0.04 | 0.00 | 0.04 | 0.06 | 0.04 | 0.06 | 0.11 | 0.15 |
| SEQID-01181 | K7KN32 | — | 1 | 0.49 | 0.27 | 0.05 | 0.07 | 0.05 | 0.07 | 0.01 | 0.03 | 0.04 | 0.03 | 0.09 | 0.12 | 0.07 |
| SEQID-01182 | Q42807 | — | 0 | 0.44 | 0.18 | 0.04 | 0.10 | 0.03 | 0.06 | 0.00 | 0.05 | 0.10 | 0.03 | 0.06 | 0.08 | 0.12 |
| SEQID-01183 | A0A762 | — | 1 | 0.43 | 0.14 | 0.04 | 0.03 | 0.04 | 0.12 | 0.01 | 0.02 | 0.13 | 0.02 | 0.04 | 0.06 | 0.03 |
| SEQID-01184 | C6SZ13 | — | 1 | 0.50 | 0.28 | 0.09 | 0.05 | 0.01 | 0.04 | 0.01 | 0.10 | 0.02 | 0.02 | 0.08 | 0.11 | 0.04 |
| SEQID-01185 | C6T1V2 | — | 1 | 0.47 | 0.17 | 0.03 | 0.10 | 0.04 | 0.04 | 0.00 | 0.04 | 0.11 | 0.03 | 0.04 | 0.08 | 0.15 |
| SEQID-01186 | I1J0H6 | — | 1 | 0.48 | 0.20 | 0.03 | 0.14 | 0.02 | 0.06 | 0.02 | 0.03 | 0.07 | 0.04 | 0.04 | 0.04 | 0.09 |
| SEQID-01187 | I1KUR0 | — | 1 | 0.46 | 0.23 | 0.03 | 0.10 | 0.03 | 0.08 | 0.01 | 0.03 | 0.07 | 0.02 | 0.05 | 0.07 | 0.10 |
| SEQID-01188 | I1KZP9 | — | 1 | 0.54 | 0.18 | 0.04 | 0.10 | 0.02 | 0.04 | 0.01 | 0.05 | 0.05 | 0.04 | 0.06 | 0.10 | 0.06 |
| SEQID-01189 | I1LLR5 | — | 1 | 0.48 | 0.20 | 0.04 | 0.02 | 0.04 | 0.07 | 0.04 | 0.05 | 0.07 | 0.06 | 0.05 | 0.06 | 0.15 |
| SEQID-01190 | I1M3C1 | — | 0 | 0.42 | 0.18 | 0.07 | 0.11 | 0.03 | 0.04 | 0.00 | 0.02 | 0.09 | 0.05 | 0.04 | 0.11 | 0.07 |
| SEQID-01191 | I1MUH0 | — | 1 | 0.51 | 0.28 | 0.08 | 0.07 | 0.01 | 0.07 | 0.01 | 0.02 | 0.10 | 0.03 | 0.05 | 0.08 | 0.12 |
| SEQID-01192 | P04670 | — | 1 | 0.50 | 0.21 | 0.04 | 0.06 | 0.06 | 0.05 | 0.02 | 0.05 | 0.01 | 0.03 | 0.04 | 0.16 | 0.03 |
| SEQID-01193 | P17093 | — | 1 | 0.52 | 0.17 | 0.04 | 0.11 | 0.04 | 0.01 | 0.00 | 0.05 | 0.08 | 0.03 | 0.05 | 0.08 | 0.08 |
| SEQID-01194 | Q9SWB6 | — | 1 | 0.50 | 0.20 | 0.05 | 0.04 | 0.04 | 0.05 | 0.02 | 0.04 | 0.04 | 0.04 | 0.08 | 0.04 | 0.15 |
| SEQID-01195 | C6F117 | — | 1 | 0.51 | 0.25 | 0.03 | 0.12 | 0.04 | 0.04 | 0.01 | 0.03 | 0.12 | 0.02 | 0.06 | 0.09 | 0.09 |
| SEQID-01196 | C6K8D0 | — | 1 | 0.48 | 0.25 | 0.04 | 0.06 | 0.04 | 0.04 | 0.02 | 0.03 | 0.07 | 0.03 | 0.07 | 0.08 | 0.10 |
| SEQID-01197 | C6SWG9 | — | 1 | 0.43 | 0.17 | 0.06 | 0.14 | 0.06 | 0.03 | 0.04 | 0.04 | 0.05 | 0.02 | 0.04 | 0.10 | 0.06 |
| SEQID-01198 | C6SXS0 | — | 1 | 0.46 | 0.22 | 0.03 | 0.14 | 0.03 | 0.05 | 0.01 | 0.04 | 0.07 | 0.04 | 0.04 | 0.08 | 0.12 |
| SEQID-01199 | C6SZX7 | — | 1 | 0.48 | 0.20 | 0.05 | 0.03 | 0.05 | 0.06 | 0.02 | 0.05 | 0.08 | 0.01 | 0.06 | 0.08 | 0.10 |
| SEQID-01200 | C6T034 | — | 1 | 0.47 | 0.20 | 0.08 | 0.03 | 0.03 | 0.04 | 0.01 | 0.03 | 0.06 | 0.01 | 0.04 | 0.09 | 0.12 |
| SEQID-01201 | C6T048 | — | 1 | 0.50 | 0.19 | 0.04 | 0.03 | 0.04 | 0.07 | 0.02 | 0.03 | 0.11 | 0.01 | 0.03 | 0.08 | 0.12 |
| SEQID-01202 | C6T871 | — | 1 | 0.50 | 0.23 | 0.05 | 0.05 | 0.05 | 0.10 | 0.02 | 0.04 | 0.03 | 0.01 | 0.05 | 0.08 | 0.13 |
| SEQID-01203 | C6T9G0 | — | 1 | 0.44 | 0.20 | 0.05 | 0.06 | 0.03 | 0.07 | 0.10 | 0.05 | 0.08 | 0.03 | 0.06 | 0.10 | 0.03 |
| SEQID-01204 | C5TFI8 | — | 1 | 0.47 | 0.19 | 0.03 | 0.13 | 0.07 | 0.06 | 0.01 | 0.02 | 0.06 | 0.01 | 0.07 | 0.07 | 0.07 |
| SEQID-01205 | C6THM2 | — | 1 | 0.43 | 0.20 | 0.06 | 0.07 | 0.03 | 0.05 | 0.02 | 0.03 | 0.07 | 0.06 | 0.03 | 0.04 | 0.14 |
| SEQID-01206 | C6TJH2 | — | 1 | 0.51 | 0.25 | 0.02 | 0.19 | 0.00 | 0.05 | 0.01 | 0.03 | 0.08 | 0.04 | 0.06 | 0.10 | 0.09 |
| SEQID-01207 | I1JW44 | — | 1 | 0.46 | 0.23 | 0.06 | 0.05 | 0.04 | 0.05 | 0.01 | 0.05 | 0.02 | 0.01 | 0.09 | 0.10 | 0.12 |
| SEQID-01208 | I1JX53 | — | 1 | 0.41 | 0.20 | 0.06 | 0.10 | 0.03 | 0.04 | 0.03 | 0.05 | 0.09 | 0.01 | 0.04 | 0.08 | 0.04 |
| SEQID-01209 | I1K3R6 | — | 1 | 0.47 | 0.21 | 0.03 | 0.03 | 0.03 | 0.07 | 0.01 | 0.03 | 0.11 | 0.01 | 0.05 | 0.09 | 0.07 |
| SEQID-01210 | I1K467 | — | 0 | 0.50 | 0.19 | 0.04 | 0.05 | 0.04 | 0.10 | 0.02 | 0.04 | 0.03 | 0.05 | 0.05 | 0.08 | 0.05 |
| SEQID-01211 | I1K554 | — | 0 | 0.49 | 0.26 | 0.08 | 0.07 | 0.03 | 0.07 | 0.02 | 0.04 | 0.06 | 0.02 | 0.06 | 0.10 | 0.13 |
| SEQID-01212 | I1KDM8 | — | 0 | 0.45 | 0.18 | 0.03 | 0.19 | 0.00 | 0.05 | 0.10 | 0.05 | 0.09 | 0.03 | 0.03 | 0.07 | 0.09 |
| SEQID-01213 | I1KRJ7 | — | 1 | 0.48 | 0.25 | 0.08 | 0.05 | 0.04 | 0.05 | 0.01 | 0.03 | 0.03 | 0.02 | 0.07 | 0.04 | 0.14 |
| SEQID-01214 | I1KZT2 | — | 1 | 0.51 | 0.21 | 0.03 | 0.04 | 0.03 | 0.07 | 0.01 | 0.05 | 0.06 | 0.02 | 0.01 | 0.10 | 0.09 |
| SEQID-01215 | | — | 1 | 0.48 | 0.21 | 0.04 | 0.07 | 0.03 | 0.06 | 0.01 | 0.03 | 0.10 | 0.02 | 0.05 | 0.08 | 0.09 |

TABLE 1-continued

| | | | | | | | | | | | | | | |
|---|---|---|---|---|---|---|---|---|---|---|---|---|---|---|
| SEQID-01215 | I1LCQ1 | — | 1 | 0.52 | 0.26 | 0.05 | 0.06 | 0.03 | 0.06 | 0.01 | 0.03 | 0.08 | 0.03 | 0.08 | 0.11 | 0.09 |
| SEQID-01216 | I1M322 | — | 1 | 0.50 | 0.27 | 0.08 | 0.06 | 0.04 | 0.05 | 0.01 | 0.02 | 0.08 | 0.02 | 0.05 | 0.12 | 0.08 |
| SEQID-01217 | I1MC31 | — | 1 | 0.47 | 0.20 | 0.03 | 0.06 | 0.04 | 0.09 | 0.00 | 0.03 | 0.12 | 0.01 | 0.05 | 0.10 | 0.12 |
| SEQID-01218 | K7LSN8 | — | 1 | 0.50 | 0.19 | 0.05 | 0.05 | 0.02 | 0.03 | 0.02 | 0.03 | 0.05 | 0.03 | 0.06 | 0.05 | 0.07 |
| SEQID-01219 | K7M3Y6 | — | 1 | 0.52 | 0.26 | 0.04 | 0.07 | 0.02 | 0.08 | 0.02 | 0.04 | 0.06 | 0.05 | 0.06 | 0.11 | 0.06 |
| SEQID-01220 | A1VZE0 | — | 1 | 0.49 | 0.23 | 0.06 | 0.06 | 0.04 | 0.06 | 0.01 | 0.04 | 0.06 | 0.02 | 0.06 | 0.08 | 0.08 |
| SEQID-01221 | B2BF98 | — | 1 | 0.43 | 0.18 | 0.05 | 0.17 | 0.02 | 0.05 | 0.01 | 0.04 | 0.06 | 0.03 | 0.04 | 0.09 | 0.16 |
| SEQID-01222 | C6SV94 | — | 0 | 0.44 | 0.19 | 0.07 | 0.18 | 0.01 | 0.06 | 0.02 | 0.02 | 0.04 | 0.03 | 0.06 | 0.07 | 0.08 |
| SEQID-01223 | C63VR3 | — | 1 | 0.56 | 0.18 | 0.06 | 0.14 | 0.05 | 0.05 | 0.02 | 0.04 | 0.06 | 0.02 | 0.05 | 0.06 | 0.09 |
| SEQID-01224 | C6SVS3 | — | 1 | 0.46 | 0.23 | 0.04 | 0.04 | 0.04 | 0.03 | 0.00 | 0.02 | 0.07 | 0.02 | 0.04 | 0.12 | 0.17 |
| SEQID-01225 | C6SWA6 | — | 0 | 0.54 | 0.27 | 0.08 | 0.11 | 0.08 | 0.02 | 0.02 | 0.07 | 0.06 | 0.00 | 0.04 | 0.11 | 0.17 |
| SEQID-01226 | C6SWE0 | — | 1 | 0.50 | 0.19 | 0.07 | 0.03 | 0.02 | 0.06 | 0.00 | 0.05 | 0.10 | 0.03 | 0.08 | 0.10 | 0.11 |
| SEQID-01227 | C6SWG3 | — | 0 | 0.47 | 0.22 | 0.06 | 0.13 | 0.05 | 0.04 | 0.02 | 0.04 | 0.07 | 0.03 | 0.07 | 0.07 | 0.12 |
| SEQID-01228 | C6T085 | — | 0 | 0.52 | 0.23 | 0.05 | 0.03 | 0.05 | 0.07 | 0.02 | 0.05 | 0.06 | 0.04 | 0.06 | 0.08 | 0.08 |
| SEQID-01229 | C6T0U3 | — | 1 | 0.52 | 0.23 | 0.03 | 0.10 | 0.03 | 0.09 | 0.00 | 0.03 | 0.08 | 0.04 | 0.07 | 0.07 | 0.12 |
| SEQID-01230 | C6T530 | — | 0 | 0.47 | 0.22 | 0.04 | 0.13 | 0.02 | 0.05 | 0.01 | 0.02 | 0.09 | 0.04 | 0.04 | 0.08 | 0.12 |
| SEQID-01231 | C6T5U0 | — | 0 | 0.43 | 0.22 | 0.07 | 0.15 | 0.03 | 0.06 | 0.00 | 0.05 | 0.06 | 0.02 | 0.05 | 0.06 | 0.10 |
| SEQID-01232 | C6THA9 | — | 1 | 0.47 | 0.22 | 0.02 | 0.09 | 0.01 | 0.05 | 0.00 | 0.04 | 0.08 | 0.03 | 0.07 | 0.09 | 0.07 |
| SEQID-01233 | C6T64 | — | 1 | 0.52 | 0.20 | 0.05 | 0.09 | 0.05 | 0.07 | 0.02 | 0.05 | 0.07 | 0.04 | 0.06 | 0.06 | 0.15 |
| SEQID-01234 | C6TMB5 | — | 1 | 0.50 | 0.26 | 0.05 | 0.07 | 0.03 | 0.05 | 0.01 | 0.04 | 0.07 | 0.04 | 0.06 | 0.08 | 0.14 |
| SEQID-01235 | I1JA95 | — | 0 | 0.37 | 0.12 | 0.03 | 0.13 | 0.03 | 0.06 | 0.01 | 0.03 | 0.06 | 0.09 | 0.05 | 0.05 | 0.08 |
| SEQID-01236 | I1JSJ3 | — | 1 | 0.44 | 0.23 | 0.08 | 0.06 | 0.05 | 0.04 | 0.01 | 0.05 | 0.08 | 0.01 | 0.04 | 0.12 | 0.07 |
| SEQID-01237 | I1JXS7 | — | 1 | 0.45 | 0.18 | 0.04 | 0.04 | 0.04 | 0.09 | 0.01 | 0.04 | 0.12 | 0.01 | 0.07 | 0.07 | 0.11 |
| SEQID-01238 | I1K099 | — | 1 | 0.46 | 0.21 | 0.06 | 0.08 | 0.06 | 0.05 | 0.00 | 0.02 | 0.09 | 0.02 | 0.07 | 0.10 | 0.08 |
| SEQID-01239 | I1K1K4 | — | 1 | 0.55 | 0.27 | 0.08 | 0.05 | 0.08 | 0.01 | 0.01 | 0.09 | 0.04 | 0.06 | 0.04 | 0.15 | 0.02 |
| SEQID-01240 | I1K964 | — | 1 | 0.45 | 0.23 | 0.05 | 0.05 | 0.05 | 0.06 | 0.02 | 0.06 | 0.05 | 0.03 | 0.06 | 0.08 | 0.05 |
| SEQID-01241 | I1K910 | — | 1 | 0.45 | 0.22 | 0.07 | 0.07 | 0.03 | 0.06 | 0.03 | 0.04 | 0.06 | 0.04 | 0.08 | 0.07 | 0.07 |
| SEQID-01242 | I1K9M9 | — | 1 | 0.45 | 0.23 | 0.04 | 0.05 | 0.05 | 0.04 | 0.01 | 0.04 | 0.03 | 0.01 | 0.06 | 0.10 | 0.04 |
| SEQID-01243 | I1KG34 | — | 0 | 0.40 | 0.13 | 0.06 | 0.09 | 0.05 | 0.05 | 0.00 | 0.05 | 0.08 | 0.06 | 0.05 | 0.06 | 0.06 |
| SEQID-01244 | I1KZY9 | — | 1 | 0.47 | 0.22 | 0.04 | 0.06 | 0.04 | 0.04 | 0.01 | 0.04 | 0.06 | 0.04 | 0.05 | 0.12 | 0.05 |
| SEQID-01245 | I1L0S5 | — | 1 | 0.49 | 0.23 | 0.04 | 0.05 | 0.07 | 0.05 | 0.02 | 0.04 | 0.06 | 0.03 | 0.05 | 0.14 | 0.07 |
| SEQID-01246 | I1L5Q0 | — | 1 | 0.46 | 0.20 | 0.09 | 0.04 | 0.04 | 0.03 | 0.01 | 0.06 | 0.08 | 0.03 | 0.05 | 0.10 | 0.12 |
| SEQID-01247 | I1L957 | — | 0 | 0.38 | 0.09 | 0.05 | 0.12 | 0.05 | 0.05 | 0.00 | 0.02 | 0.11 | 0.01 | 0.05 | 0.02 | 0.18 |
| SEQID-01248 | I1LFD6 | — | 1 | 0.55 | 0.26 | 0.11 | 0.06 | 0.03 | 0.08 | 0.01 | 0.05 | 0.15 | 0.04 | 0.01 | 0.12 | 0.11 |
| SEQID-01249 | I1LIT1 | — | 1 | 0.45 | 0.23 | 0.05 | 0.01 | 0.03 | 0.04 | 0.00 | 0.01 | 0.09 | 0.03 | 0.04 | 0.09 | 0.08 |
| SEQID-01250 | I1MIA3 | — | 0 | 0.44 | 0.22 | 0.03 | 0.06 | 0.06 | 0.06 | 0.01 | 0.03 | 0.05 | 0.05 | 0.08 | 0.10 | 0.05 |
| SEQID-01251 | I1N1F9 | — | 1 | 0.48 | 0.21 | 0.06 | 0.10 | 0.06 | 0.07 | 0.01 | 0.02 | 0.08 | 0.04 | 0.05 | 0.10 | 0.07 |
| SEQID-01252 | I1N4U1 | — | 1 | 0.45 | 0.22 | 0.07 | 0.06 | 0.03 | 0.08 | 0.00 | 0.04 | 0.07 | 0.04 | 0.05 | 0.09 | 0.07 |
| SEQID-01253 | I1NH02 | — | 1 | 0.45 | 0.23 | 0.06 | 0.07 | 0.04 | 0.08 | 0.01 | 0.04 | 0.09 | 0.03 | 0.08 | 0.09 | 0.09 |
| SEQID-01254 | O23957 | — | 0 | 0.40 | 0.13 | 0.04 | 0.02 | 0.04 | 0.08 | 0.02 | 0.06 | 0.03 | 0.06 | 0.03 | 0.06 | 0.05 |
| SEQID-01255 | O49857 | — | 1 | 0.47 | 0.22 | 0.06 | 0.09 | 0.05 | 0.05 | 0.00 | 0.05 | 0.07 | 0.04 | 0.06 | 0.10 | 0.08 |
| SEQID-01256 | P00560 | — | 1 | 0.51 | 0.25 | 0.07 | 0.06 | 0.04 | 0.06 | 0.01 | 0.02 | 0.08 | 0.04 | 0.06 | 0.09 | 0.05 |
| SEQID-01257 | P00359 | — | 1 | 0.50 | 0.23 | 0.06 | 0.05 | 0.04 | 0.04 | 0.01 | 0.04 | 0.08 | 0.05 | 0.06 | 0.10 | 0.12 |
| SEQID-01258 | P00549 | — | 1 | 0.43 | 0.24 | 0.06 | 0.05 | 0.04 | 0.03 | 0.01 | 0.02 | 0.05 | 0.04 | 0.08 | 0.07 | 0.09 |
| SEQID-01259 | P00358 | — | 1 | 0.51 | 0.23 | 0.07 | 0.07 | 0.04 | 0.07 | 0.01 | 0.03 | 0.07 | 0.04 | 0.06 | 0.07 | 0.09 |
| SEQID-01260 | P10591 | — | 1 | 0.45 | 0.20 | 0.06 | 0.06 | 0.05 | 0.08 | 0.01 | 0.04 | 0.05 | 0.01 | 0.06 | 0.08 | 0.07 |
| SEQID-01261 | P00360 | — | 1 | 0.51 | 0.23 | 0.07 | 0.06 | 0.06 | 0.08 | 0.00 | 0.04 | 0.09 | 0.01 | 0.08 | 0.06 | 0.10 |
| SEQID-01262 | P10592 | — | 1 | 0.45 | 0.20 | 0.06 | 0.04 | 0.06 | 0.08 | 0.01 | 0.03 | 0.04 | 0.03 | 0.03 | 0.08 | 0.10 |
| SEQID-01263 | P00942 | — | 1 | 0.49 | 0.24 | 0.07 | 0.06 | 0.07 | 0.05 | 0.00 | 0.04 | 0.10 | 0.04 | 0.06 | 0.08 | 0.10 |
| SEQID-01264 | P02994 | — | 1 | 0.52 | 0.21 | 0.05 | 0.05 | 0.05 | 0.06 | 0.01 | 0.03 | 0.08 | 0.05 | 0.06 | 0.05 | 0.10 |
| SEQID-01265 | P06169 | — | 1 | 0.51 | 0.23 | 0.06 | 0.06 | 0.06 | 0.05 | 0.01 | 0.03 | 0.06 | 0.04 | 0.07 | 0.10 | 0.13 |
| SEQID-01266 | P22943 | — | 0 | 0.35 | 0.10 | 0.08 | 0.04 | 0.03 | 0.11 | 0.00 | 0.07 | 0.12 | 0.06 | 0.01 | 0.03 | 0.07 |
| SEQID-01267 | P14540 | — | 1 | 0.47 | 0.19 | 0.06 | 0.04 | 0.05 | 0.05 | 0.01 | 0.03 | 0.10 | 0.04 | 0.07 | 0.07 | 0.16 |

TABLE 1-continued

| | | | | | | | | | | | | | | |
|---|---|---|---|---|---|---|---|---|---|---|---|---|---|---|
| SEQID-01268 | P05694 | — | — | 1 | 0.40 | 0.22 | 0.05 | 0.06 | 0.05 | 0.06 | 0.00 | 0.04 | 0.08 | 0.03 | 0.02 | 0.06 | 0.09 | 0.09 |
| SEQID-01269 | P31539 | — | — | 0 | 0.44 | 0.23 | 0.05 | 0.08 | 0.04 | 0.08 | 0.01 | 0.07 | 0.10 | 0.03 | 0.02 | 0.08 | 0.11 | 0.09 |
| SEQID-01270 | P15103 | — | — | 1 | 0.48 | 0.21 | 0.04 | 0.05 | 0.04 | 0.07 | 0.00 | 0.03 | 0.15 | 0.02 | 0.01 | 0.07 | 0.10 | 0.12 |
| SEQID-01271 | P32324 | — | — | 1 | 0.49 | 0.23 | 0.05 | 0.07 | 0.03 | 0.07 | 0.00 | 0.04 | 0.08 | 0.04 | 0.02 | 0.06 | 0.08 | 0.08 |
| SEQID-01272 | Q07653 | — | — | 1 | 0.38 | 0.09 | 0.04 | 0.05 | 0.08 | 0.08 | 0.00 | 0.05 | 0.07 | 0.04 | 0.06 | 0.03 | 0.02 | 0.09 |
| SEQID-01273 | P24730 | — | — | 1 | 0.37 | 0.17 | 0.05 | 0.06 | 0.03 | 0.05 | 0.01 | 0.12 | 0.13 | 0.01 | 0.02 | 0.05 | 0.09 | 0.09 |
| SEQID-01274 | P02829 | — | — | 1 | 0.48 | 0.21 | 0.01 | 0.05 | 0.04 | 0.04 | 0.00 | 0.03 | 0.15 | 0.02 | 0.01 | 0.07 | 0.09 | 0.07 |
| SEQID-01275 | Q08969 | — | — | 1 | 0.25 | 0.05 | 0.05 | 0.10 | 0.09 | 0.13 | 0.00 | 0.17 | 0.06 | 0.07 | 0.03 | 0.01 | 0.04 | 0.12 |
| SEQID-01276 | P46367 | — | — | 1 | 0.48 | 0.23 | 0.05 | 0.05 | 0.05 | 0.05 | 0.00 | 0.04 | 0.08 | 0.03 | 0.02 | 0.09 | 0.07 | 0.03 |
| SEQID-01277 | P00950 | — | — | 1 | 0.45 | 0.22 | 0.06 | 0.07 | 0.05 | 0.04 | 0.01 | 0.04 | 0.06 | 0.04 | 0.02 | 0.05 | 0.11 | 0.09 |
| SEQID-01278 | P14126 | — | — | 1 | 0.52 | 0.18 | 0.05 | 0.12 | 0.02 | 0.04 | 0.00 | 0.02 | 0.06 | 0.04 | 0.05 | 0.05 | 0.11 | 0.11 |
| SEQID-01279 | P06106 | — | — | 1 | 0.47 | 0.20 | 0.06 | 0.04 | 0.05 | 0.04 | 0.00 | 0.04 | 0.05 | 0.04 | 0.05 | 0.06 | 0.05 | 0.13 |
| SEQID-01280 | P17709 | — | — | 1 | 0.50 | 0.23 | 0.04 | 0.06 | 0.03 | 0.07 | 0.01 | 0.05 | 0.07 | 0.04 | 0.05 | 0.06 | 0.08 | 0.07 |
| SEQID-01281 | P38158 | — | — | 1 | 0.48 | 0.15 | 0.03 | 0.06 | 0.06 | 0.08 | 0.01 | 0.04 | 0.08 | 0.03 | 0.04 | 0.06 | 0.12 | 0.07 |
| SEQID-01282 | Q12230 | — | — | 1 | 0.39 | 0.19 | 0.06 | 0.07 | 0.03 | 0.08 | 0.00 | 0.05 | 0.14 | 0.03 | 0.03 | 0.04 | 0.06 | 0.07 |
| SEQID-01283 | P07251 | — | — | 1 | 0.43 | 0.26 | 0.07 | 0.09 | 0.06 | 0.04 | 0.00 | 0.06 | 0.08 | 0.05 | 0.01 | 0.06 | 0.13 | 0.07 |
| SEQID-01284 | P11484 | — | — | 1 | 0.47 | 0.22 | 0.07 | 0.07 | 0.04 | 0.07 | 0.01 | 0.04 | 0.08 | 0.04 | 0.01 | 0.06 | 0.09 | 0.06 |
| SEQID-01285 | P17536 | — | — | 1 | 0.40 | 0.18 | 0.03 | 0.04 | 0.07 | 0.06 | 0.01 | 0.05 | 0.10 | 0.03 | 0.01 | 0.06 | 0.08 | 0.09 |
| SEQID-01286 | P60010 | — | — | 1 | 0.47 | 0.21 | 0.05 | 0.06 | 0.02 | 0.07 | 0.02 | 0.08 | 0.25 | 0.05 | 0.02 | 0.03 | 0.07 | 0.15 |
| SEQID-01287 | P12709 | — | — | 1 | 0.53 | 0.20 | 0.04 | 0.05 | 0.04 | 0.06 | 0.01 | 0.04 | 0.08 | 0.04 | 0.03 | 0.06 | 0.09 | 0.06 |
| SEQID-01288 | P09435 | — | — | 1 | 0.44 | 0.19 | 0.06 | 0.08 | 0.05 | 0.08 | 0.00 | 0.04 | 0.07 | 0.04 | 0.04 | 0.06 | 0.07 | 0.08 |
| SEQID-01289 | P19414 | — | — | 1 | 0.48 | 0.20 | 0.06 | 0.06 | 0.06 | 0.06 | 0.01 | 0.03 | 0.09 | 0.05 | 0.01 | 0.07 | 0.08 | 0.08 |
| SEQID-01290 | P17255 | — | — | 1 | 0.46 | 0.21 | 0.05 | 0.05 | 0.04 | 0.06 | 0.00 | 0.03 | 0.06 | 0.05 | 0.03 | 0.06 | 0.08 | 0.10 |
| SEQID-01291 | P19382 | — | — | 0 | 0.46 | 0.25 | 0.07 | 0.07 | 0.03 | 0.06 | 0.01 | 0.03 | 0.11 | 0.03 | 0.02 | 0.08 | 0.09 | 0.09 |
| SEQID-01292 | P16467 | — | — | 1 | 0.51 | 0.24 | 0.06 | 0.05 | 0.05 | 0.05 | 0.00 | 0.04 | 0.08 | 0.04 | 0.03 | 0.07 | 0.10 | 0.07 |
| SEQID-01293 | P06115 | — | — | 1 | 0.43 | 0.16 | 0.03 | 0.06 | 0.06 | 0.06 | 0.02 | 0.07 | 0.10 | 0.03 | 0.03 | 0.04 | 0.06 | 0.08 |
| SEQID-01294 | Q00055 | — | — | 1 | 0.48 | 0.24 | 0.05 | 0.05 | 0.04 | 0.08 | 0.01 | 0.04 | 0.07 | 0.05 | 0.04 | 0.07 | 0.08 | 0.07 |
| SEQID-01295 | P04806 | — | — | 1 | 0.48 | 0.22 | 0.04 | 0.05 | 0.05 | 0.06 | 0.00 | 0.04 | 0.10 | 0.04 | 0.04 | 0.07 | 0.10 | 0.09 |
| SEQID-01296 | P16862 | — | — | 1 | 0.44 | 0.21 | 0.07 | 0.08 | 0.05 | 0.06 | 0.01 | 0.03 | 0.08 | 0.04 | 0.02 | 0.06 | 0.10 | 0.06 |
| SEQID-01297 | P19435 | — | — | 1 | 0.51 | 0.14 | 0.04 | 0.12 | 0.04 | 0.07 | 0.00 | 0.02 | 0.04 | 0.04 | 0.05 | 0.06 | 0.10 | 0.12 |
| SEQID-01298 | P53252 | — | — | 1 | 0.35 | 0.18 | 0.05 | 0.08 | 0.05 | 0.08 | 0.02 | 0.08 | 0.15 | 0.05 | 0.01 | 0.06 | 0.09 | 0.07 |
| SEQID-01299 | P00830 | — | — | 1 | 0.48 | 0.25 | 0.07 | 0.07 | 0.02 | 0.05 | 0.01 | 0.05 | 0.09 | 0.03 | 0.02 | 0.07 | 0.10 | 0.07 |
| SEQID-01300 | P16861 | — | — | 1 | 0.48 | 0.22 | 0.06 | 0.06 | 0.05 | 0.06 | 0.00 | 0.03 | 0.08 | 0.05 | 0.03 | 0.06 | 0.09 | 0.07 |
| SEQID-01301 | P16521 | — | — | 1 | 0.49 | 0.22 | 0.06 | 0.06 | 0.05 | 0.06 | 0.00 | 0.03 | 0.10 | 0.03 | 0.03 | 0.08 | 0.08 | 0.09 |
| SEQID-01302 | P11154 | — | — | 1 | 0.46 | 0.23 | 0.06 | 0.08 | 0.04 | 0.06 | 0.00 | 0.05 | 0.07 | 0.03 | 0.03 | 0.06 | 0.09 | 0.06 |
| SEQID-01303 | P23301 | — | — | 0 | 0.50 | 0.18 | 0.05 | 0.04 | 0.03 | 0.07 | 0.02 | 0.08 | 0.09 | 0.04 | 0.04 | 0.05 | 0.07 | 0.10 |
| SEQID-01304 | P41805 | — | — | 1 | 0.43 | 0.21 | 0.06 | 0.14 | 0.04 | 0.11 | 0.00 | 0.05 | 0.11 | 0.04 | 0.04 | 0.05 | 0.08 | 0.11 |
| SEQID-01305 | P00331 | — | — | 1 | 0.47 | 0.23 | 0.07 | 0.03 | 0.04 | 0.05 | 0.01 | 0.04 | 0.07 | 0.03 | 0.03 | 0.04 | 0.08 | 0.08 |
| SEQID-01306 | P10091 | — | — | 0 | 0.47 | 0.24 | 0.04 | 0.08 | 0.04 | 0.05 | 0.02 | 0.02 | 0.07 | 0.07 | 0.04 | 0.07 | 0.08 | 0.06 |
| SEQID-01307 | P18399 | — | — | 0 | 0.13 | 0.02 | 0.00 | 0.02 | 0.25 | 0.14 | 0.01 | 0.06 | 0.09 | 0.03 | 0.01 | 0.01 | 0.00 | 0.06 |
| SEQID-01308 | Q12363 | — | — | 1 | 0.47 | 0.19 | 0.03 | 0.05 | 0.05 | 0.08 | 0.00 | 0.03 | 0.07 | 0.05 | 0.03 | 0.07 | 0.06 | 0.03 |
| SEQID-01309 | Q12122 | — | — | 1 | 0.48 | 0.23 | 0.05 | 0.06 | 0.04 | 0.09 | 0.02 | 0.02 | 0.06 | 0.04 | 0.03 | 0.09 | 0.07 | 0.07 |
| SEQID-01310 | P07262 | — | — | 1 | 0.43 | 0.20 | 0.05 | 0.06 | 0.03 | 0.05 | 0.01 | 0.05 | 0.09 | 0.03 | 0.01 | 0.09 | 0.06 | 0.06 |
| SEQID-01311 | P37291 | — | — | 1 | 0.46 | 0.21 | 0.05 | 0.04 | 0.04 | 0.04 | 0.01 | 0.04 | 0.07 | 0.04 | 0.04 | 0.05 | 0.08 | 0.10 |
| SEQID-01312 | P00390 | — | — | 1 | 0.48 | 0.22 | 0.06 | 0.07 | 0.04 | 0.04 | 0.02 | 0.04 | 0.09 | 0.03 | 0.04 | 0.04 | 0.08 | 0.07 |
| SEQID-01313 | P38720 | — | — | 1 | 0.47 | 0.22 | 0.07 | 0.06 | 0.04 | 0.07 | 0.00 | 0.02 | 0.07 | 0.04 | 0.04 | 0.07 | 0.12 | 0.09 |
| SEQID-01314 | P26263 | — | — | 1 | 0.52 | 0.26 | 0.04 | 0.03 | 0.04 | 0.05 | 0.01 | 0.06 | 0.09 | 0.05 | 0.01 | 0.05 | 0.09 | 0.08 |
| SEQID-01315 | P33315 | — | — | 1 | 0.45 | 0.20 | 0.05 | 0.06 | 0.05 | 0.06 | 0.00 | 0.05 | 0.07 | 0.04 | 0.03 | 0.07 | 0.09 | 0.08 |
| SEQID-01316 | P07149 | — | — | 1 | 0.50 | 0.23 | 0.04 | 0.03 | 0.04 | 0.05 | 0.01 | 0.04 | 0.07 | 0.05 | 0.03 | 0.05 | 0.09 | 0.07 |
| SEQID-01317 | P0CX48 | — | — | 1 | 0.54 | 0.19 | 0.04 | 0.06 | 0.04 | 0.01 | 0.00 | 0.04 | 0.08 | 0.03 | 0.02 | 0.06 | 0.00 | 0.03 |
| SEQID-01318 | P15992 | — | — | 1 | 0.44 | 0.19 | 0.03 | 0.11 | 0.04 | 0.10 | 0.00 | 0.03 | 0.03 | 0.04 | 0.04 | 0.04 | 0.03 | 0.14 |
| SEQID-01319 | P26783 | — | — | 1 | 0.45 | 0.23 | 0.07 | 0.05 | 0.03 | 0.05 | 0.00 | 0.06 | 0.06 | 0.02 | 0.01 | 0.08 | 0.08 | 0.11 |
| SEQID-01320 | P35719 | — | — | 1 | 0.48 | 0.23 | 0.03 | 0.06 | 0.04 | 0.06 | 0.00 | 0.05 | 0.13 | 0.02 | 0.01 | 0.06 | 0.06 | 0.12 |

TABLE 1-continued

| | | | | | | | | | | | | | | | |
|---|---|---|---|---|---|---|---|---|---|---|---|---|---|---|---|
| SEQID-01321 | P33442 | — | — | 1 | 0.55 | 0.22 | 0.04 | 0.03 | 0.04 | 0.05 | 0.00 | 0.05 | 0.07 | 0.03 | 0.03 | 0.06 | 0.09 | 0.15 |
| SEQID-01322 | P23248 | — | — | 1 | 0.55 | 0.23 | 0.04 | 0.03 | 0.05 | 0.05 | 0.00 | 0.04 | 0.07 | 0.03 | 0.03 | 0.05 | 0.09 | 0.15 |
| SEQID-01323 | P33011 | — | — | 1 | 0.51 | 0.21 | 0.07 | 0.04 | 0.05 | 0.08 | 0.01 | 0.04 | 0.03 | 0.04 | 0.01 | 0.05 | 0.09 | 0.07 |
| SEQID-01324 | P15019 | — | — | 1 | 0.50 | 0.23 | 0.06 | 0.04 | 0.03 | 0.07 | 0.00 | 0.04 | 0.09 | 0.03 | 0.01 | 0.07 | 0.08 | 0.12 |
| SEQID-01325 | P0C590 | — | — | 1 | 0.46 | 0.23 | 0.06 | 0.07 | 0.06 | 0.06 | 0.00 | 0.05 | 0.10 | 0.04 | 0.01 | 0.07 | 0.08 | 0.09 |
| SEQID-01326 | P31688 | — | — | 1 | 0.48 | 0.21 | 0.03 | 0.07 | 0.05 | 0.06 | 0.00 | 0.06 | 0.07 | 0.02 | 0.02 | 0.05 | 0.10 | 0.09 |
| SEQID-01327 | Q02326 | — | — | 1 | 0.52 | 0.23 | 0.06 | 0.03 | 0.06 | 0.07 | 0.00 | 0.04 | 0.08 | 0.06 | 0.01 | 0.03 | 0.09 | 0.17 |
| SEQID-01328 | P25443 | — | — | 1 | 0.48 | 0.23 | 0.05 | 0.10 | 0.04 | 0.03 | 0.00 | 0.06 | 0.06 | 0.04 | 0.01 | 0.07 | 0.11 | 0.09 |
| SEQID-01329 | P05750 | — | — | 0 | 0.45 | 0.23 | 0.03 | 0.12 | 0.03 | 0.04 | 0.00 | 0.03 | 0.11 | 0.04 | 0.01 | 0.06 | 0.09 | 0.09 |
| SEQID-01330 | P05317 | — | — | 1 | 0.45 | 0.24 | 0.03 | 0.06 | 0.03 | 0.06 | 0.01 | 0.06 | 0.10 | 0.03 | 0.02 | 0.06 | 0.08 | 0.06 |
| SEQID-01331 | P38009 | — | — | 1 | 0.44 | 0.23 | 0.07 | 0.07 | 0.04 | 0.04 | 0.00 | 0.04 | 0.08 | 0.03 | 0.03 | 0.07 | 0.08 | 0.08 |
| SEQID-01332 | Q3E754 | — | — | 0 | 0.34 | 0.21 | 0.05 | 0.11 | 0.05 | 0.07 | 0.01 | 0.04 | 0.07 | 0.03 | 0.01 | 0.06 | 0.08 | 0.08 |
| SEQID-01333 | P0C2H7 | — | — | 1 | 0.57 | 0.18 | 0.06 | 0.08 | 0.02 | 0.02 | 0.00 | 0.03 | 0.07 | 0.04 | 0.05 | 0.03 | 0.04 | 0.07 |
| SEQID-01334 | P35691 | — | — | 1 | 0.49 | 0.19 | 0.05 | 0.02 | 0.05 | 0.05 | 0.00 | 0.05 | 0.10 | 0.04 | 0.01 | 0.07 | 0.04 | 0.19 |
| SEQID-01335 | Q12690 | — | — | 1 | 0.41 | 0.17 | 0.10 | 0.18 | 0.05 | 0.03 | 0.01 | 0.03 | 0.08 | 0.02 | 0.02 | 0.05 | 0.06 | 0.10 |
| SEQID-01336 | P10664 | — | — | 1 | 0.49 | 0.21 | 0.08 | 0.10 | 0.05 | 0.05 | 0.00 | 0.02 | 0.05 | 0.05 | 0.04 | 0.04 | 0.08 | 0.11 |
| SEQID-01337 | P41939 | — | — | 1 | 0.51 | 0.22 | 0.04 | 0.06 | 0.02 | 0.04 | 0.00 | 0.07 | 0.09 | 0.04 | 0.03 | 0.08 | 0.07 | 0.10 |
| SEQID-01338 | P16140 | — | — | 1 | 0.43 | 0.22 | 0.04 | 0.09 | 0.05 | 0.05 | 0.02 | 0.04 | 0.10 | 0.04 | 0.02 | 0.07 | 0.08 | 0.09 |
| SEQID-01339 | P10963 | — | — | 1 | 0.47 | 0.19 | 0.05 | 0.05 | 0.05 | 0.05 | 0.00 | 0.05 | 0.08 | 0.03 | 0.04 | 0.07 | 0.07 | 0.06 |
| SEQID-01340 | P37012 | — | — | 1 | 0.48 | 0.20 | 0.04 | 0.04 | 0.04 | 0.04 | 0.00 | 0.07 | 0.08 | 0.03 | 0.04 | 0.07 | 0.07 | 0.07 |
| SEQID-01341 | P23254 | — | — | 1 | 0.46 | 0.21 | 0.07 | 0.05 | 0.07 | 0.05 | 0.01 | 0.05 | 0.06 | 0.04 | 0.03 | 0.08 | 0.10 | 0.10 |
| SEQID-01342 | P0CX52 | — | — | 0 | 0.49 | 0.22 | 0.05 | 0.10 | 0.02 | 0.04 | 0.00 | 0.04 | 0.05 | 0.04 | 0.03 | 0.06 | 0.08 | 0.07 |
| SEQID-01343 | P05759 | — | — | 0 | 0.54 | 0.21 | 0.02 | 0.07 | 0.03 | 0.05 | 0.01 | 0.05 | 0.05 | 0.04 | 0.04 | 0.05 | 0.09 | 0.14 |
| SEQID-01344 | P0CX23 | — | — | 1 | 0.42 | 0.18 | 0.06 | 0.12 | 0.04 | 0.05 | 0.00 | 0.06 | 0.09 | 0.04 | 0.05 | 0.06 | 0.07 | 0.19 |
| SEQID-01345 | P34760 | — | — | 1 | 0.50 | 0.24 | 0.07 | 0.04 | 0.03 | 0.03 | 0.02 | 0.04 | 0.08 | 0.01 | 0.02 | 0.07 | 0.09 | 0.12 |
| SEQID-01346 | P0CX45 | — | — | 1 | 0.50 | 0.21 | 0.06 | 0.06 | 0.04 | 0.06 | 0.00 | 0.06 | 0.09 | 0.03 | 0.04 | 0.06 | 0.09 | 0.08 |
| SEQID-01347 | P46654 | — | — | 1 | 0.43 | 0.22 | 0.06 | 0.15 | 0.05 | 0.05 | 0.00 | 0.04 | 0.04 | 0.07 | 0.05 | 0.07 | 0.07 | 0.09 |
| SEQID-01348 | P31116 | — | — | 1 | 0.52 | 0.26 | 0.08 | 0.08 | 0.08 | 0.09 | 0.00 | 0.07 | 0.12 | 0.02 | 0.02 | 0.06 | 0.08 | 0.03 |
| SEQID-01349 | P53912 | — | — | 1 | 0.50 | 0.25 | 0.06 | 0.03 | 0.06 | 0.07 | 0.01 | 0.03 | 0.06 | 0.04 | 0.04 | 0.06 | 0.09 | 0.11 |
| SEQID-01350 | P19358 | — | — | 1 | 0.46 | 0.21 | 0.06 | 0.06 | 0.06 | 0.05 | 0.00 | 0.06 | 0.07 | 0.02 | 0.01 | 0.09 | 0.11 | 0.11 |
| SEQID-01351 | P06168 | — | — | 1 | 0.45 | 0.19 | 0.05 | 0.08 | 0.05 | 0.04 | 0.01 | 0.04 | 0.07 | 0.04 | 0.01 | 0.07 | 0.08 | 0.09 |
| SEQID-01352 | Q03558 | — | — | 1 | 0.42 | 0.18 | 0.06 | 0.09 | 0.06 | 0.04 | 0.01 | 0.04 | 0.08 | 0.04 | 0.04 | 0.05 | 0.09 | 0.08 |
| SEQID-01353 | P39954 | — | — | 1 | 0.50 | 0.24 | 0.07 | 0.03 | 0.07 | 0.04 | 0.02 | 0.04 | 0.09 | 0.04 | 0.02 | 0.06 | 0.07 | 0.07 |
| SEQID-01354 | Q00764 | — | — | 1 | 0.50 | 0.23 | 0.03 | 0.04 | 0.03 | 0.05 | 0.00 | 0.04 | 0.08 | 0.04 | 0.04 | 0.06 | 0.09 | 0.08 |
| SEQID-01355 | P17967 | — | — | 1 | 0.44 | 0.21 | 0.07 | 0.02 | 0.07 | 0.05 | 0.01 | 0.04 | 0.08 | 0.02 | 0.04 | 0.06 | 0.09 | 0.07 |
| SEQID-01356 | P04802 | — | — | 1 | 0.45 | 0.20 | 0.05 | 0.09 | 0.05 | 0.09 | 0.00 | 0.06 | 0.11 | 0.03 | 0.03 | 0.05 | 0.10 | 0.08 |
| SEQID-01357 | P48589 | — | — | 1 | 0.50 | 0.30 | 0.06 | 0.09 | 0.03 | 0.03 | 0.00 | 0.05 | 0.12 | 0.04 | 0.01 | 0.04 | 0.10 | 0.10 |
| SEQID-01358 | P14832 | — | — | 1 | 0.48 | 0.18 | 0.04 | 0.06 | 0.04 | 0.05 | 0.01 | 0.07 | 0.15 | 0.08 | 0.05 | 0.04 | 0.11 | 0.07 |
| SEQID-01359 | P0CX83 | — | — | 1 | 0.42 | 0.18 | 0.09 | 0.20 | 0.04 | 0.04 | 0.00 | 0.07 | 0.05 | 0.02 | 0.03 | 0.05 | 0.05 | 0.09 |
| SEQID-01360 | P0CX39 | — | — | 1 | 0.42 | 0.14 | 0.07 | 0.15 | 0.07 | 0.05 | 0.01 | 0.08 | 0.07 | 0.04 | 0.04 | 0.04 | 0.08 | 0.14 |
| SEQID-01361 | P26786 | — | — | 0 | 0.50 | 0.25 | 0.04 | 0.09 | 0.02 | 0.04 | 0.00 | 0.02 | 0.08 | 0.04 | 0.02 | 0.06 | 0.05 | 0.13 |
| SEQID-01362 | P05737 | — | — | 1 | 0.48 | 0.22 | 0.06 | 0.08 | 0.06 | 0.06 | 0.00 | 0.04 | 0.09 | 0.02 | 0.03 | 0.09 | 0.11 | 0.11 |
| SEQID-01363 | P17076 | — | — | 1 | 0.49 | 0.19 | 0.09 | 0.07 | 0.09 | 0.07 | 0.01 | 0.04 | 0.07 | 0.03 | 0.02 | 0.04 | 0.08 | 0.13 |
| SEQID-01364 | P07233 | — | — | 1 | 0.48 | 0.20 | 0.03 | 0.07 | 0.03 | 0.04 | 0.00 | 0.03 | 0.06 | 0.04 | 0.01 | 0.05 | 0.08 | 0.16 |
| SEQID-01365 | P00917 | — | — | 1 | 0.49 | 0.20 | 0.05 | 0.03 | 0.05 | 0.06 | 0.01 | 0.04 | 0.11 | 0.04 | 0.02 | 0.05 | 0.10 | 0.08 |
| SEQID-01366 | P18239 | — | — | 1 | 0.50 | 0.21 | 0.07 | 0.07 | 0.07 | 0.05 | 0.00 | 0.05 | 0.08 | 0.03 | 0.03 | 0.04 | 0.06 | 0.12 |
| SEQID-01367 | P26321 | — | — | 0 | 0.41 | 0.16 | 0.07 | 0.10 | 0.01 | 0.07 | 0.01 | 0.05 | 0.03 | 0.06 | 0.00 | 0.04 | 0.11 | 0.10 |
| SEQID-01368 | P17505 | — | — | 0 | 0.51 | 0.25 | 0.06 | 0.05 | 0.06 | 0.05 | 0.00 | 0.02 | 0.10 | 0.03 | 0.02 | 0.05 | 0.05 | 0.08 |
| SEQID-01369 | P07257 | — | — | 0 | 0.47 | 0.25 | 0.07 | 0.06 | 0.06 | 0.06 | 0.00 | 0.03 | 0.07 | 0.04 | 0.03 | 0.06 | 0.08 | 0.10 |
| SEQID-01370 | P31373 | — | — | 1 | 0.48 | 0.24 | 0.06 | 0.05 | 0.06 | 0.05 | 0.00 | 0.05 | 0.06 | 0.04 | 0.01 | 0.03 | 0.10 | 0.10 |
| SEQID-01371 | P38999 | — | — | 1 | 0.48 | 0.23 | 0.07 | 0.05 | 0.07 | 0.07 | 0.01 | 0.02 | 0.07 | 0.04 | 0.05 | 0.06 | 0.13 | 0.10 |
| SEQID-01372 | P07256 | — | — | 1 | 0.49 | 0.23 | 0.06 | 0.05 | 0.06 | 0.06 | 0.00 | 0.05 | 0.06 | 0.03 | 0.01 | 0.06 | 0.11 | 0.09 |
| SEQID-01373 | P53319 | — | — | 1 | 0.48 | 0.12 | 0.07 | 0.07 | 0.04 | 0.07 | 0.01 | 0.07 | 0.06 | 0.05 | 0.03 | 0.08 | 0.09 | 0.08 |

TABLE 1-continued

| | | | | | | | | | | | | | | | | |
|---|---|---|---|---|---|---|---|---|---|---|---|---|---|---|---|---|
| SEQID-01374 | P54115 | — | 1 | 0.48 | 0.22 | 0.06 | 0.05 | 0.06 | 0.06 | 0.01 | 0.03 | 0.09 | 0.05 | 0.01 | 0.07 | 0.08 | 0.09 |
| SEQID-01375 | P32861 | — | 1 | 0.50 | 0.25 | 0.03 | 0.03 | 0.07 | 0.06 | 0.01 | 0.03 | 0.07 | 0.03 | 0.04 | 0.07 | 0.12 | 0.08 |
| SEQID-01376 | P32191 | — | 1 | 0.49 | 0.21 | 0.05 | 0.06 | 0.05 | 0.05 | 0.01 | 0.04 | 0.06 | 0.04 | 0.02 | 0.05 | 0.09 | 0.07 |
| SEQID-01377 | P19097 | — | 1 | 0.46 | 0.21 | 0.06 | 0.05 | 0.04 | 0.05 | 0.01 | 0.05 | 0.10 | 0.04 | 0.02 | 0.06 | 0.09 | 0.09 |
| SEQID-01378 | P38711 | — | 0 | 0.53 | 0.19 | 0.05 | 0.07 | 0.01 | 0.03 | 0.06 | 0.04 | 0.04 | 0.03 | 0.05 | 0.01 | 0.11 | 0.10 |
| SEQID-01379 | P0CX31 | — | 0 | 0.46 | 0.25 | 0.06 | 0.14 | 0.04 | 0.04 | 0.00 | 0.04 | 0.07 | 0.03 | 0.01 | 0.02 | 0.07 | 0.16 |
| SEQID-01380 | P0C0W1 | — | 1 | 0.51 | 0.19 | 0.04 | 0.10 | 0.05 | 0.05 | 0.01 | 0.04 | 0.05 | 0.03 | 0.04 | 0.10 | 0.0a | 0.10 |
| SEQID-01381 | P39516 | — | 0 | 0.42 | 0.21 | 0.09 | 0.16 | 0.02 | 0.07 | 0.01 | 0.03 | 0.04 | 0.03 | 0.01 | 0.05 | 0.05 | 0.08 |
| SEQID-01382 | P36010 | — | 1 | 0.50 | 0.19 | 0.04 | 0.07 | 0.03 | 0.06 | 0.00 | 0.06 | 0.08 | 0.06 | 0.02 | 0.06 | 0.08 | 0.10 |
| SEQID-01383 | Q02753 | — | 0 | 0.46 | 0.21 | 0.04 | 0.12 | 0.04 | 0.02 | 0.01 | 0.02 | 0.06 | 0.05 | 0.05 | 0.05 | 0.05 | 0.12 |
| SEQID-01384 | P40159 | — | 1 | 0.24 | 0.05 | 0.04 | 0.05 | 0.14 | 0.05 | 0.00 | 0.14 | 0.06 | 0.16 | 0.03 | 0.02 | 0.02 | 0.03 |
| SEQID-01385 | P05755 | — | 0 | 0.41 | 0.20 | 0.06 | 0.17 | 0.02 | 0.02 | 0.02 | 0.03 | 0.10 | 0.03 | 0.03 | 0.05 | 0.10 | 0.10 |
| SEQID-01386 | P08067 | — | 1 | 0.49 | 0.21 | 0.05 | 0.06 | 0.03 | 0.07 | 0.00 | 0.03 | 0.04 | 0.04 | 0.03 | 0.06 | 0.08 | 0.08 |
| SEQID-01387 | Q04432 | — | 1 | 0.51 | 0.20 | 0.07 | 0.02 | 0.04 | 0.10 | 0.01 | 0.03 | 0.06 | 0.05 | 0.03 | 0.05 | 0.07 | 0.11 |
| SEQID-01388 | P39015 | — | 1 | 0.36 | 0.12 | 0.08 | 0.10 | 0.12 | 0.08 | 0.01 | 0.01 | 0.08 | 0.02 | 0.00 | 0.06 | 0.05 | 0.14 |
| SEQID-01389 | P36060 | — | 1 | 0.52 | 0.19 | 0.03 | 0.03 | 0.05 | 0.07 | 0.00 | 0.05 | 0.06 | 0.03 | 0.02 | 0.05 | 0.09 | 0.12 |
| SEQID-01390 | P53228 | — | 1 | 0.49 | 0.21 | 0.06 | 0.05 | 0.03 | 0.06 | 0.01 | 0.03 | 0.11 | 0.02 | 0.04 | 0.06 | 0.09 | 0.12 |
| SEQID-01391 | P43567 | — | 1 | 0.51 | 0.24 | 0.06 | 0.05 | 0.04 | 0.06 | 0.01 | 0.03 | 0.05 | 0.04 | 0.03 | 0.05 | 0.09 | 0.08 |
| SEQID-01392 | P41338 | — | 1 | 0.46 | 0.24 | 0.09 | 0.10 | 0.05 | 0.06 | 0.00 | 0.05 | 0.12 | 0.05 | 0.02 | 0.07 | 0.08 | 0.09 |
| SEQID-01393 | P54839 | — | 1 | 0.47 | 0.21 | 0.04 | 0.04 | 0.05 | 0.05 | 0.04 | 0.05 | 0.05 | 0.04 | 0.04 | 0.06 | 0.09 | 0.10 |
| SEQID-01394 | Q04792 | — | 1 | 0.49 | 0.20 | 0.04 | 0.05 | 0.06 | 0.07 | 0.00 | 0.04 | 0.09 | 0.03 | 0.05 | 0.05 | 0.10 | 0.08 |
| SEQID-01395 | Q01574 | — | 0 | 0.48 | 0.21 | 0.05 | 0.06 | 0.05 | 0.05 | 0.01 | 0.04 | 0.06 | 0.04 | 0.03 | 0.06 | 0.08 | 0.08 |
| SEQID-01396 | P25694 | — | 0 | 0.43 | 0.22 | 0.03 | 0.13 | 0.03 | 0.03 | 0.00 | 0.03 | 0.08 | 0.02 | 0.02 | 0.06 | 0.08 | 0.07 |
| SEQID-01397 | Q05050 | — | 1 | 0.46 | 0.22 | 0.06 | 0.17 | 0.05 | 0.05 | 0.02 | 0.03 | 0.10 | 0.06 | 0.01 | 0.05 | 0.07 | 0.10 |
| SEQID-01398 | P38427 | — | 1 | 0.44 | 0.17 | 0.03 | 0.07 | 0.03 | 0.03 | 0.00 | 0.05 | 0.07 | 0.04 | 0.03 | 0.05 | 0.11 | 0.14 |
| SEQID-01399 | P07259 | — | 0 | 0.45 | 0.21 | 0.06 | 0.13 | 0.05 | 0.06 | 0.01 | 0.03 | 0.06 | 0.02 | 0.03 | 0.05 | 0.10 | 0.07 |
| SEQID-01400 | P01097 | — | 1 | 0.47 | 0.24 | 0.04 | 0.07 | 0.06 | 0.05 | 0.01 | 0.03 | 0.08 | 0.03 | 0.02 | 0.07 | 0.09 | 0.07 |
| SEQID-01401 | Q01519 | — | 0 | 0.39 | 0.14 | 0.05 | 0.14 | 0.05 | 0.05 | 0.01 | 0.08 | 0.12 | 0.08 | 0.03 | 0.07 | 0.09 | 0.10 |
| SEQID-01402 | P38804 | — | 1 | 0.45 | 0.11 | 0.04 | 0.17 | 0.06 | 0.01 | 0.00 | 0.08 | 0.05 | 0.05 | 0.04 | 0.03 | 0.03 | 0.09 |
| SEQID-01403 | P53221 | — | 0 | 0.47 | 0.20 | 0.05 | 0.03 | 0.04 | 0.06 | 0.04 | 0.02 | 0.14 | 0.02 | 0.00 | 0.05 | 0.08 | 0.13 |
| SEQID-01404 | P14127 | — | 0 | 0.48 | 0.24 | 0.05 | 0.03 | 0.04 | 0.02 | 0.00 | 0.05 | 0.05 | 0.05 | 0.02 | 0.05 | 0.11 | 0.16 |
| SEQID-01405 | P04037 | — | 0 | 0.43 | 0.22 | 0.03 | 0.13 | 0.05 | 0.07 | 0.01 | 0.06 | 0.06 | 0.03 | 0.01 | 0.05 | 0.11 | 0.11 |
| SEQID-01406 | P00427 | — | 1 | 0.46 | 0.22 | 0.06 | 0.17 | 0.05 | 0.05 | 0.02 | 0.04 | 0.04 | 0.04 | 0.03 | 0.05 | 0.11 | 0.07 |
| SEQID-01407 | P53849 | — | 0 | 0.39 | 0.19 | 0.06 | 0.13 | 0.06 | 0.06 | 0.00 | 0.03 | 0.12 | 0.01 | 0.02 | 0.03 | 0.10 | 0.10 |
| SEQID-01408 | P04449 | — | 1 | 0.36 | 0.09 | 0.02 | 0.07 | 0.02 | 0.05 | 0.13 | 0.05 | 0.07 | 0.04 | 0.06 | 0.03 | 0.03 | 0.22 |
| SEQID-01409 | P38013 | — | 1 | 0.49 | 0.13 | 0.07 | 0.14 | 0.07 | 0.02 | 0.00 | 0.03 | 0.07 | 0.02 | 0.02 | 0.04 | 0.04 | 0.09 |
| SEQID-01410 | P05740 | — | 1 | 0.51 | 0.22 | 0.06 | 0.01 | 0.06 | 0.07 | 0.02 | 0.04 | 0.06 | 0.03 | 0.02 | 0.07 | 0.05 | 0.11 |
| SEQID-01411 | P0CX50 | — | 0 | 0.40 | 0.16 | 0.10 | 0.14 | 0.04 | 0.04 | 0.02 | 0.03 | 0.13 | 0.02 | 0.03 | 0.04 | 0.06 | 0.11 |
| SEQID-01412 | P05738 | — | 1 | 0.50 | 0.20 | 0.07 | 0.17 | 0.03 | 0.05 | 0.01 | 0.02 | 0.07 | 0.03 | 0.01 | 0.04 | 0.08 | 0.12 |
| SEQID-01413 | P00447 | — | 1 | 0.54 | 0.27 | 0.02 | 0.08 | 0.07 | 0.06 | 0.01 | 0.04 | 0.03 | 0.03 | 0.03 | 0.09 | 0.05 | 0.12 |
| SEQID-01414 | P0CX38 | — | 0 | 0.50 | 0.20 | 0.07 | 0.03 | 0.02 | 0.05 | 0.00 | 0.06 | 0.05 | 0.03 | 0.03 | 0.05 | 0.10 | 0.09 |
| SEQID-01415 | Q06146 | — | 1 | 0.44 | 0.20 | 0.05 | 0.16 | 0.07 | 0.05 | 0.00 | 0.06 | 0.06 | 0.06 | 0.01 | 0.05 | 0.08 | 0.13 |
| SEQID-01416 | P38715 | — | 0 | 0.33 | 0.15 | 0.03 | 0.09 | 0.04 | 0.08 | 0.00 | 0.05 | 0.14 | 0.05 | 0.02 | 0.05 | 0.08 | 0.09 |
| SEQID-01417 | P40531 | — | 0 | 0.52 | 0.24 | 0.03 | 0.04 | 0.05 | 0.06 | 0.02 | 0.03 | 0.05 | 0.02 | 0.04 | 0.07 | 0.11 | 0.10 |
| SEQID-01418 | P28834 | — | 0 | 0.42 | 0.18 | 0.06 | 0.05 | 0.05 | 0.05 | 0.00 | 0.07 | 0.13 | 0.03 | 0.01 | 0.04 | 0.10 | 0.09 |
| SEQID-01419 | P41940 | — | 1 | 0.51 | 0.24 | 0.05 | 0.05 | 0.04 | 0.05 | 0.01 | 0.04 | 0.08 | 0.03 | 0.01 | 0.07 | 0.05 | 0.09 |
| SEQID-01420 | P28241 | — | 1 | 0.54 | 0.28 | 0.03 | 0.04 | 0.03 | 0.06 | 0.00 | 0.02 | 0.06 | 0.03 | 0.03 | 0.09 | 0.06 | 0.08 |
| SEQID-01421 | P39714 | — | 1 | 0.48 | 0.25 | 0.05 | 0.07 | 0.04 | 0.06 | 0.01 | 0.03 | 0.07 | 0.02 | 0.06 | 0.09 | 0.08 | 0.10 |
| SEQID-01422 | Q12443 | — | 1 | 0.53 | 0.24 | 0.04 | 0.03 | 0.04 | 0.05 | 0.03 | 0.02 | 0.08 | 0.05 | 0.02 | 0.08 | 0.10 | 0.06 |
| SEQID-01423 | P07267 | — | 1 | 0.47 | 0.20 | 0.03 | 0.07 | 0.03 | 0.06 | 0.00 | 0.04 | 0.06 | 0.05 | 0.02 | 0.06 | 0.07 | 0.10 |
| SEQID-01424 | P36009 | — | 1 | 0.47 | 0.21 | 0.05 | 0.02 | 0.05 | 0.07 | 0.01 | 0.03 | 0.07 | 0.04 | 0.02 | 0.04 | 0.08 | 0.09 |
| SEQID-01425 | Q04409 | — | 1 | 0.48 | 0.19 | 0.07 | 0.05 | 0.04 | 0.07 | 0.00 | 0.02 | 0.08 | 0.04 | 0.03 | 0.06 | 0.12 | 0.12 |
| SEQID-01426 | P50095 | — | 1 | 0.48 | 0.23 | 0.05 | 0.06 | 0.06 | 0.05 | 0.01 | 0.05 | 0.06 | 0.05 | 0.02 | 0.06 | 0.10 | 0.07 |

TABLE 1-continued

| | | | | | | | | | | | | | |
|---|---|---|---|---|---|---|---|---|---|---|---|---|---|
| SEQID-01427 | P32316 | — | — | 1 | 0.48 | 0.21 | 0.05 | 0.07 | 0.06 | 0.07 | 0.01 | 0.03 | 0.07 | 0.03 | 0.05 | 0.06 | 0.08 | 0.07 |
| SEQID-01428 | P37302 | — | — | 1 | 0.45 | 0.19 | 0.05 | 0.05 | 0.08 | 0.07 | 0.01 | 0.04 | 0.08 | 0.04 | 0.04 | 0.06 | 0.08 | 0.09 |
| SEQID-01429 | Q03104 | — | — | 1 | 0.50 | 0.17 | 0.03 | 0.03 | 0.06 | 0.10 | 0.00 | 0.06 | 0.11 | 0.02 | 0.02 | 0.03 | 0.09 | 0.13 |
| SEQID-01430 | P15705 | — | — | 1 | 0.39 | 0.14 | 0.03 | 0.06 | 0.06 | 0.07 | 0.02 | 0.06 | 0.07 | 0.05 | 0.02 | 0.05 | 0.07 | 0.12 |
| SEQID-01431 | Q00711 | — | — | 1 | 0.46 | 0.19 | 0.06 | 0.09 | 0.04 | 0.06 | 0.06 | 0.03 | 0.07 | 0.05 | 0.05 | 0.07 | 0.08 | 0.06 |
| SEQID-01432 | P07244 | — | — | 1 | 0.48 | 0.25 | 0.06 | 0.05 | 0.04 | 0.07 | 0.00 | 0.03 | 0.06 | 0.05 | 0.03 | 0.07 | 0.09 | 0.06 |
| SEQID-01433 | P41053 | — | — | 1 | 0.42 | 0.11 | 0.02 | 0.19 | 0.05 | 0.03 | 0.02 | 0.04 | 0.04 | 0.08 | 0.08 | 0.03 | 0.03 | 0.08 |
| SEQID-01434 | P02309 | — | — | 0 | 0.47 | 0.23 | 0.04 | 0.01 | 0.01 | 0.03 | 0.01 | 0.02 | 0.05 | 0.03 | 0.02 | 0.07 | 0.09 | 0.12 |
| SEQID-01435 | P22803 | — | — | 1 | 0.48 | 0.21 | 0.10 | 0.05 | 0.02 | 0.07 | 0.02 | 0.05 | 0.07 | 0.08 | 0.00 | 0.05 | 0.05 | 0.10 |
| SEQID-01436 | P20091 | — | — | 0 | 0.48 | 0.25 | 0.02 | 0.11 | 0.05 | 0.08 | 0.01 | 0.03 | 0.05 | 0.03 | 0.01 | 0.08 | 0.07 | 0.07 |
| SEQID-01437 | Q04438 | — | — | 1 | 0.36 | 0.13 | 0.02 | 0.08 | 0.07 | 0.08 | 0.00 | 0.07 | 0.09 | 0.03 | 0.03 | 0.03 | 0.04 | 0.08 |
| SEQID-01438 | P02294 | — | — | 0 | 0.47 | 0.16 | 0.08 | 0.07 | 0.02 | 0.02 | 0.00 | 0.04 | 0.07 | 0.04 | 0.03 | 0.06 | 0.05 | 0.17 |
| SEQID-01439 | P38701 | — | — | 1 | 0.51 | 0.25 | 0.02 | 0.07 | 0.05 | 0.05 | 0.01 | 0.10 | 0.11 | 0.10 | 0.02 | 0.10 | 0.05 | 0.13 |
| SEQID-01440 | P38061 | — | — | 1 | 0.55 | 0.19 | 0.06 | 0.12 | 0.05 | 0.02 | 0.00 | 0.02 | 0.03 | 0.02 | 0.02 | 0.06 | 0.05 | 0.16 |
| SEQID-01441 | P32445 | — | — | 1 | 0.44 | 0.16 | 0.05 | 0.08 | 0.08 | 0.05 | 0.00 | 0.05 | 0.03 | 0.03 | 0.02 | 0.04 | 0.07 | 0.08 |
| SEQID-01442 | P38754 | — | — | 0 | 0.53 | 0.24 | 0.10 | 0.11 | 0.08 | 0.04 | 0.00 | 0.06 | 0.04 | 0.03 | 0.02 | 0.04 | 0.08 | 0.14 |
| SEQID-01443 | Q03048 | — | — | 1 | 0.44 | 0.19 | 0.05 | 0.07 | 0.04 | 0.09 | 0.00 | 0.01 | 0.08 | C.02 | 0.01 | 0.04 | 0.08 | 0.09 |
| SEQID-01444 | Q01855 | — | — | 1 | 0.49 | 0.18 | 0.06 | 0.14 | 0.04 | 0.03 | 0.01 | 0.02 | 0.07 | 0.03 | 0.03 | 0.06 | 0.06 | 0.10 |
| SEQID-01445 | POCX54 | — | — | 0 | 0.46 | 0.24 | 0.06 | 0.07 | 0.04 | 0.05 | 0.01 | 0.04 | 0.05 | 0.03 | 0.02 | 0.10 | 0.07 | 0.13 |
| SEQID-01446 | P40414 | — | — | 0 | 0.36 | 0.16 | 0.03 | 0.04 | 0.08 | 0.05 | 0.01 | 0.08 | 0.25 | 0.04 | 0.00 | 0.02 | 0.08 | 0.13 |
| SEQID-01447 | Q3E757 | — | — | 1 | 0.48 | 0.20 | 0.03 | 0.13 | 0.04 | 0.06 | 0.01 | 0.04 | 0.07 | 0.04 | 0.02 | 0.06 | 0.06 | 0.14 |
| SEQID-01448 | Q12402 | — | — | 1 | 0.54 | 0.27 | 0.05 | 0.04 | 0.03 | 0.03 | 0.00 | 0.03 | 0.08 | 0.03 | 0.01 | 0.08 | 0.13 | 0.11 |
| SEQID-01449 | Q96VH4 | — | — | 1 | 0.49 | 0.19 | 0.09 | 0.04 | 0.04 | 0.04 | 0.00 | 0.05 | 0.07 | 0.04 | 0.02 | 0.08 | 0.07 | 0.07 |
| SEQID-01450 | P52286 | — | — | 1 | 0.38 | 0.18 | 0.03 | 0.09 | 0.09 | 0.08 | 0.01 | 0.04 | 0.10 | 0.05 | 0.03 | 0.07 | 0.06 | 0.06 |
| SEQID-01451 | P26785 | — | — | 1 | 0.50 | 0.11 | 0.07 | 0.12 | 0.02 | 0.13 | 0.00 | 0.03 | 0.07 | 0.01 | 0.02 | 0.04 | 0.09 | 0.15 |
| SEQID-01452 | P32471 | — | — | 1 | 0.44 | 0.17 | 0.10 | 0.01 | 0.03 | 0.04 | 0.02 | 0.05 | 0.05 | 0.02 | 0.03 | 0.06 | 0.06 | 0.10 |
| SEQID-01453 | P53184 | — | — | 1 | 0.53 | 0.22 | 0.03 | 0.14 | 0.03 | 0.11 | 0.04 | 0.03 | 0.13 | 0.02 | 0.07 | 0.07 | 0.06 | 0.09 |
| SEQID-01454 | P32835 | — | — | 1 | 0.48 | 0.20 | 0.05 | 0.04 | 0.05 | 0.06 | 0.02 | 0.06 | 0.06 | 0.02 | 0.02 | 0.05 | 0.08 | 0.09 |
| SEQID-01455 | P17891 | — | — | 1 | 0.38 | 0.14 | 0.05 | 0.06 | 0.05 | 0.16 | 0.01 | 0.06 | 0.14 | 0.03 | 0.01 | 0.05 | 0.06 | 0.11 |
| SEQID-01456 | P05626 | — | — | 1 | 0.48 | 0.25 | 0.06 | 0.06 | 0.04 | 0.04 | 0.01 | 0.06 | 0.09 | 0.02 | 0.01 | 0.05 | 0.11 | 0.10 |
| SEQID-01457 | P40106 | — | — | 1 | 0.49 | 0.20 | 0.07 | 0.04 | 0.04 | 0.08 | 0.00 | 0.02 | 0.08 | 0.04 | 0.02 | 0.05 | 0.13 | 0.07 |
| SEQID-01458 | P27616 | — | — | 1 | 0.50 | 0.23 | 0.04 | 0.05 | 0.03 | 0.04 | 0.00 | 0.05 | 0.10 | 0.04 | 0.02 | 0.08 | 0.06 | 0.12 |
| SEQID-01459 | P47143 | — | — | 1 | 0.49 | 0.23 | 0.08 | 0.02 | 0.04 | 0.07 | 0.01 | 0.04 | 0.07 | 0.03 | 0.03 | 0.07 | 0.09 | 0.11 |
| SEQID-01460 | P32449 | — | — | 1 | 0.45 | 0.22 | 0.07 | 0.07 | 0.07 | 0.06 | 0.00 | 0.05 | 0.07 | 0.05 | 0.03 | 0.05 | 0.10 | 0.08 |
| SEQID-01461 | P13663 | — | — | 1 | 0.48 | 0.26 | 0.06 | 0.06 | 0.03 | 0.03 | 0.02 | 0.04 | 0.05 | 0.04 | 0.03 | 0.07 | 0.09 | 0.07 |
| SEQID-01462 | P32771 | — | — | 1 | 0.50 | 0.21 | 0.07 | 0.04 | 0.03 | 0.07 | 0.04 | 0.02 | 0.08 | 0.04 | 0.03 | 0.09 | 0.06 | 0.09 |
| SEQID-01463 | P32288 | — | — | 1 | 0.41 | 0.15 | 0.05 | 0.08 | 0.03 | 0.09 | 0.02 | 0.04 | 0.07 | 0.06 | 0.05 | 0.06 | 0.10 | 0.10 |
| SEQID-01464 | P09624 | — | — | 1 | 0.51 | 0.24 | 0.06 | 0.05 | 0.05 | 0.06 | 0.01 | 0.03 | 0.08 | 0.05 | 0.04 | 0.08 | 0.05 | 0.06 |
| SEQID-01465 | Q05911 | — | — | 1 | 0.49 | 0.23 | 0.06 | 0.09 | 0.04 | 0.05 | 0.00 | 0.04 | 0.09 | 0.04 | 0.04 | 0.08 | 0.08 | 0.11 |
| SEQID-01466 | P54114 | — | — | 0 | 0.50 | 0.21 | 0.06 | 0.06 | 0.05 | 0.06 | 0.00 | 0.08 | 0.09 | 0.02 | 0.03 | 0.06 | 0.10 | 0.06 |
| SEQID-01467 | P32582 | — | — | 0 | 0.50 | 0.24 | 0.06 | 0.03 | 0.05 | 0.07 | 0.01 | 0.04 | 0.07 | 0.04 | 0.01 | 0.07 | 0.08 | 0.11 |
| SEQID-01468 | P15891 | — | — | 1 | 0.36 | 0.14 | 0.04 | 0.04 | 0.06 | 0.08 | 0.05 | 0.03 | 0.15 | 0.02 | 0.05 | 0.03 | 0.10 | 0.12 |
| SEQID-01469 | P53051 | — | — | 1 | 0.46 | 0.15 | 0.06 | 0.04 | 0.05 | 0.08 | 0.00 | 0.04 | 0.09 | 0.04 | 0.01 | 0.05 | 0.05 | 0.12 |
| SEQID-01470 | P09232 | — | — | 1 | 0.47 | 0.18 | 0.03 | 0.06 | 0.06 | 0.09 | 0.00 | 0.02 | 0.08 | 0.04 | 0.03 | 0.05 | 0.06 | 0.09 |
| SEQID-01471 | P52910 | — | — | 1 | 0.47 | 0.22 | 0.05 | 0.04 | 0.06 | 0.06 | 0.01 | 0.04 | 0.10 | 0.06 | 0.05 | 0.06 | 0.07 | 0.11 |
| SEQID-01472 | P07264 | — | — | 1 | 0.47 | 0.20 | 0.05 | 0.06 | 0.04 | 0.07 | 0.01 | 0.03 | 0.07 | 0.05 | 0.04 | 0.08 | 0.08 | 0.07 |
| SEQID-01473 | P33416 | — | — | 1 | 0.40 | 0.15 | 0.05 | 0.06 | 0.05 | 0.08 | 0.01 | 0.04 | 0.03 | 0.04 | 0.03 | 0.07 | 0.11 | 0.09 |
| SEQID-01474 | P21306 | — | — | 1 | 0.47 | 0.25 | 0.12 | 0.10 | 0.08 | 0.02 | 0.00 | 0.04 | 0.09 | 0.04 | 0.02 | 0.03 | 0.07 | 0.10 |
| SEQID-01475 | P01095 | — | — | 0 | 0.63 | 0.25 | 0.02 | 0.07 | 0.00 | 0.08 | 0.05 | 0.08 | 0.04 | 0.04 | 0.00 | 0.05 | 0.07 | 0.16 |
| SEQID-01476 | POCX26 | — | — | 0 | 0.46 | 0.16 | 0.03 | 0.00 | 0.00 | 0.01 | 0.00 | 0.00 | 0.11 | 0.02 | 0.10 | 0.03 | 0.03 | 0.14 |
| SEQID-01477 | P14120 | — | — | 1 | 0.52 | 0.28 | 0.05 | 0.15 | 0.04 | 0.02 | 0.02 | 0.04 | 0.04 | 0.04 | 0.01 | 0.04 | 0.13 | 0.13 |
| SEQID-01478 | P25373 | — | — | 0 | 0.47 | 0.27 | 0.05 | 0.04 | 0.04 | 0.05 | 0.00 | 0.05 | 0.13 | 0.03 | 0.00 | 0.07 | 0.13 | 0.08 |
| SEQID-01479 | Q3E792 | — | — | 0 | 0.50 | 0.21 | 0.08 | 0.09 | 0.00 | 0.04 | 0.00 | 0.05 | 0.05 | 0.02 | 0.03 | 0.08 | 0.08 | 0.19 |

TABLE 1-continued

| | | | | | | | | | | | | | | | |
|---|---|---|---|---|---|---|---|---|---|---|---|---|---|---|---|
| SEQID-01480 | P40037 | — | — | 0 | 0.47 | 0.25 | 0.10 | 0.03 | 0.08 | 0.05 | 0.01 | 0.03 | 0.07 | 0.01 | 0.07 | 0.07 | 0.06 |
| SEQID-01481 | P32463 | — | — | 0 | 0.41 | 0.23 | 0.05 | 0.03 | 0.06 | 0.10 | 0.01 | 0.05 | 0.06 | 0.01 | 0.09 | 0.06 | 0.06 |
| SEQID-01482 | P00128 | — | — | 1 | 0.44 | 0.24 | 0.06 | 0.03 | 0.04 | 0.06 | 0.01 | 0.04 | 0.11 | 0.03 | 0.09 | 0.12 | 0.08 |
| SEQID-01483 | P07281 | — | — | 1 | 0.39 | 0.20 | 0.06 | 0.12 | 0.04 | 0.06 | 0.00 | 0.06 | 0.07 | 0.02 | 0.07 | 0.06 | 0.09 |
| SEQID-01484 | P04456 | — | — | 0 | 0.51 | 0.22 | 0.09 | 0.07 | 0.05 | 0.04 | 0.01 | 0.02 | 0.04 | 0.01 | 0.05 | 0.08 | 0.18 |
| SEQID-01485 | Q12513 | — | — | 0 | 0.39 | 0.20 | 0.04 | 0.07 | 0.09 | 0.11 | 0.01 | 0.03 | 0.12 | 0.02 | 0.08 | 0.07 | 0.08 |
| SEQID-01486 | P05756 | — | — | 1 | 0.46 | 0.24 | 0.06 | 0.13 | 0.04 | 0.03 | 0.01 | 0.02 | 0.05 | 0.02 | 0.09 | 0.09 | 0.10 |
| SEQID-01487 | P39726 | — | — | 1 | 0.46 | 0.21 | 0.04 | 0.04 | 0.05 | 0.05 | 0.00 | 0.03 | 0.12 | 0.02 | 0.04 | 0.11 | 0.06 |
| SEQID-01488 | Q12408 | — | — | 0 | 0.45 | 0.28 | 0.04 | 0.02 | 0.06 | 0.08 | 0.02 | 0.05 | 0.12 | 0.01 | 0.09 | 0.11 | 0.05 |
| SEQID-01489 | P40043 | — | — | 1 | 0.56 | 0.16 | 0.02 | 0.04 | 0.02 | 0.05 | 0.01 | 0.02 | 0.13 | 0.10 | 0.04 | 0.05 | 0.13 |
| SEQID-01490 | P38886 | — | — | 0 | 0.41 | 0.20 | 0.05 | 0.07 | 0.06 | 0.08 | 0.01 | 0.03 | 0.11 | 0.03 | 0.06 | 0.09 | 0.04 |
| SEQID-01491 | Q07651 | — | — | 1 | 0.49 | 0.19 | 0.06 | 0.06 | 0.06 | 0.03 | 0.02 | 0.10 | 0.11 | 0.03 | 0.09 | 0.11 | 0.05 |
| SEQID-01492 | Q07551 | — | — | 1 | 0.48 | 0.22 | 0.04 | 0.04 | 0.06 | 0.05 | 0.01 | 0.03 | 0.02 | 0.01 | 0.07 | 0.10 | 0.10 |
| SEQID-01493 | P50107 | — | — | 1 | 0.47 | 0.17 | 0.02 | 0.05 | 0.04 | 0.06 | 0.02 | 0.06 | 0.09 | 0.02 | 0.05 | 0.08 | 0.10 |
| SEQID-01494 | P04173 | — | — | 1 | 0.50 | 0.26 | 0.07 | 0.04 | 0.06 | 0.07 | 0.00 | 0.03 | 0.08 | 0.05 | 0.07 | 0.12 | 0.09 |
| SEQID-01495 | P49723 | — | — | 1 | 0.49 | 0.17 | 0.05 | 0.04 | 0.04 | 0.06 | 0.01 | 0.03 | 0.04 | 0.02 | 0.07 | 0.07 | 0.11 |
| SEQID-01496 | P40495 | — | — | 0 | 0.45 | 0.25 | 0.06 | 0.08 | 0.04 | 0.06 | 0.01 | 0.05 | 0.07 | 0.01 | 0.08 | 0.09 | 0.08 |
| SEQID-01497 | P08524 | — | — | 1 | 0.48 | 0.22 | 0.05 | 0.04 | 0.07 | 0.06 | 0.02 | 0.04 | 0.10 | 0.02 | 0.06 | 0.10 | 0.11 |
| SEQID-01498 | Q12123 | — | — | 1 | 0.50 | 0.23 | 0.05 | 0.07 | 0.04 | 0.07 | 0.00 | 0.03 | 0.07 | 0.05 | 0.08 | 0.09 | 0.08 |
| SEQID-01499 | Q12329 | — | — | 0 | 0.34 | 0.14 | 0.04 | 0.09 | 0.05 | 0.07 | 0.01 | 0.03 | 0.08 | 0.04 | 0.08 | 0.09 | 0.07 |
| SEQID-01500 | P38219 | — | — | 1 | 0.49 | 0.24 | 0.03 | 0.07 | 0.04 | 0.06 | 0.01 | 0.06 | 0.04 | 0.02 | 0.09 | 0.06 | 0.11 |
| SEQID-01501 | P38891 | — | — | 1 | 0.49 | 0.21 | 0.05 | 0.06 | 0.05 | 0.06 | 0.01 | 0.04 | 0.07 | 0.02 | 0.05 | 0.09 | 0.08 |
| SEQID-01502 | P09938 | — | — | 1 | 0.50 | 0.19 | 0.05 | 0.05 | 0.06 | 0.09 | 0.01 | 0.02 | 0.13 | 0.02 | 0.06 | 0.09 | 0.10 |
| SEQID-01503 | P07991 | — | — | 1 | 0.51 | 0.24 | 0.05 | 0.04 | 0.04 | 0.06 | 0.00 | 0.04 | 0.10 | 0.06 | 0.07 | 0.11 | 0.10 |
| SEQID-01504 | P29952 | — | — | 1 | 0.46 | 0.19 | 0.07 | 0.05 | 0.03 | 0.05 | 0.02 | 0.04 | 0.07 | 0.01 | 0.05 | 0.08 | 0.03 |
| SEQID-01505 | P40054 | — | — | 1 | 0.47 | 0.26 | 0.05 | 0.05 | 0.05 | 0.07 | 0.00 | 0.05 | 0.08 | 0.03 | 0.06 | 0.10 | 0.10 |
| SEQID-01506 | P32481 | — | — | 1 | 0.48 | 0.25 | 0.05 | 0.04 | 0.07 | 0.04 | 0.01 | 0.06 | 0.07 | 0.03 | 0.09 | 0.08 | 0.06 |
| SEQID-01507 | P03536 | — | — | 1 | 0.45 | 0.24 | 0.04 | 0.09 | 0.04 | 0.06 | 0.02 | 0.04 | 0.10 | 0.03 | 0.10 | 0.10 | 0.09 |
| SEQID-01508 | P06208 | — | — | 0 | 0.42 | 0.20 | 0.06 | 0.08 | 0.06 | 0.07 | 0.00 | 0.03 | 0.07 | 0.03 | 0.08 | 0.10 | 0.05 |
| SEQID-01509 | P46655 | — | — | 1 | 0.50 | 0.21 | 0.05 | 0.07 | 0.05 | 0.06 | 0.01 | 0.03 | 0.08 | 0.02 | 0.06 | 0.07 | 0.07 |
| SEQID-01510 | P04801 | — | — | 1 | 0.48 | 0.18 | 0.03 | 0.07 | 0.04 | 0.07 | 0.01 | 0.04 | 0.07 | 0.02 | 0.07 | 0.08 | 0.11 |
| SEQID-01511 | P00915 | — | — | 1 | 0.47 | 0.24 | 0.05 | 0.04 | 0.04 | 0.06 | 0.01 | 0.04 | 0.10 | 0.03 | 0.05 | 0.08 | 0.10 |
| SEQID-01512 | P39730 | — | — | 1 | 0.45 | 0.20 | 0.05 | 0.06 | 0.03 | 0.06 | 0.02 | 0.05 | 0.10 | 0.02 | 0.06 | 0.11 | 0.09 |
| SEQID-01513 | P22515 | — | — | 1 | 0.48 | 0.22 | 0.04 | 0.05 | 0.06 | 0.08 | 0.00 | 0.04 | 0.14 | 0.01 | 0.05 | 0.09 | 0.14 |
| SEQID-01514 | Q00955 | — | — | 1 | 0.47 | 0.12 | 0.04 | 0.08 | 0.05 | 0.06 | 0.00 | 0.04 | 0.08 | 0.02 | 0.06 | 0.10 | 0.09 |
| SEQID-01515 | P37299 | — | — | 1 | 0.56 | 0.20 | 0.03 | 0.04 | 0.03 | 0.04 | 0.00 | 0.01 | 0.09 | 0.03 | 0.07 | 0.09 | 0.07 |
| SEQID-01516 | P50263 | — | — | 0 | 0.45 | 0.03 | 0.08 | 0.19 | 0.12 | 0.10 | 0.03 | 0.01 | 0.05 | 0.05 | 0.03 | 0.17 | 0.07 |
| SEQID-01517 | P01098 | — | — | 0 | 0.37 | 0.18 | 0.10 | 0.01 | 0.09 | 0.03 | 0.00 | 0.06 | 0.06 | 0.06 | 0.01 | 0.01 | 0.16 |
| SEQID-01518 | Q12497 | — | — | 1 | 0.42 | 0.12 | 0.07 | 0.11 | 0.05 | 0.02 | 0.01 | 0.06 | 0.10 | 0.03 | 0.06 | 0.10 | 0.11 |
| SEQID-01519 | P05745 | — | — | 1 | 0.49 | 0.20 | 0.06 | 0.11 | 0.03 | 0.10 | 0.02 | 0.00 | 0.07 | 0.03 | 0.02 | 0.08 | 0.13 |
| SEQID-01520 | Q3E841 | — | — | 1 | 0.47 | 0.20 | 0.07 | 0.17 | 0.05 | 0.01 | 0.01 | 0.00 | 0.06 | 0.01 | 0.08 | 0.06 | 0.16 |
| SEQID-01521 | P38910 | — | — | 0 | 0.51 | 0.29 | 0.05 | 0.06 | 0.05 | 0.03 | 0.00 | 0.07 | 0.08 | 0.03 | 0.09 | 0.11 | 0.10 |
| SEQID-01522 | P41056 | — | — | 1 | 0.46 | 0.20 | 0.05 | 0.04 | 0.07 | 0.07 | 0.00 | 0.03 | 0.06 | 0.00 | 0.07 | 0.06 | 0.12 |
| SEQID-01523 | P39939 | — | — | 0 | 0.37 | 0.16 | 0.08 | 0.14 | 0.07 | 0.03 | 0.03 | 0.01 | 0.04 | 0.03 | 0.06 | 0.03 | 0.09 |
| SEQID-01524 | Q08245 | — | — | 0 | 0.42 | 0.14 | 0.03 | 0.19 | 0.07 | 0.03 | 0.00 | 0.01 | 0.04 | 0.01 | 0.05 | 0.14 | 0.14 |
| SEQID-01525 | P04912 | — | — | 0 | 0.42 | 0.24 | 0.04 | 0.01 | 0.12 | 0.02 | 0.03 | 0.02 | 0.21 | 0.03 | 0.04 | 0.01 | 0.20 |
| SEQID-01526 | POCX41 | — | — | 1 | 0.45 | 0.22 | 0.04 | 0.11 | 0.09 | 0.04 | 0.00 | 0.06 | 0.05 | 0.00 | 0.06 | 0.10 | 0.10 |
| SEQID-01527 | P07274 | — | — | 1 | 0.43 | 0.24 | 0.03 | 0.11 | 0.05 | 0.10 | 0.01 | 0.07 | 0.04 | 0.03 | 0.05 | 0.08 | 0.10 |
| SEQID-01528 | Q12305 | — | — | 1 | 0.43 | 0.18 | 0.06 | 0.06 | 0.03 | 0.07 | 0.01 | 0.06 | 0.05 | 0.04 | 0.08 | 0.06 | 0.16 |
| SEQID-01529 | P40185 | — | — | 0 | 0.48 | 0.23 | 0.04 | 0.04 | 0.06 | 0.07 | 0.01 | 0.04 | 0.07 | 0.01 | 0.06 | 0.03 | 0.10 |
| SEQID-01530 | P38879 | — | — | 0 | 0.41 | 0.21 | 0.07 | 0.05 | 0.09 | 0.03 | 0.01 | 0.01 | 0.06 | 0.03 | 0.04 | 0.05 | 0.05 |
| SEQID-01531 | P11076 | — | — | 1 | 0.49 | 0.22 | 0.04 | 0.03 | 0.07 | 0.04 | 0.01 | 0.03 | 0.10 | 0.01 | 0.06 | 0.08 | 0.08 |
| SEQID-01532 | P49435 | — | — | 0 | 0.50 | 0.26 | 0.07 | 0.09 | 0.04 | 0.04 | 0.01 | 0.04 | 0.11 | 0.01 | 0.07 | 0.10 | 0.11 |

TABLE 1-continued

| SEQID | ID | | | | | | | | | | | | | | | | | |
|---|---|---|---|---|---|---|---|---|---|---|---|---|---|---|---|---|---|---|
| SEQID-01533 | P22141 | — | — | 0 | 0.45 | 0.23 | 0.03 | 0.08 | 0.02 | 0.09 | 0.00 | 0.07 | 0.06 | 0.03 | 0.02 | 0.07 | 0.10 | 0.08 |
| SEQID-01534 | P07260 | — | — | 1 | 0.52 | 0.20 | 0.03 | 0.06 | 0.04 | 0.08 | 0.01 | 0.03 | 0.10 | 0.04 | 0.01 | 0.05 | 0.09 | 0.10 |
| SEQID-01535 | Q04304 | — | — | 1 | 0.46 | 0.25 | 0.06 | 0.06 | 0.06 | 0.06 | 0.01 | 0.03 | 0.08 | 0.03 | 0.01 | 0.07 | 0.08 | 0.09 |
| SEQID-01536 | Q01976 | — | — | 1 | 0.48 | 0.23 | 0.03 | 0.07 | 0.04 | 0.07 | 0.02 | 0.05 | 0.09 | 0.03 | 0.02 | 0.08 | 0.11 | 0.10 |
| SEQID-01537 | Q12522 | — | — | 0 | 0.43 | 0.27 | 0.04 | 0.08 | 0.06 | 0.05 | 0.02 | 0.06 | 0.09 | 0.04 | 0.02 | 0.07 | 0.11 | 0.01 |
| SEQID-01538 | P40582 | — | — | 1 | 0.48 | 0.22 | 0.04 | 0.05 | 0.03 | 0.06 | 0.00 | 0.04 | 0.08 | 0.02 | 0.02 | 0.06 | 0.11 | 0.09 |
| SEQID-01539 | P39929 | — | — | 1 | 0.44 | 0.20 | 0.04 | 0.05 | 0.08 | 0.06 | 0.00 | 0.06 | 0.08 | 0.03 | 0.03 | 0.07 | 0.09 | 0.10 |
| SEQID-01540 | P39931 | — | — | 1 | 0.51 | 0.20 | 0.03 | 0.05 | 0.04 | 0.03 | 0.00 | 0.02 | 0.17 | 0.02 | 0.02 | 0.07 | 0.03 | 0.09 |
| SEQID-01541 | P00410 | — | — | 0 | 0.53 | 0.28 | 0.04 | 0.03 | 0.03 | 0.06 | 0.01 | 0.04 | 0.15 | 0.03 | 0.01 | 0.10 | 0.11 | 0.04 |
| SEQID-01542 | P15873 | — | — | 1 | 0.51 | 0.26 | 0.03 | 0.04 | 0.02 | 0.06 | 0.00 | 0.03 | 0.07 | 0.02 | 0.01 | 0.09 | 0.13 | 0.08 |
| SEQID-01543 | P32379 | — | — | 1 | 0.43 | 0.22 | 0.06 | 0.06 | 0.05 | 0.06 | 0.01 | 0.04 | 0.08 | 0.02 | 0.02 | 0.06 | 0.11 | 0.10 |
| SEQID-01544 | P21801 | — | — | 1 | 0.46 | 0.19 | 0.06 | 0.06 | 0.03 | 0.03 | 0.05 | 0.03 | 0.15 | 0.04 | 0.03 | 0.06 | 0.11 | 0.07 |
| SEQID-01545 | P30656 | — | — | 1 | 0.45 | 0.20 | 0.04 | 0.06 | 0.04 | 0.06 | 0.02 | 0.05 | 0.04 | 0.03 | 0.03 | 0.06 | 0.11 | 0.09 |
| SEQID-01546 | Q04491 | — | — | 1 | 0.51 | 0.23 | 0.05 | 0.06 | 0.05 | 0.06 | 0.00 | 0.06 | 0.06 | 0.05 | 0.03 | 0.06 | 0.08 | 0.06 |
| SEQID-01547 | P07143 | — | — | 1 | 0.43 | 0.16 | 0.08 | 0.07 | 0.04 | 0.05 | 0.01 | 0.03 | 0.09 | 0.04 | 0.03 | 0.03 | 0.08 | 0.08 |
| SEQID-01548 | P24280 | — | — | 1 | 0.44 | 0.18 | 0.04 | 0.06 | 0.03 | 0.03 | 0.01 | 0.04 | 0.07 | 0.03 | 0.03 | 0.03 | 0.08 | 0.07 |
| SEQID-01549 | P01120 | — | — | 0 | 0.37 | 0.17 | 0.05 | 0.00 | 0.11 | 0.06 | 0.05 | 0.08 | 0.10 | 0.03 | 0.02 | 0.05 | 0.09 | 0.09 |
| SEQID-01550 | P14065 | — | — | 1 | 0.51 | 0.24 | 0.04 | 0.04 | 0.06 | 0.05 | 0.01 | 0.05 | 0.07 | 0.05 | 0.01 | 0.05 | 0.06 | 0.08 |
| SEQID-01551 | P53598 | — | — | 0 | 0.51 | 0.22 | 0.04 | 0.04 | 0.05 | 0.04 | 0.01 | 0.04 | 0.07 | 0.03 | 0.04 | 0.05 | 0.10 | 0.10 |
| SEQID-01552 | P47120 | — | — | 1 | 0.43 | 0.22 | 0.06 | 0.06 | 0.02 | 0.06 | 0.01 | 0.07 | 0.07 | 0.06 | 0.01 | 0.10 | 0.07 | 0.10 |
| SEQID-01553 | Q12068 | — | — | 1 | 0.51 | 0.22 | 0.03 | 0.06 | 0.05 | 0.04 | 0.01 | 0.03 | 0.12 | 0.04 | 0.03 | 0.04 | 0.11 | 0.07 |
| SEQID-01554 | P38115 | — | — | 1 | 0.49 | 0.24 | 0.05 | 0.04 | 0.05 | 0.06 | 0.01 | 0.05 | 0.08 | 0.03 | 0.03 | 0.06 | 0.09 | 0.11 |
| SEQID-01555 | P53839 | — | — | 1 | 0.49 | 0.24 | 0.04 | 0.05 | 0.04 | 0.08 | 0.01 | 0.06 | 0.10 | 0.03 | 0.04 | 0.07 | 0.12 | 0.09 |
| SEQID-01556 | P32366 | — | — | 1 | 0.43 | 0.21 | 0.04 | 0.06 | 0.04 | 0.04 | 0.02 | 0.04 | 0.11 | 0.04 | 0.02 | 0.06 | 0.10 | 0.09 |
| SEQID-01557 | Q03102 | — | — | 1 | 0.50 | 0.21 | 0.06 | 0.04 | 0.05 | 0.05 | 0.01 | 0.05 | 0.09 | 0.03 | 0.04 | 0.07 | 0.11 | 0.08 |
| SEQID-01558 | Q06151 | — | — | 0 | 0.53 | 0.25 | 0.05 | 0.09 | 0.05 | 0.06 | 0.01 | 0.04 | 0.06 | 0.05 | 0.01 | 0.03 | 0.11 | 0.04 |
| SEQID-01559 | P32623 | — | — | 1 | 0.47 | 0.23 | 0.02 | 0.10 | 0.06 | 0.05 | 0.00 | 0.06 | 0.08 | 0.03 | 0.02 | 0.0a | 0.09 | 0.12 |
| SEQID-01560 | P23644 | — | — | 0 | 0.37 | 0.17 | 0.06 | 0.07 | 0.03 | 0.07 | 0.00 | 0.07 | 0.14 | 0.02 | 0.01 | 0.05 | 0.08 | 0.08 |
| SEQID-01561 | P32377 | — | — | 1 | 0.45 | 0.21 | 0.05 | 0.08 | 0.03 | 0.05 | 0.01 | 0.03 | 0.05 | 0.03 | 0.01 | 0.04 | 0.11 | 0.05 |
| SEQID-01562 | P27476 | — | — | 1 | 0.48 | 0.19 | 0.06 | 0.05 | 0.05 | 0.04 | 0.02 | 0.07 | 0.08 | 0.04 | 0.01 | 0.05 | 0.04 | 0.06 |
| SEQID-01563 | P36046 | — | — | 1 | 0.31 | 0.08 | 0.04 | 0.08 | 0.04 | 0.06 | 0.02 | 0.02 | 0.17 | 0.05 | 0.01 | 0.03 | 0.06 | 0.07 |
| SEQID-01564 | P23542 | — | — | 1 | 0.32 | 0.10 | 0.04 | 0.06 | 0.04 | 0.09 | 0.01 | 0.06 | 0.17 | 0.03 | 0.02 | 0.03 | 0.12 | 0.11 |
| SEQID-01565 | Q08412 | — | — | 1 | 0.50 | 0.21 | 0.06 | 0.04 | 0.05 | 0.05 | 0.01 | 0.05 | 0.05 | 0.03 | 0.02 | 0.02 | 0.10 | 0.11 |
| SEQID-01566 | P53549 | — | — | 0 | 0.35 | 0.14 | 0.03 | 0.09 | 0.06 | 0.10 | 0.00 | 0.06 | 0.15 | 0.03 | 0.03 | 0.06 | 0.11 | 0.08 |
| SEQID-01567 | P19262 | — | — | 1 | 0.44 | 0.21 | 0.04 | 0.10 | 0.03 | 0.07 | 0.00 | 0.05 | 0.12 | 0.02 | 0.02 | 0.0a | 0.09 | 0.08 |
| SEQID-01568 | P02557 | — | — | 1 | 0.48 | 0.20 | 0.06 | 0.07 | 0.05 | 0.06 | 0.01 | 0.04 | 0.11 | 0.04 | 0.01 | 0.05 | 0.08 | 0.11 |
| SEQID-01569 | P04076 | — | — | 1 | 0.43 | 0.18 | 0.04 | 0.08 | 0.04 | 0.07 | 0.02 | 0.06 | 0.09 | 0.04 | 0.03 | 0.05 | 0.07 | 0.04 |
| SEQID-01570 | P07284 | — | — | 1 | 0.49 | 0.22 | 0.04 | 0.06 | 0.06 | 0.08 | 0.01 | 0.07 | 0.08 | 0.04 | 0.03 | 0.04 | 0.12 | 0.07 |
| SEQID-01571 | P17649 | — | — | 1 | 0.45 | 0.19 | 0.03 | 0.05 | 0.05 | 0.05 | 0.02 | 0.05 | 0.12 | 0.03 | 0.02 | 0.06 | 0.09 | 0.12 |
| SEQID-01572 | P08417 | — | — | 1 | 0.45 | 0.19 | 0.06 | 0.06 | 0.04 | 0.03 | 0.02 | 0.07 | 0.08 | 0.03 | 0.03 | 0.06 | 0.10 | 0.10 |
| SEQID-01573 | P16120 | — | — | 1 | 0.49 | 0.22 | 0.06 | 0.07 | 0.06 | 0.03 | 0.01 | 0.03 | 0.08 | 0.04 | 0.04 | 0.06 | 0.10 | 0.08 |
| SEQID-01574 | P14904 | — | — | 1 | 0.49 | 0.22 | 0.04 | 0.05 | 0.04 | 0.07 | 0.01 | 0.03 | 0.09 | 0.03 | 0.01 | 0.06 | 0.09 | 0.10 |
| SEQID-01575 | P38625 | — | — | 1 | 0.52 | 0.24 | 0.04 | 0.05 | 0.04 | 0.06 | 0.00 | 0.04 | 0.08 | 0.04 | 0.04 | 0.07 | 0.09 | 0.09 |
| SEQID-01576 | P30952 | — | — | 1 | 0.49 | 0.22 | 0.04 | 0.05 | 0.06 | 0.05 | 0.02 | 0.04 | 0.07 | 0.03 | 0.03 | 0.08 | 0.10 | 0.09 |
| SEQID-01577 | P32891 | — | — | 1 | 0.49 | 0.21 | 0.06 | 0.06 | 0.07 | 0.05 | 0.01 | 0.04 | 0.07 | 0.03 | 0.03 | 0.07 | 0.10 | 0.07 |
| SEQID-01578 | P38695 | — | — | 1 | 0.50 | 0.21 | 0.04 | 0.07 | 0.04 | 0.04 | 0.02 | 0.03 | 0.07 | 0.05 | 0.00 | 0.06 | 0.12 | 0.10 |
| SEQID-01579 | P15624 | — | — | 1 | 0.48 | 0.22 | 0.03 | 0.05 | 0.05 | 0.05 | 0.01 | 0.05 | 0.06 | 0.02 | 0.02 | 0.07 | 0.09 | 0.05 |
| SEQID-01580 | P32590 | — | — | 1 | 0.45 | 0.20 | 0.06 | 0.06 | 0.07 | 0.03 | 0.01 | 0.03 | 0.08 | 0.03 | 0.03 | 0.06 | 0.10 | 0.09 |
| SEQID-01581 | P32775 | — | — | 1 | 0.47 | 0.18 | 0.04 | 0.05 | 0.06 | 0.07 | 0.00 | 0.07 | 0.08 | 0.04 | 0.04 | 0.06 | 0.08 | 0.10 |
| SEQID-01582 | P53278 | — | — | 1 | 0.40 | 0.15 | 0.04 | 0.04 | 0.04 | 0.05 | 0.01 | 0.03 | 0.15 | 0.01 | 0.05 | 0.04 | 0.09 | 0.06 |
| SEQID-01583 | P13188 | — | — | 1 | 0.47 | 0.19 | 0.04 | 0.04 | 0.02 | 0.08 | 0.00 | 0.06 | 0.10 | 0.03 | 0.02 | 0.05 | 0.07 | 0.12 |
| SEQID-01584 | P07245 | — | — | 1 | 0.46 | 0.24 | 0.06 | 0.06 | 0.05 | 0.06 | 0.01 | 0.06 | 0.07 | 0.04 | 0.03 | 0.08 | 0.09 | 0.11 |
| SEQID-01585 | P40825 | — | — | 1 | 0.48 | 0.20 | 0.04 | 0.05 | 0.05 | 0.05 | 0.01 | 0.08 | 0.09 | 0.04 | 0.02 | 0.06 | 0.09 | 0.11 |

TABLE 1-continued

| | | | | | | | | | | | | | | |
|---|---|---|---|---|---|---|---|---|---|---|---|---|---|---|
| SEQID-01586 | P20967 | — | — | 1 | 0.47 | 0.19 | 0.04 | 0.07 | 0.04 | 0.05 | 0.01 | 0.08 | 0.03 | 0.04 | 0.05 | 0.10 | 0.08 |
| SEQID-01587 | P22855 | — | — | 1 | 0.48 | 0.19 | 0.03 | 0.06 | 0.03 | 0.06 | 0.01 | 0.07 | 0.05 | 0.03 | 0.06 | 0.08 | 0.09 |
| SEQID-01588 | F0TEP7 | — | — | 1 | 0.50 | 0.25 | 0.06 | 0.05 | 0.04 | 0.08 | 0.01 | 0.08 | 0.08 | 0.02 | 0.08 | 0.08 | 0.10 |
| SEQID-01589 | F0TIG2 | — | — | 1 | 0.46 | 0.22 | 0.04 | 0.09 | 0.04 | 0.08 | 0.01 | 0.08 | 0.05 | 0.05 | 0.09 | 0.07 | 0.09 |
| SEQID-01590 | F0TIH2 | — | — | 1 | 0.47 | 0.20 | 0.05 | 0.11 | 0.05 | 0.05 | 0.01 | 0.05 | 0.06 | 0.06 | 0.09 | 0.07 | 0.13 |
| SEQID-01591 | F0TEB3 | — | — | 1 | 0.50 | 0.11 | 0.07 | 0.04 | 0.06 | 0.07 | 0.01 | 0.09 | 0.05 | 0.05 | 0.06 | 0.08 | 0.08 |
| SEQID-01592 | F0TEJ0 | — | — | 0 | 0.45 | 0.21 | 0.05 | 0.05 | 0.06 | 0.08 | 0.01 | 0.08 | 0.06 | 0.03 | 0.06 | 0.08 | 0.07 |
| SEQID-01593 | F0TDZ2 | — | — | 0 | 0.49 | 0.23 | 0.03 | 0.06 | 0.02 | 0.10 | 0.00 | 0.06 | 0.05 | 0.04 | 0.07 | 0.08 | 0.10 |
| SEQID-01594 | F0TEQ7 | — | — | 1 | 0.45 | 0.24 | 0.05 | 0.08 | 0.06 | 0.09 | 0.00 | 0.09 | 0.04 | 0.02 | 0.06 | 0.07 | 0.08 |
| SEQID-01595 | F0TFN9 | — | — | 1 | 0.48 | 0.22 | 0.05 | 0.06 | 0.04 | 0.09 | 0.00 | 0.10 | 0.03 | 0.03 | 0.07 | 0.08 | 0.10 |
| SEQID-01596 | F0TGC0 | — | — | 1 | 0.49 | 0.15 | 0.09 | 0.16 | 0.04 | 0.04 | 0.00 | 0.04 | 0.02 | 0.03 | 0.04 | 0.07 | 0.16 |
| SEQID-01597 | F0TIP0 | — | — | 1 | 0.48 | 0.22 | 0.07 | 0.05 | 0.04 | 0.03 | 0.00 | 0.04 | 0.04 | 0.03 | 0.03 | 0.07 | 0.11 |
| SEQID-01598 | F0THG3 | — | — | 1 | 0.48 | 0.21 | 0.03 | 0.09 | 0.03 | 0.07 | 0.01 | 0.07 | 0.11 | 0.04 | 0.05 | 0.10 | 0.09 |
| SEQID-01599 | F0THR9 | — | — | 0 | 0.45 | 0.20 | 0.05 | 0.07 | 0.05 | 0.08 | 0.00 | 0.08 | 0.06 | 0.03 | 0.07 | 0.07 | 0.08 |
| SEQID-01600 | F0TID9 | — | — | 1 | 0.52 | 0.24 | 0.06 | 0.04 | 0.03 | 0.04 | 0.00 | 0.04 | 0.08 | 0.04 | 0.04 | 0.08 | 0.09 |
| SEQID-01601 | F0TII4 | — | — | 0 | 0.50 | 0.20 | 0.04 | 0.08 | 0.03 | 0.03 | 0.00 | 0.05 | 0.09 | 0.05 | 0.08 | 0.07 | 0.16 |
| SEQID-01602 | F0TEP6 | — | — | 0 | 0.46 | 0.20 | 0.04 | 0.05 | 0.04 | 0.06 | 0.00 | 0.07 | 0.06 | 0.06 | 0.06 | 0.05 | 0.11 |
| SEQID-01603 | F0TFM5 | — | — | 0 | 0.48 | 0.22 | 0.07 | 0.07 | 0.04 | 0.07 | 0.01 | 0.09 | 0.06 | 0.06 | 0.08 | 0.07 | 0.09 |
| SEQID-01604 | F0TIS4 | — | — | 0 | 0.46 | 0.20 | 0.05 | 0.08 | 0.07 | 0.08 | 0.01 | 0.08 | 0.08 | 0.03 | 0.06 | 0.06 | 0.14 |
| SEQID-01605 | F0TIG5 | — | — | 1 | 0.50 | 0.19 | 0.09 | 0.02 | 0.08 | 0.06 | 0.02 | 0.06 | 0.03 | 0.04 | 0.04 | 0.06 | 0.10 |
| SEQID-01606 | F0TIG7 | — | — | 0 | 0.44 | 0.19 | 0.04 | 0.14 | 0.04 | 0.03 | 0.01 | 0.04 | 0.03 | 0.01 | 0.05 | 0.02 | 0.12 |
| SEQID-01607 | F0TII6 | — | — | 1 | 0.47 | 0.20 | 0.06 | 0.07 | 0.06 | 0.06 | 0.00 | 0.08 | 0.10 | 0.04 | 0.07 | 0.06 | 0.08 |
| SEQID-01608 | F0TIG9 | — | — | 1 | 0.46 | 0.23 | 0.06 | 0.13 | 0.06 | 0.04 | 0.01 | 0.06 | 0.07 | 0.02 | 0.07 | 0.05 | 0.11 |
| SEQID-01609 | F0TIH5 | — | — | 1 | 0.52 | 0.23 | 0.05 | 0.08 | 0.03 | 0.04 | 0.00 | 0.04 | 0.07 | 0.03 | 0.06 | 0.04 | 0.14 |
| SEQID-01610 | F0TDX9 | — | — | 0 | 0.44 | 0.20 | 0.02 | 0.12 | 0.07 | 0.05 | 0.00 | 0.07 | 0.08 | 0.05 | 0.05 | 0.06 | 0.10 |
| SEQID-01611 | F0TE85 | — | — | 1 | 0.45 | 0.22 | 0.07 | 0.14 | 0.04 | 0.05 | 0.00 | 0.04 | 0.09 | 0.04 | 0.04 | 0.09 | 0.07 |
| SEQID-01612 | F0TFK9 | — | — | 1 | 0.44 | 0.20 | 0.04 | 0.09 | 0.05 | 0.05 | 0.02 | 0.07 | 0.06 | 0.02 | 0.07 | 0.07 | 0.10 |
| SEQID-01613 | F0TGI4 | — | — | 0 | 0.50 | 0.25 | 0.06 | 0.04 | 0.06 | 0.08 | 0.00 | 0.04 | 0.12 | 0.02 | 0.09 | 0.09 | 0.10 |
| SEQID-01614 | F0TI74 | — | — | 1 | 0.46 | 0.20 | 0.05 | 0.03 | 0.05 | 0.08 | 0.01 | 0.08 | 0.10 | 0.01 | 0.07 | 0.08 | 0.10 |
| SEQID-01615 | F0TI56 | — | — | 1 | 0.46 | 0.16 | 0.05 | 0.04 | 0.07 | 0.06 | 0.01 | 0.06 | 0.11 | 0.02 | 0.07 | 0.08 | 0.13 |
| SEQID-01616 | F0TI46 | — | — | 1 | 0.56 | 0.25 | 0.07 | 0.02 | 0.04 | 0.06 | 0.01 | 0.06 | 0.05 | 0.03 | 0.03 | 0.09 | 0.03 |
| SEQID-01617 | F0TDQ0 | — | — | 1 | 0.43 | 0.17 | 0.05 | 0.03 | 0.05 | 0.11 | 0.00 | 0.04 | 0.04 | 0.01 | 0.06 | 0.04 | 0.09 |
| SEQID-01618 | F0TDS8 | — | — | 0 | 0.42 | 0.20 | 0.02 | 0.12 | 0.02 | 0.05 | 0.00 | 0.07 | 0.14 | 0.02 | 0.01 | 0.08 | 0.03 |
| SEQID-01619 | F0TE84 | — | — | 1 | 0.41 | 0.20 | 0.03 | 0.15 | 0.04 | 0.06 | 0.00 | 0.04 | 0.09 | 0.01 | 0.02 | 0.10 | 0.07 |
| SEQID-01620 | F0TED5 | — | — | 1 | 0.52 | 0.24 | 0.06 | 0.03 | 0.05 | 0.09 | 0.01 | 0.09 | 0.07 | 0.03 | 0.05 | 0.09 | 0.12 |
| SEQID-01621 | F0TEQ9 | — | — | 0 | 0.43 | 0.20 | 0.06 | 0.05 | 0.05 | 0.04 | 0.00 | 0.08 | 0.08 | 0.02 | 0.06 | 0.06 | 0.08 |
| SEQID-01622 | F0TEU3 | — | — | 0 | 0.49 | 0.20 | 0.10 | 0.06 | 0.06 | 0.04 | 0.00 | 0.04 | 0.12 | 0.01 | 0.06 | 0.06 | 0.16 |
| SEQID-01623 | F0TFQ7 | — | — | 0 | 0.44 | 0.21 | 0.01 | 0.19 | 0.04 | 0.04 | 0.00 | 0.06 | 0.07 | 0.01 | 0.08 | 0.08 | 0.08 |
| SEQID-01624 | F0TFS5 | — | — | 1 | 0.45 | 0.23 | 0.05 | 0.03 | 0.05 | 0.01 | 0.00 | 0.04 | 0.09 | 0.04 | 0.07 | 0.04 | 0.09 |
| SEQID-01625 | F0TGH0 | — | — | 0 | 0.49 | 0.17 | 0.05 | 0.13 | 0.01 | 0.07 | 0.01 | 0.06 | 0.04 | 0.04 | 0.05 | 0.06 | 0.14 |
| SEQID-01626 | F0TH33 | — | — | 1 | 0.51 | 0.17 | 0.07 | 0.01 | 0.04 | 0.04 | 0.01 | 0.06 | 0.03 | 0.02 | 0.02 | 0.06 | 0.19 |
| SEQID-01627 | F0THG4 | — | — | 1 | 0.52 | 0.23 | 0.08 | 0.03 | 0.08 | 0.05 | 0.01 | 0.05 | 0.06 | 0.03 | 0.05 | 0.08 | 0.09 |
| SEQID-01628 | F0TIG8 | — | — | 1 | 0.48 | 0.20 | 0.05 | 0.09 | 0.05 | 0.03 | 0.00 | 0.05 | 0.11 | 0.05 | 0.03 | 0.11 | 0.07 |
| SEQID-01629 | F0TIH8 | — | — | 0 | 0.52 | 0.24 | 0.04 | 0.11 | 0.04 | 0.02 | 0.00 | 0.03 | 0.08 | 0.04 | 0.02 | 0.02 | 0.09 |
| SEQID-01630 | F0TIH9 | — | — | 0 | 0.47 | 0.19 | 0.01 | 0.13 | 0.06 | 0.06 | 0.01 | 0.06 | 0.06 | 0.01 | 0.04 | 0.06 | 0.16 |
| SEQID-01631 | F0TII3 | — | — | 1 | 0.48 | 0.27 | 0.05 | 0.13 | 0.05 | 0.05 | 0.00 | 0.06 | 0.07 | 0.01 | 0.09 | 0.06 | 0.11 |
| SEQID-01632 | F0TII5 | — | — | 1 | 0.46 | 0.26 | 0.05 | 0.09 | 0.05 | 0.01 | 0.01 | 0.04 | 0.06 | 0.01 | 0.12 | 0.06 | 0.11 |
| SEQID-01633 | F0TII6 | — | — | 0 | 0.38 | 0.20 | 0.04 | 0.21 | 0.04 | 0.07 | 0.01 | 0.06 | 0.04 | 0.01 | 0.07 | 0.06 | 0.10 |
| SEQID-01634 | F0TIR8 | — | — | 1 | 0.43 | 0.21 | 0.07 | 0.16 | 0.02 | 0.06 | 0.01 | 0.06 | 0.03 | 0.02 | 0.05 | 0.09 | 0.12 |
| SEQID-01635 | F0TIS2 | — | — | 0 | 0.50 | 0.23 | 0.08 | 0.05 | 0.08 | 0.08 | 0.01 | 0.08 | 0.06 | 0.05 | 0.10 | 0.07 | 0.09 |
| SEQID-01636 | F0TIU2 | — | — | 1 | 0.44 | 0.22 | 0.08 | 0.05 | 0.05 | 0.09 | 0.00 | 0.09 | 0.09 | 0.02 | 0.06 | 0.09 | 0.07 |
| SEQID-01637 | F0TIX0 | — | — | 0 | 0.40 | 0.18 | 0.07 | 0.00 | 0.07 | 0.08 | 0.01 | 0.19 | 0.11 | 0.01 | 0.08 | 0.08 | 0.13 |
| SEQID-01638 | P13538 | — | — | 1 | 0.45 | 0.19 | 0.05 | 0.07 | 0.05 | 0.04 | 0.01 | 0.05 | 0.15 | 0.03 | 0.05 | 0.10 | 0.12 |

TABLE 1-continued

| | | | | | | | | | | | | | | |
|---|---|---|---|---|---|---|---|---|---|---|---|---|---|---|
| SEQID-01639 | F1P3W7 | — | — | 1 | 0.45 | 0.19 | 0.05 | 0.07 | 0.04 | 0.05 | 0.01 | 0.07 | 0.15 | 0.02 | 0.02 | 0.05 | 0.10 | 0.12 |
| SEQID-01640 | F1P3X4 | — | — | 1 | 0.45 | 0.19 | 0.05 | 0.07 | 0.04 | 0.05 | 0.01 | 0.07 | 0.15 | 0.02 | 0.03 | 0.05 | 0.10 | 0.12 |
| SEQID-01641 | F1ND26 | — | — | 1 | 0.45 | 0.19 | 0.06 | 0.07 | 0.04 | 0.05 | 0.01 | 0.07 | 0.15 | 0.02 | 0.02 | 0.05 | 0.10 | 0.12 |
| SEQID-01642 | F1NDL1 | — | — | 1 | 0.47 | 0.17 | 0.05 | 0.06 | 0.03 | 0.08 | 0.01 | 0.05 | 0.07 | 0.03 | 0.04 | 0.06 | 0.07 | 0.13 |
| SEQID-01643 | F1NGF6 | — | — | 1 | 0.47 | 0.20 | 0.04 | 0.07 | 0.04 | 0.05 | 0.01 | 0.04 | 0.11 | 0.03 | 0.03 | 0.06 | 0.06 | 0.09 |
| SEQID-01644 | P68139 | — | — | 1 | 0.47 | 0.20 | 0.04 | 0.08 | 0.03 | 0.06 | 0.02 | 0.03 | 0.09 | 0.04 | 0.03 | 0.04 | 0.07 | 0.06 |
| SEQID-01645 | P00565 | — | — | 1 | 0.50 | 0.19 | 0.02 | 0.08 | 0.04 | 0.07 | 0.01 | 0.04 | 0.08 | 0.05 | 0.05 | 0.07 | 0.09 | 0.09 |
| SEQID-01646 | P00543 | — | — | 1 | 0.47 | 0.22 | 0.07 | 0.09 | 0.04 | 0.06 | 0.01 | 0.03 | 0.11 | 0.04 | 0.04 | 0.04 | 0.07 | 0.08 |
| SEQID-01647 | P16419 | — | — | 1 | 0.49 | 0.20 | 0.04 | 0.09 | 0.03 | 0.06 | 0.01 | 0.03 | 0.09 | 0.03 | 0.02 | 0.08 | 0.07 | 0.09 |
| SEQID-01648 | Q5ZMQ2 | — | — | 1 | 0.45 | 0.20 | 0.05 | 0.07 | 0.02 | 0.07 | 0.02 | 0.04 | 0.11 | 0.04 | 0.03 | 0.05 | 0.09 | 0.06 |
| SEQID-01649 | F1NU17 | — | — | 1 | 0.54 | 0.24 | 0.06 | 0.03 | 0.04 | 0.06 | 0.01 | 0.02 | 0.07 | 0.05 | 0.05 | 0.05 | 0.09 | 0.13 |
| SEQID-01650 | P07322 | — | — | 1 | 0.49 | 0.22 | 0.07 | 0.06 | 0.04 | 0.07 | 0.01 | 0.04 | 0.09 | 0.05 | 0.05 | 0.07 | 0.09 | 0.10 |
| SEQID-01651 | P20111 | — | — | 1 | 0.44 | 0.19 | 0.05 | 0.09 | 0.04 | 0.06 | 0.01 | 0.07 | 0.12 | 0.02 | 0.03 | 0.07 | 0.09 | 0.07 |
| SEQID-01652 | P13585 | — | — | 1 | 0.50 | 0.25 | 0.06 | 0.07 | 0.04 | 0.06 | 0.02 | 0.02 | 0.09 | 0.03 | 0.02 | 0.05 | 0.10 | 0.06 |
| SEQID-01653 | P00356 | — | — | 1 | 0.52 | 0.22 | 0.07 | 0.05 | 0.05 | 0.06 | 0.01 | 0.02 | 0.04 | 0.05 | 0.04 | 0.06 | 0.06 | 0.09 |
| SEQID-01654 | Q07734 | — | — | 1 | 0.47 | 0.21 | 0.03 | 0.07 | 0.03 | 0.07 | 0.01 | 0.02 | 0.09 | 0.05 | 0.04 | 0.05 | 0.06 | 0.10 |
| SEQID-01655 | F1NN63 | — | — | 1 | 0.47 | 0.20 | 0.06 | 0.03 | 0.05 | 0.07 | 0.02 | 0.03 | 0.05 | 0.03 | 0.03 | 0.08 | 0.07 | 0.08 |
| SEQID-01656 | F2Z4L6 | — | — | 1 | 0.43 | 0.18 | 0.04 | 0.06 | 0.03 | 0.05 | 0.05 | 0.06 | 0.09 | 0.05 | 0.04 | 0.06 | 0.07 | 0.09 |
| SEQID-01657 | F1NX83 | — | — | 1 | 0.46 | 0.20 | 0.04 | 0.08 | 0.05 | 0.05 | 0.03 | 0.04 | 0.07 | 0.02 | 0.03 | 0.06 | 0.09 | 0.06 |
| SEQID-01658 | P00940 | — | — | 1 | 0.51 | 0.23 | 0.07 | 0.04 | 0.01 | 0.06 | 0.02 | 0.04 | 0.03 | 0.06 | 0.05 | 0.07 | 0.07 | 0.11 |
| SEQID-01659 | F1NXK1 | — | — | 1 | 0.46 | 0.20 | 0.03 | 0.05 | 0.03 | 0.05 | 0.01 | 0.05 | 0.13 | 0.02 | 0.02 | 0.07 | 0.07 | 0.11 |
| SEQID-01660 | E1B5N7 | — | — | 1 | 0.45 | 0.21 | 0.04 | 0.09 | 0.05 | 0.06 | 0.02 | 0.04 | 0.09 | 0.03 | 0.03 | 0.06 | 0.09 | 0.06 |
| SEQID-01661 | Q02173 | — | — | 1 | 0.46 | 0.20 | 0.05 | 0.07 | 0.04 | 0.06 | 0.01 | 0.03 | 0.10 | 0.03 | 0.03 | 0.05 | 0.07 | 0.08 |
| SEQID-01662 | F1NW35 | — | — | 1 | 0.57 | 0.27 | 0.04 | 0.04 | 0.03 | 0.07 | 0.02 | 0.04 | 0.06 | 0.04 | 0.04 | 0.07 | 0.10 | 0.11 |
| SEQID-01663 | E19T53 | — | — | 0 | 0.47 | 0.20 | 0.04 | 0.06 | 0.05 | 0.05 | 0.01 | 0.05 | 0.12 | 0.03 | 0.07 | 0.05 | 0.08 | 0.11 |
| SEQID-01664 | P02609 | — | — | 1 | 0.48 | 0.17 | 0.04 | 0.03 | 0.03 | 0.06 | 0.02 | 0.03 | 0.09 | 0.03 | 0.02 | 0.07 | 0.05 | 0.11 |
| SEQID-01665 | F1NIJ6 | — | — | 1 | 0.55 | 0.21 | 0.05 | 0.10 | 0.05 | 0.09 | 0.01 | 0.03 | 0.11 | 0.04 | 0.01 | 0.06 | 0.10 | 0.11 |
| SEQID-01666 | P05031 | — | — | 0 | 0.50 | 0.22 | 0.05 | 0.06 | 0.05 | 0.05 | 0.05 | 0.04 | 0.07 | 0.04 | 0.06 | 0.06 | 0.10 | 0.09 |
| SEQID-01667 | P68246 | — | — | 1 | 0.45 | 0.17 | 0.03 | 0.07 | 0.01 | 0.06 | 0.01 | 0.04 | 0.11 | 0.05 | 0.03 | 0.05 | 0.10 | 0.13 |
| SEQID-01668 | P11009 | — | — | 1 | 0.45 | 0.21 | 0.04 | 0.11 | 0.03 | 0.07 | 0.02 | 0.05 | 0.14 | 0.02 | 0.02 | 0.07 | 0.11 | 0.16 |
| SEQID-01669 | P08106 | — | — | 1 | 0.46 | 0.20 | 0.05 | 0.11 | 0.04 | 0.07 | 0.01 | 0.03 | 0.07 | 0.04 | 0.04 | 0.06 | 0.10 | 0.06 |
| SEQID-01670 | P02457 | — | — | 1 | 0.24 | 0.09 | 0.08 | 0.07 | 0.05 | 0.08 | 0.01 | 0.05 | 0.09 | 0.04 | 0.04 | 0.05 | 0.07 | 0.08 |
| SEQID-01671 | P02604 | — | — | 0 | 0.46 | 0.17 | 0.08 | 0.08 | 0.03 | 0.05 | 0.02 | 0.04 | 0.07 | 0.16 | 0.07 | 0.07 | 0.04 | 0.10 |
| SEQID-01672 | Q52LN1 | — | — | 1 | 0.45 | 0.20 | 0.09 | 0.03 | 0.05 | 0.06 | 0.00 | 0.04 | 0.13 | 0.03 | 0.03 | 0.05 | 0.07 | 0.12 |
| SEQID-01673 | Q05623 | — | — | 1 | 0.42 | 0.16 | 0.06 | 0.10 | 0.04 | 0.06 | 0.01 | 0.04 | 0.09 | 0.03 | 0.03 | 0.06 | 0.09 | 0.07 |
| SEQID-01674 | E1C3E2 | — | — | 1 | 0.45 | 0.19 | 0.07 | 0.06 | 0.03 | 0.07 | 0.01 | 0.04 | 0.10 | 0.03 | 0.03 | 0.05 | 0.05 | 0.10 |
| SEQID-01675 | P51913 | — | — | 1 | 0.46 | 0.23 | 0.05 | 0.06 | 0.04 | 0.08 | 0.01 | 0.03 | 0.10 | 0.04 | 0.02 | 0.06 | 0.06 | 0.09 |
| SEQID-01676 | O73885 | — | — | 1 | 0.46 | 0.21 | 0.06 | 0.06 | 0.05 | 0.05 | 0.01 | 0.02 | 0.08 | 0.05 | 0.05 | 0.05 | 0.09 | 0.10 |
| SEQID-01677 | P15989 | — | — | 1 | 0.44 | 0.22 | 0.05 | 0.09 | 0.04 | 0.07 | 0.02 | 0.05 | 0.08 | 0.04 | 0.02 | 0.07 | 0.08 | 0.10 |
| SEQID-01678 | F1NCR0 | — | — | 0 | 0.26 | 0.11 | 0.07 | 0.05 | 0.03 | 0.04 | 0.00 | 0.06 | 0.09 | 0.17 | 0.02 | 0.03 | 0.09 | 0.06 |
| SEQID-01679 | F1NKY4 | — | — | 1 | 0.42 | 0.18 | 0.08 | 0.11 | 0.04 | 0.05 | 0.00 | 0.03 | 0.07 | 0.01 | 0.02 | 0.04 | 0.05 | 0.05 |
| SEQID-01680 | P53449 | — | — | 0 | 0.37 | 0.22 | 0.10 | 0.08 | 0.01 | 0.02 | 0.02 | 0.05 | 0.19 | 0.05 | 0.08 | 0.03 | 0.08 | 0.15 |
| SEQID-01681 | Q5ZMJ6 | — | — | 1 | 0.51 | 0.20 | 0.07 | 0.03 | 0.06 | 0.18 | 0.01 | 0.04 | 0.08 | 0.05 | 0.02 | 0.02 | 0.09 | 0.04 |
| SEQID-01682 | P19204 | — | — | 1 | 0.47 | 0.20 | 0.03 | 0.03 | 0.02 | 0.05 | 0.01 | 0.05 | 0.03 | 0.05 | 0.01 | 0.08 | 0.07 | 0.10 |
| SEQID-01683 | F1N9H4 | — | — | 1 | 0.50 | 0.21 | 0.05 | 0.06 | 0.04 | 0.06 | 0.01 | 0.02 | 0.13 | 0.02 | 0.05 | 0.05 | 0.10 | 0.09 |
| SEQID-01684 | E1BR47 | — | — | 1 | 0.46 | 0.22 | 0.03 | 0.08 | 0.04 | 0.07 | 0.02 | 0.03 | 0.08 | 0.05 | 0.03 | 0.06 | 0.06 | 0.12 |
| SEQID-01685 | F1NYI2 | — | — | 1 | 0.49 | 0.22 | 0.05 | 0.05 | 0.03 | 0.07 | 0.01 | 0.05 | 0.08 | 0.04 | 0.02 | 0.07 | 0.12 | 0.03 |
| SEQID-01686 | P02542 | — | — | 1 | 0.38 | 0.18 | 0.06 | 0.06 | 0.04 | 0.04 | 0.00 | 0.03 | 0.07 | 0.05 | 0.02 | 0.04 | 0.10 | 0.11 |
| SEQID-01687 | F1NCJ4 | — | — | 1 | 0.48 | 0.22 | 0.04 | 0.13 | 0.04 | 0.05 | 0.02 | 0.03 | 0.13 | 0.17 | 0.02 | 0.04 | 0.09 | 0.05 |
| SEQID-01688 | E1BVT3 | — | — | 0 | 0.49 | 0.25 | 0.07 | 0.06 | 0.07 | 0.06 | 0.01 | 0.05 | 0.10 | 0.01 | 0.03 | 0.06 | 0.11 | 0.07 |
| SEQID-01689 | E1BXW3 | — | — | 1 | 0.46 | 0.23 | 0.06 | 0.10 | 0.03 | 0.05 | 0.02 | 0.03 | 0.07 | 0.05 | 0.03 | 0.07 | 0.10 | 0.09 |
| SEQID-01690 | P79757 | — | — | 1 | 0.43 | 0.17 | 0.06 | 0.09 | 0.04 | 0.04 | 0.01 | 0.04 | 0.11 | 0.05 | 0.03 | 0.06 | 0.06 | 0.05 |
| SEQID-01691 | P04268 | — | — | 0 | 0.40 | 0.18 | 0.08 | 0.07 | 0.02 | 0.03 | 0.00 | 0.05 | 0.23 | 0.01 | 0.01 | 0.04 | 0.11 | 0.15 |

TABLE 1-continued

| | | | | | | | | | | | | | | | |
|---|---|---|---|---|---|---|---|---|---|---|---|---|---|---|---|
| SEQID-01692 | P00508 | — | 1 | 0.45 | 0.20 | 0.06 | 0.09 | 0.04 | 0.05 | 0.01 | 0.04 | 0.06 | 0.04 | 0.03 | 0.06 | 0.09 | 0.08 |
| SEQID-01693 | P09203 | — | 1 | 0.43 | 0.17 | 0.04 | 0.07 | 0.05 | 0.06 | 0.02 | 0.06 | 0.09 | 0.04 | 0.03 | 0.04 | 0.07 | 0.04 |
| SEQID-01694 | F1NGA2 | — | 0 | 0.45 | 0.25 | 0.07 | 0.10 | 0.03 | 0.05 | 0.00 | 0.06 | 0.07 | 0.05 | 0.01 | 0.07 | 0.10 | 0.06 |
| SEQID-01695 | P15988 | — | 1 | 0.38 | 0.17 | 0.04 | 0.09 | 0.03 | 0.07 | 0.02 | 0.05 | 0.08 | 0.08 | 0.00 | 0.06 | 0.07 | 0.07 |
| SEQID-01696 | F1NXK2 | — | 0 | 0.49 | 0.23 | 0.04 | 0.11 | 0.02 | 0.08 | 0.00 | 0.00 | 0.09 | 0.04 | 0.01 | 0.08 | 0.08 | 0.07 |
| SEQID-01697 | F1P0E4 | — | 1 | 0.50 | 0.18 | 0.05 | 0.03 | 0.06 | 0.06 | 0.02 | 0.06 | 0.05 | 0.06 | 0.05 | 0.04 | 0.09 | 0.11 |
| SEQID-01698 | E1BU93 | — | 1 | 0.46 | 0.15 | 0.03 | 0.06 | 0.04 | 0.04 | 0.01 | 0.04 | 0.03 | 0.04 | 0.05 | 0.04 | 0.08 | 0.10 |
| SEQID-01699 | P07341 | — | 1 | 0.44 | 0.20 | 0.08 | 0.06 | 0.04 | 0.04 | 0.01 | 0.05 | 0.07 | 0.04 | 0.05 | 0.05 | 0.10 | 0.08 |
| SEQID-01700 | P17785 | — | 1 | 0.45 | 0.21 | 0.05 | 0.03 | 0.02 | 0.08 | 0.01 | 0.04 | 0.09 | 0.03 | 0.06 | 0.07 | 0.09 | 0.11 |
| SEQID-01701 | E1BR89 | — | 1 | 0.43 | 0.19 | 0.06 | 0.03 | 0.04 | 0.04 | 0.02 | 0.04 | 0.05 | 0.04 | 0.01 | 0.05 | 0.09 | 0.07 |
| SEQID-01702 | F1NXR6 | — | 1 | 0.44 | 0.20 | 0.05 | 0.07 | 0.04 | 0.04 | 0.02 | 0.04 | 0.09 | 0.04 | 0.06 | 0.06 | 0.07 | 0.05 |
| SEQID-01703 | F1P0N2 | — | 1 | 0.46 | 0.18 | 0.04 | 0.08 | 0.04 | 0.06 | 0.02 | 0.04 | 0.04 | 0.04 | 0.04 | 0.05 | 0.09 | 0.07 |
| SEQID-01704 | F1NPH8 | — | 1 | 0.37 | 0.19 | 0.06 | 0.10 | 0.03 | 0.05 | 0.03 | 0.03 | 0.08 | 0.02 | 0.03 | 0.03 | 0.13 | 0.07 |
| SEQID-01705 | P04713 | — | 1 | 0.44 | 0.21 | 0.07 | 0.09 | 0.04 | 0.05 | 0.02 | 0.03 | 0.13 | 0.05 | 0.02 | 0.04 | 0.08 | 0.06 |
| SEQID-01706 | K7UZT6 | — | 1 | 0.45 | 0.22 | 0.06 | 0.03 | 0.04 | 0.06 | 0.01 | 0.05 | 0.07 | 0.05 | 0.04 | 0.04 | 0.10 | 0.06 |
| SEQID-01707 | B4F832 | — | 1 | 0.44 | 0.21 | 0.03 | 0.10 | 0.02 | 0.04 | 0.02 | 0.05 | 0.09 | 0.05 | 0.04 | 0.04 | 0.08 | 0.06 |
| SEQID-01708 | P11155 | — | 1 | 0.45 | 0.21 | 0.07 | 0.03 | 0.04 | 0.05 | 0.01 | 0.04 | 0.09 | 0.05 | 0.02 | 0.05 | 0.09 | 0.08 |
| SEQID-01709 | Q43247 | — | 1 | 0.52 | 0.23 | 0.06 | 0.05 | 0.04 | 0.07 | 0.01 | 0.02 | 0.07 | 0.05 | 0.02 | 0.06 | 0.06 | 0.06 |
| SEQID-01710 | P04712 | — | 1 | 0.43 | 0.22 | 0.04 | 0.07 | 0.05 | 0.06 | 0.02 | 0.04 | 0.08 | 0.03 | 0.06 | 0.06 | 0.11 | 0.10 |
| SEQID-01711 | B6TEC1 | — | 1 | 0.46 | 0.23 | 0.03 | 0.10 | 0.03 | 0.06 | 0.03 | 0.01 | 0.06 | 0.06 | 0.04 | 0.03 | 0.08 | 0.07 |
| SEQID-01712 | Q0QW12 | — | 1 | 0.46 | 0.23 | 0.07 | 0.10 | 0.02 | 0.07 | 0.01 | 0.04 | 0.08 | 0.06 | 0.04 | 0.05 | 0.08 | 0.05 |
| SEQID-01713 | B4F8M9 | — | 1 | 0.54 | 0.18 | 0.04 | 0.03 | 0.02 | 0.04 | 0.01 | 0.04 | 0.07 | 0.04 | 0.05 | 0.05 | 0.06 | 0.05 |
| SEQID-01714 | Q5K3Q7 | — | 1 | 0.53 | 0.28 | 0.09 | 0.03 | 0.01 | 0.05 | 0.01 | 0.03 | 0.05 | 0.06 | 0.09 | 0.09 | 0.10 | 0.15 |
| SEQID-01715 | B4FJZ7 | — | 1 | 0.46 | 0.14 | 0.07 | 0.18 | 0.01 | 0.04 | 0.00 | 0.03 | 0.07 | 0.06 | 0.04 | 0.04 | 0.06 | 0.18 |
| SEQID-01716 | B6T1F1 | — | 1 | 0.47 | 0.14 | 0.06 | 0.18 | 0.02 | 0.02 | 0.02 | 0.03 | 0.06 | 0.02 | 0.04 | 0.04 | 0.07 | 0.18 |
| SEQID-01717 | K7URL6 | — | 1 | 0.53 | 0.28 | 0.09 | 0.03 | 0.03 | 0.04 | 0.01 | 0.01 | 0.05 | 0.06 | 0.01 | 0.09 | 0.10 | 0.05 |
| SEQID-01718 | B4FUW2 | — | 1 | 0.42 | 0.17 | 0.03 | 0.22 | 0.03 | 0.04 | 0.01 | 0.05 | 0.04 | 0.04 | 0.03 | 0.03 | 0.07 | 0.10 |
| SEQID-01719 | B6UEE8 | — | 1 | 0.47 | 0.26 | 0.11 | 0.06 | 0.03 | 0.05 | 0.02 | 0.01 | 0.05 | 0.04 | 0.06 | 0.06 | 0.11 | 0.10 |
| SEQID-01720 | B4FUK7 | — | 1 | 0.47 | 0.15 | 0.05 | 0.07 | 0.06 | 0.07 | 0.02 | 0.03 | 0.06 | 0.06 | 0.02 | 0.02 | 0.06 | 0.03 |
| SEQID-01721 | B4FY16 | — | 1 | 0.53 | 0.21 | 0.05 | 0.06 | 0.03 | 0.06 | 0.02 | 0.03 | 0.07 | 0.05 | 0.07 | 0.07 | 0.06 | 0.07 |
| SEQID-01722 | Q946V2 | — | 1 | 0.41 | 0.20 | 0.06 | 0.08 | 0.05 | 0.04 | 0.02 | 0.08 | 0.06 | 0.04 | 0.03 | 0.04 | 0.09 | 0.13 |
| SEQID-01723 | B6T1H0 | — | 0 | 0.44 | 0.17 | 0.04 | 0.17 | 0.04 | 0.05 | 0.00 | 0.05 | 0.05 | 0.05 | 0.05 | 0.04 | 0.08 | 0.03 |
| SEQID-01724 | B4F989 | — | 1 | 0.46 | 0.31 | 0.05 | 0.07 | 0.02 | 0.06 | 0.03 | 0.03 | 0.09 | 0.04 | 0.00 | 0.04 | 0.07 | 0.03 |
| SEQID-01725 | B4G1E1 | — | 1 | 0.46 | 0.20 | 0.05 | 0.07 | 0.03 | 0.04 | 0.01 | 0.03 | 0.09 | 0.04 | 0.03 | 0.08 | 0.07 | 0.15 |
| SEQID-01726 | B6TQ68 | — | 1 | 0.46 | 0.14 | 0.06 | 0.19 | 0.04 | 0.08 | 0.00 | 0.08 | 0.09 | 0.04 | 0.04 | 0.08 | 0.07 | 0.06 |
| SEQID-01727 | B6SP93 | — | 0 | 0.48 | 0.11 | 0.09 | 0.04 | 0.01 | 0.00 | 0.01 | 0.02 | 0.06 | 0.04 | 0.06 | 0.04 | 0.06 | 0.06 |
| SEQID-01728 | P08440 | — | 1 | 0.45 | 0.22 | 0.07 | 0.13 | 0.07 | 0.05 | 0.01 | 0.02 | 0.08 | 0.21 | 0.03 | 0.03 | 0.03 | 0.18 |
| SEQID-01729 | B6TQ08 | — | 1 | 0.47 | 0.21 | 0.05 | 0.06 | 0.02 | 0.02 | 0.00 | 0.03 | 0.14 | 0.05 | 0.01 | 0.08 | 0.11 | 0.30 |
| SEQID-01730 | B4FUH2 | — | 0 | 0.44 | 0.18 | 0.06 | 0.07 | 0.03 | 0.03 | 0.01 | 0.04 | 0.14 | 0.03 | 0.05 | 0.08 | 0.07 | 0.10 |
| SEQID-01731 | P21569 | — | 0 | 0.50 | 0.16 | 0.09 | 0.06 | 0.02 | 0.00 | 0.01 | 0.02 | 0.09 | 0.03 | 0.08 | 0.03 | 0.10 | 0.06 |
| SEQID-01732 | P27923 | — | 0 | 0.27 | 0.13 | 0.06 | 0.05 | 0.04 | 0.05 | 0.06 | 0.11 | 0.07 | 0.09 | 0.03 | 0.02 | 0.04 | 0.04 |
| SEQID-01733 | C0P455 | — | 1 | 0.49 | 0.24 | 0.06 | 0.15 | 0.05 | 0.05 | 0.00 | 0.02 | 0.09 | 0.05 | 0.00 | 0.03 | 0.09 | 0.09 |
| SEQID-01734 | C0PHE3 | — | 0 | 0.54 | 0.08 | 0.04 | 0.04 | 0.04 | 0.06 | 0.02 | 0.06 | 0.05 | 0.05 | 0.04 | 0.05 | 0.08 | 0.18 |
| SEQID-01735 | B6SP74 | — | 1 | 0.46 | 0.20 | 0.07 | 0.08 | 0.02 | 0.03 | 0.00 | 0.03 | 0.05 | 0.04 | 0.02 | 0.04 | 0.08 | 0.11 |
| SEQID-01736 | K7T5X3 | — | 1 | 0.47 | 0.23 | 0.03 | 0.09 | 0.03 | 0.04 | 0.02 | 0.07 | 0.07 | 0.04 | 0.02 | 0.06 | 0.10 | 0.05 |
| SEQID-01737 | K7V1U2 | — | 1 | 0.27 | 0.10 | 0.06 | 0.13 | 0.07 | 0.07 | 0.02 | 0.02 | 0.08 | 0.21 | 0.02 | 0.03 | 0.03 | 0.02 |
| SEQID-01738 | B6T879 | — | 1 | 0.33 | 0.08 | 0.07 | 0.04 | 0.01 | 0.05 | 0.02 | 0.02 | 0.06 | 0.05 | 0.01 | 0.01 | 0.04 | 0.16 |
| SEQID-01739 | Q946V3 | — | 1 | 0.44 | 0.18 | 0.06 | 0.06 | 0.02 | 0.06 | 0.01 | 0.03 | 0.14 | 0.03 | 0.01 | 0.05 | 0.06 | 0.15 |
| SEQID-01740 | P12863 | — | 0 | 0.50 | 0.16 | 0.09 | 0.05 | 0.03 | 0.09 | 0.00 | 0.04 | 0.09 | 0.03 | 0.02 | 0.06 | 0.07 | 0.22 |
| SEQID-01741 | B6TC95 | — | 0 | 0.27 | 0.13 | 0.06 | 0.05 | 0.04 | 0.00 | 0.06 | 0.11 | 0.07 | 0.09 | 0.00 | 0.02 | 0.05 | 0.02 |
| SEQID-01742 | P49106 | — | 1 | 0.49 | 0.24 | 0.08 | 0.15 | 0.04 | 0.04 | 0.02 | 0.05 | 0.05 | 0.07 | 0.02 | 0.03 | 0.07 | 0.08 |
| SEQID-01743 | B6U607 | — | 1 | 0.47 | 0.08 | 0.19 | 0.04 | 0.02 | 0.08 | 0.01 | 0.05 | 0.15 | 0.05 | 0.01 | 0.05 | 0.04 | 0.31 |
| SEQID-01744 | C0P381 | — | 1 | 0.41 | 0.20 | 0.06 | 0.08 | 0.03 | 0.04 | 0.02 | 0.04 | 0.09 | 0.05 | 0.06 | 0.06 | 0.10 | 0.08 |
| SEQID-01744 | B6U607 | — | 1 | 0.04 | 0.23 | 0.09 | 0.09 | 0.05 | 0.03 | 0.01 | 0.04 | 0.09 | 0.05 | 0.01 | 0.02 | 0.12 | 0.06 |
| SEQID-01744 | C0P381 | — | 0 | 0.30 | 0.11 | 0.02 | 0.02 | 0.03 | 0.01 | 0.05 | 0.37 | 0.05 | 0.02 | 0.11 | 0.03 | 0.05 | 0.02 |

TABLE 1-continued

| | | | | | | | | | | | | | | |
|---|---|---|---|---|---|---|---|---|---|---|---|---|---|---|
| SEQID-01745 | B4G0K5 | — | 1 | 0.45 | 0.15 | 0.04 | 0.06 | 0.07 | 0.02 | 0.04 | 0.06 | 0.06 | 0.03 | 0.05 | 0.06 |
| SEQID-01746 | K7TNK3 | — | 1 | 0.43 | 0.20 | 0.05 | 0.03 | 0.05 | 0.01 | 0.09 | 0.20 | 0.01 | 0.03 | 0.13 | 0.11 |
| SEQID-01747 | B6SGI4 | — | 1 | 0.42 | 0.07 | 0.06 | 0.04 | 0.00 | 0.04 | 0.01 | 0.02 | 0.09 | 0.03 | 0.02 | 0.12 |
| SEQID-01748 | P04706 | — | 0 | 0.37 | 0.21 | 0.05 | 0.00 | 0.00 | 0.07 | 0.16 | 0.01 | 0.03 | 0.02 | 0.12 | 0.00 |
| SEQID-01749 | B6T5F2 | — | 1 | 0.49 | 0.16 | 0.06 | 0.04 | 0.02 | 0.00 | 0.06 | 0.06 | 0.03 | 0.04 | 0.06 | 0.17 |
| SEQID-01750 | B6T440 | — | 1 | 0.49 | 0.22 | 0.06 | 0.03 | 0.06 | 0.02 | 0.03 | 0.09 | 0.03 | 0.05 | 0.09 | 0.09 |
| SEQID-01751 | B6TN50 | — | 1 | 0.47 | 0.19 | 0.06 | 0.05 | 0.03 | 0.00 | 0.05 | 0.07 | 0.04 | 0.06 | 0.09 | 0.14 |
| SEQID-01752 | K7UDH4 | — | 1 | 0.49 | 0.20 | 0.03 | 0.05 | 0.05 | 0.05 | 0.02 | 0.05 | 0.02 | 0.07 | 0.10 | 0.07 |
| SEQID-01753 | P62787 | — | 0 | 0.47 | 0.22 | 0.04 | 0.02 | 0.03 | 0.00 | 0.03 | 0.04 | 0.05 | 0.04 | 0.08 | 0.11 |
| SEQID-01754 | B6SIA2 | — | 1 | 0.33 | 0.13 | 0.08 | 0.03 | 0.04 | 0.06 | 0.02 | 0.06 | 0.02 | 0.04 | 0.01 | 0.09 |
| SEQID-01755 | P01088 | — | 1 | 0.38 | 0.22 | 0.09 | 0.01 | 0.03 | 0.00 | 0.03 | 0.06 | 0.05 | 0.06 | 0.12 | 0.02 |
| SEQID-01756 | B4FK49 | — | 1 | 0.50 | 0.22 | 0.05 | 0.01 | 0.04 | 0.02 | 0.02 | 0.05 | 0.02 | 0.10 | 0.05 | 0.09 |
| SEQID-01757 | B4G1P4 | — | 1 | 0.48 | 0.19 | 0.05 | 0.03 | 0.03 | 0.05 | 0.03 | 0.09 | 0.04 | 0.05 | 0.08 | 0.09 |
| SEQID-01758 | B4F093 | — | 0 | 0.50 | 0.09 | 0.05 | 0.05 | 0.07 | 0.00 | 0.05 | 0.07 | 0.01 | 0.01 | 0.04 | 0.31 |
| SEQID-01759 | O22424 | — | 1 | 0.51 | 0.22 | 0.17 | 0.02 | 0.06 | 0.02 | 0.00 | 0.03 | 0.04 | 0.08 | 0.08 | 0.12 |
| SEQID-01760 | B8QXG4 | — | 1 | 0.50 | 0.18 | 0.04 | 0.05 | 0.03 | 0.00 | 0.03 | 0.04 | 0.03 | 0.08 | 0.08 | 0.10 |
| SEQID-01761 | B6TFX9 | — | 1 | 0.50 | 0.18 | 0.08 | 0.04 | 0.06 | 0.01 | 0.05 | 0.08 | 0.02 | 0.04 | 0.10 | 0.05 |
| SEQID-01762 | B6TDF8 | — | 1 | 0.45 | 0.23 | 0.08 | 0.02 | 0.04 | 0.01 | 0.03 | 0.05 | 0.02 | 0.06 | 0.06 | 0.08 |
| SEQID-01763 | K7VLV6 | — | 1 | 0.46 | 0.21 | 0.08 | 0.04 | 0.05 | 0.01 | 0.01 | 0.03 | 0.02 | 0.03 | 0.12 | 0.16 |
| SEQID-01764 | B6SJ49 | — | 1 | 0.49 | 0.21 | 0.06 | 0.03 | 0.06 | 0.01 | 0.03 | 0.12 | 0.02 | 0.04 | 0.04 | 0.16 |
| SEQID-01765 | P69246 | — | 0 | 0.41 | 0.18 | 0.05 | 0.05 | 0.21 | 0.09 | 0.03 | 0.06 | 0.05 | 0.00 | 0.11 | 0.01 |
| SEQID-01766 | P80639 | — | 0 | 0.45 | 0.18 | 0.09 | 0.01 | 0.17 | 0.00 | 0.07 | 0.06 | 0.03 | 0.05 | 0.09 | 0.12 |
| SEQID-01767 | C0HHC4 | — | 1 | 0.49 | 0.20 | 0.04 | 0.03 | 0.04 | 0.02 | 0.04 | 0.09 | 0.04 | 0.06 | 0.06 | 0.11 |
| SEQID-01768 | B4FFR7 | — | 1 | 0.50 | 0.21 | 0.04 | 0.04 | 0.07 | 0.00 | 0.05 | 0.03 | 0.05 | 0.09 | 0.05 | 0.08 |
| SEQID-01769 | B4G031 | — | 1 | 0.49 | 0.14 | 0.07 | 0.03 | 0.14 | 0.01 | 0.01 | 0.06 | 0.04 | 0.04 | 0.05 | 0.22 |
| SEQID-01770 | B4F9R4 | — | 1 | 0.44 | 0.19 | 0.07 | 0.05 | 0.06 | 0.02 | 0.04 | 0.08 | 0.07 | 0.03 | 0.09 | 0.08 |
| SEQID-01771 | Q41764 | — | 1 | 0.43 | 0.17 | 0.07 | 0.04 | 0.15 | 0.00 | 0.03 | 0.03 | 0.02 | 0.04 | 0.12 | 0.08 |
| SEQID-01772 | Q08062 | — | 1 | 0.47 | 0.24 | 0.08 | 0.04 | 0.03 | 0.01 | 0.03 | 0.04 | 0.05 | 0.05 | 0.04 | 0.07 |
| SEQID-01773 | B6T7G7 | — | 1 | 0.50 | 0.20 | 0.05 | 0.03 | 0.10 | 0.01 | 0.02 | 0.08 | 0.04 | 0.05 | 0.08 | 0.11 |
| SEQID-01774 | P26301 | — | 0 | 0.46 | 0.22 | 0.06 | 0.05 | 0.04 | 0.01 | 0.06 | 0.04 | 0.01 | 0.03 | 0.09 | 0.10 |
| SEQID-01775 | B6TBZ8 | — | 1 | 0.43 | 0.23 | 0.06 | 0.06 | 0.06 | 0.02 | 0.04 | 0.03 | 0.04 | 0.07 | 0.08 | 0.07 |
| SEQID-01776 | B6L051 | — | 1 | 0.43 | 0.21 | 0.04 | 0.05 | 0.05 | 0.02 | 0.05 | 0.09 | 0.04 | 0.07 | 0.10 | 0.03 |
| SEQID-01777 | B6SGX0 | — | 0 | 0.56 | 0.18 | 0.05 | 0.03 | 0.07 | 0.00 | 0.01 | 0.06 | 0.05 | 0.05 | 0.08 | 0.03 |
| SEQID-01778 | Q4W1F6 | — | 1 | 0.56 | 0.21 | 0.05 | 0.05 | 0.16 | 0.01 | 0.03 | 0.10 | 0.04 | 0.03 | 0.09 | 0.21 |
| SEQID-01779 | B6SNY0 | — | 1 | 0.40 | 0.24 | 0.13 | 0.13 | 0.01 | 0.01 | 0.04 | 0.03 | 0.05 | 0.04 | 0.05 | 0.12 |
| SEQID-01780 | Q41764 | — | 1 | 0.44 | 0.18 | 0.10 | 0.07 | 0.13 | 0.02 | 0.06 | 0.06 | 0.01 | 0.02 | 0.12 | 0.02 |
| SEQID-01781 | B6T4H7 | — | 1 | 0.56 | 0.18 | 0.05 | 0.07 | 0.03 | 0.01 | 0.05 | 0.02 | 0.08 | 0.06 | 0.04 | 0.10 |
| SEQID-01782 | P25460 | — | 1 | 0.52 | 0.17 | 0.06 | 0.06 | 0.10 | 0.01 | 0.02 | 0.06 | 0.02 | 0.05 | 0.06 | 0.06 |
| SEQID-01783 | B4FUS2 | — | 1 | 0.51 | 0.20 | 0.02 | 0.04 | 0.05 | 0.03 | 0.03 | 0.04 | 0.04 | 0.06 | 0.06 | 0.17 |
| SEQID-01784 | P06673 | — | 0 | 0.33 | 0.16 | 0.10 | 0.02 | 0.16 | 0.01 | 0.07 | 0.17 | 0.03 | 0.08 | 0.03 | 0.16 |
| SEQID-01785 | B4F9R6 | — | 1 | 0.50 | 0.16 | 0.03 | 0.04 | 0.04 | 0.04 | 0.04 | 0.04 | 0.00 | 0.04 | 0.09 | 0.12 |
| SEQID-01786 | B6T782 | — | 1 | 0.43 | 0.20 | 0.07 | 0.04 | 0.12 | 0.01 | 0.02 | 0.04 | 0.02 | 0.05 | 0.06 | 0.01 |
| SEQID-01787 | B4FB55 | — | 1 | 0.44 | 0.17 | 0.07 | 0.03 | 0.17 | 0.04 | 0.03 | 0.05 | 0.05 | 0.05 | 0.11 | 0.11 |
| SEQID-01788 | P45633 | — | 1 | 0.42 | 0.19 | 0.07 | 0.07 | 0.09 | 0.00 | 0.04 | 0.09 | 0.04 | 0.02 | 0.06 | 0.09 |
| SEQID-01789 | K7UJH1 | — | 1 | 0.45 | 0.24 | 0.16 | 0.16 | 0.16 | 0.01 | 0.01 | 0.06 | 0.03 | 0.04 | 0.07 | 0.11 |
| SEQID-01790 | B6SI09 | — | 1 | 0.51 | 0.21 | 0.04 | 0.04 | 0.08 | 0.03 | 0.05 | 0.05 | 0.06 | 0.04 | 0.06 | 0.07 |
| SEQID-01791 | B4FAV3 | — | 1 | 0.50 | 0.21 | 0.06 | 0.06 | 0.11 | 0.01 | 0.02 | 0.07 | 0.07 | 0.06 | 0.13 | 0.01 |
| SEQID-01792 | P00333 | — | 1 | 0.42 | 0.75 | 0.07 | 0.05 | 0.10 | 0.03 | 0.06 | 0.03 | 0.03 | 0.02 | 0.07 | 0.14 |
| SEQID-01793 | P05494 | — | 0 | 0.44 | 0.24 | 0.0a | 0.09 | 0.05 | 0.01 | 0.05 | 0.04 | 0.04 | 0.06 | 0.06 | 0.08 |
| SEQID-01794 | P19023 | — | 0 | 0.45 | 0.17 | 0.03 | 0.09 | 0.09 | 0.01 | 0.03 | 0.04 | 0.01 | 0.07 | 0.11 | 0.06 |
| SEQID-01795 | A4GUI1 | — | 1 | 0.47 | 0.19 | 0.05 | 0.17 | 0.17 | 0.01 | 0.06 | 0.05 | 0.02 | 0.04 | 0.07 | 0.05 |
| SEQID-01796 | B4FGQ6 | — | 0 | 0.54 | 0.72 | 0.05 | 0.15 | 0.15 | 0.01 | 0.04 | 0.06 | 0.05 | 0.05 | 0.13 | 0.18 |
| SEQID-01797 | B6T2K5 | — | 1 | 0.49 | 0.22 | 0.13 | 0.05 | 0.05 | 0.00 | 0.08 | 0.01 | 0.05 | 0.04 | 0.11 | 0.21 |
| SEQID-01798 | B4FJ41 | | | | | | | | | | | | | | 0.06 |

TABLE 1-continued

| | | | | | | | | | | | | | | | |
|---|---|---|---|---|---|---|---|---|---|---|---|---|---|---|---|
| SEQID-01798 | Q08275 | — | — | 0 | 0.44 | 0.20 | 0.08 | 0.15 | 0.01 | 0.09 | 0.01 | 0.09 | 0.04 | 0.02 | 0.03 | 0.07 | 0.08 |
| SEQID-01799 | B6SK03 | — | — | 1 | 0.46 | 0.17 | 0.02 | 0.15 | 0.01 | 0.06 | 0.01 | 0.08 | 0.05 | 0.03 | 0.05 | 0.07 | 0.06 |
| SEQID-01800 | B6TR92 | — | — | 1 | 0.49 | 0.20 | 0.05 | 0.03 | 0.05 | 0.07 | 0.04 | 0.06 | 0.04 | 0.01 | 0.06 | 0.08 | 0.12 |
| SEQID-01801 | B6SP06 | — | — | 1 | 0.22 | 0.07 | 0.02 | 0.13 | 0.03 | 0.10 | 0.02 | 0.04 | 0.22 | 0.02 | 0.02 | 0.03 | 0.04 |
| SEQID-01802 | B6SJ08 | — | — | 0 | 0.48 | 0.20 | 0.05 | 0.18 | 0.01 | 0.04 | 0.02 | 0.04 | 0.04 | 0.02 | 0.04 | 0.09 | 0.11 |
| SEQID-01803 | B6UHQ3 | — | — | 1 | 0.39 | 0.19 | 0.17 | 0.03 | 0.04 | 0.06 | 0.02 | 0.04 | 0.04 | 0.05 | 0.01 | 0.13 | 0.02 |
| SEQID-01804 | B4F8D6 | — | — | 1 | 0.38 | 0.17 | 0.07 | 0.12 | 0.04 | 0.08 | 0.07 | 0.05 | 0.05 | 0.02 | 0.02 | 0.10 | 0.04 |
| SEQID-01805 | B4FHH2 | — | — | 1 | 0.43 | 0.24 | 0.05 | 0.07 | 0.03 | 0.04 | 0.05 | 0.03 | 0.04 | 0.03 | 0.06 | 0.10 | 0.08 |
| SEQID-01806 | C0PM74 | — | — | 1 | 0.47 | 0.22 | 0.06 | 0.10 | 0.02 | 0.08 | 0.04 | 0.04 | 0.06 | 0.02 | 0.06 | 0.10 | 0.11 |
| SEQID-01807 | B4F7Y1 | — | — | 1 | 0.54 | 0.22 | 0.06 | 0.10 | 0.04 | 0.05 | 0.04 | 0.06 | 0.06 | 0.03 | 0.08 | 0.09 | 0.18 |
| SEQID-01808 | Q84RL7 | — | — | 1 | 0.49 | 0.26 | 0.10 | 0.10 | 0.02 | 0.05 | 0.02 | 0.02 | 0.07 | 0.02 | 0.08 | 0.09 | 0.04 |
| SEQID-01809 | C0PCQ6 | — | — | 1 | 0.49 | 0.20 | 0.04 | 0.13 | 0.02 | 0.05 | 0.02 | 0.05 | 0.03 | 0.02 | 0.05 | 0.06 | 0.10 |
| SEQID-01810 | B4FBF6 | — | — | 1 | 0.47 | 0.20 | 0.09 | 0.06 | 0.03 | 0.03 | 0.04 | 0.08 | 0.05 | 0.01 | 0.05 | 0.08 | 0.08 |
| SEQID-01811 | B6THG9 | — | — | 0 | 0.42 | 0.16 | 0.06 | 0.11 | 0.04 | 0.08 | 0.02 | 0.03 | 0.04 | 0.03 | 0.05 | 0.08 | 0.11 |
| SEQID-01812 | O24573 | — | — | 0 | 0.48 | 0.25 | 0.06 | 0.04 | 0.03 | 0.05 | 0.02 | 0.07 | 0.05 | 0.01 | 0.06 | 0.10 | 0.11 |
| SEQID-01813 | B4FRC6 | — | — | 1 | 0.45 | 0.23 | 0.10 | 0.03 | 0.05 | 0.03 | 0.02 | 0.05 | 0.04 | 0.01 | 0.06 | 0.12 | 0.11 |
| SEQID-01814 | P04709 | — | — | 1 | 0.46 | 0.19 | 0.06 | 0.08 | 0.05 | 0.05 | 0.04 | 0.04 | 0.06 | 0.01 | 0.02 | 0.09 | 0.04 |
| SEQID-01815 | Q41745 | — | — | 1 | 0.57 | 0.26 | 0.06 | 0.09 | 0.01 | 0.04 | 0.03 | 0.03 | 0.06 | 0.01 | 0.06 | 0.09 | 0.08 |
| SEQID-01816 | B4FTU3 | — | — | 1 | 0.53 | 0.29 | 0.08 | 0.06 | 0.04 | 0.01 | 0.04 | 0.03 | 0.04 | 0.02 | 0.06 | 0.12 | 0.07 |
| SEQID-01817 | C0PMH6 | — | — | 1 | 0.53 | 0.25 | 0.07 | 0.05 | 0.03 | 0.04 | 0.01 | 0.04 | 0.03 | 0.02 | 0.06 | 0.14 | 0.06 |
| SEQID-01818 | B4F987 | — | — | 1 | 0.43 | 0.19 | 0.07 | 0.10 | 0.01 | 0.02 | 0.03 | 0.03 | 0.05 | 0.03 | 0.07 | 0.10 | 0.06 |
| SEQID-01819 | B4FUE0 | — | — | 1 | 0.51 | 0.21 | 0.05 | 0.06 | 0.03 | 0.07 | 0.02 | 0.06 | 0.05 | 0.00 | 0.04 | 0.07 | 0.03 |
| SEQID-01820 | B4FQ44 | — | — | 1 | 0.44 | 0.19 | 0.06 | 0.09 | 0.05 | 0.05 | 0.02 | 0.10 | 0.03 | 0.03 | 0.08 | 0.07 | 0.12 |
| SEQID-01821 | B4FAD9 | — | — | 1 | 0.51 | 0.27 | 0.13 | 0.11 | 0.06 | 0.07 | 0.00 | 0.05 | 0.05 | 0.04 | 0.06 | 0.07 | 0.04 |
| SEQID-01822 | B8A1R6 | — | — | 1 | 0.53 | 0.29 | 0.08 | 0.22 | 0.05 | 0.06 | 0.02 | 0.07 | 0.07 | 0.06 | 0.08 | 0.11 | 0.10 |
| SEQID-01823 | D3YKV1 | — | — | 1 | 0.44 | 0.22 | 0.09 | 0.09 | 0.04 | 0.03 | 0.03 | 0.03 | 0.04 | 0.01 | 0.08 | 0.13 | 0.04 |
| SEQID-01824 | C0PHH5 | — | — | 1 | 0.48 | 0.25 | 0.07 | 0.17 | 0.02 | 0.05 | 0.03 | 0.05 | 0.05 | 0.02 | 0.09 | 0.08 | 0.08 |
| SEQID-01825 | B6UDM4 | — | — | 1 | 0.54 | 0.23 | 0.08 | 0.13 | 0.03 | 0.07 | 0.06 | 0.07 | 0.04 | 0.02 | 0.09 | 0.09 | 0.07 |
| SEQID-01826 | B6SPL7 | — | — | 0 | 0.53 | 0.21 | 0.06 | 0.18 | 0.05 | 0.05 | 0.06 | 0.05 | 0.03 | 0.05 | 0.08 | 0.14 | 0.07 |
| SEQID-01627 | B4FC92 | — | — | 0 | 0.46 | 0.17 | 0.07 | 0.10 | 0.04 | 0.01 | 0.01 | 0.03 | 0.10 | 0.03 | 0.03 | 0.10 | 0.09 |
| SEQID-01828 | B4FIA6 | — | — | 0 | 0.42 | 0.23 | 0.06 | 0.08 | 0.01 | 0.04 | 0.03 | 0.09 | 0.06 | 0.00 | 0.01 | 0.15 | 0.12 |
| SEQID-01829 | B4FEE7 | — | — | 0 | 0.33 | 0.13 | 0.13 | 0.05 | 0.03 | 0.03 | 0.01 | 0.04 | 0.07 | 0.04 | 0.03 | 0.04 | 0.04 |
| SEQID-01830 | B6SHT0 | — | — | 1 | 0.46 | 0.22 | 0.08 | 0.11 | 0.04 | 0.04 | 0.02 | 0.02 | 0.03 | 0.06 | 0.04 | 0.08 | 0.10 |
| SEQID-01831 | P19950 | — | — | 1 | 0.44 | 0.18 | 0.09 | 0.22 | 0.05 | 0.04 | 0.00 | 0.06 | 0.04 | 0.06 | 0.04 | 0.11 | 0.08 |
| SEQID-01832 | B4FD90 | — | — | 1 | 0.41 | 0.20 | 0.06 | 0.17 | 0.04 | 0.03 | 0.02 | 0.05 | 0.07 | 0.05 | 0.05 | 0.02 | 0.08 |
| SEQID-01833 | B4FH43 | — | — | 1 | 0.43 | 0.21 | 0.11 | 0.13 | 0.02 | 0.05 | 0.01 | 0.07 | 0.07 | 0.05 | 0.08 | 0.07 | 0.08 |
| SEQID-01834 | B6SNQ7 | — | — | 0 | 0.43 | 0.21 | 0.06 | 0.09 | 0.03 | 0.01 | 0.04 | 0.06 | 0.06 | 0.03 | 0.08 | 0.06 | 0.05 |
| SEQID-01835 | B4G250 | — | — | 1 | 0.46 | 0.20 | 0.06 | 0.18 | 0.04 | 0.05 | 0.01 | 0.05 | 0.05 | 0.06 | 0.03 | 0.06 | 0.11 |
| SEQID-01836 | B6UD91 | — | — | 1 | 0.38 | 0.16 | 0.04 | 0.10 | 0.03 | 0.04 | 0.04 | 0.06 | 0.13 | 0.00 | 0.06 | 0.06 | 0.09 |
| SEQID-01837 | B6U23 | — | — | 1 | 0.47 | 0.20 | 0.16 | 0.08 | 0.03 | 0.04 | 0.02 | 0.05 | 0.07 | 0.02 | 0.04 | 0.11 | 0.05 |
| SEQID-01838 | B6T1F2 | — | — | 1 | 0.34 | 0.17 | 0.18 | 0.12 | 0.06 | 0.02 | 0.01 | 0.04 | 0.05 | 0.01 | 0.03 | 0.08 | 0.04 |
| SEQID-01839 | P49076 | — | — | 1 | 0.50 | 0.22 | 0.03 | 0.13 | 0.03 | 0.01 | 0.03 | 0.03 | 0.04 | 0.03 | 0.06 | 0.07 | 0.11 |
| SEQID-01840 | P12653 | — | — | 1 | 0.52 | 0.24 | 0.04 | 0.08 | 0.06 | 0.09 | 0.04 | 0.04 | 0.07 | 0.05 | 0.06 | 0.12 | 0.07 |
| SEQID-01841 | B4F9G6 | — | — | 1 | 0.48 | 0.23 | 0.08 | 0.05 | 0.04 | 0.04 | 0.03 | 0.03 | 0.09 | 0.02 | 0.03 | 0.13 | 0.08 |
| SEQID-01842 | B4FAM6 | — | — | 1 | 0.52 | 0.20 | 0.06 | 0.09 | 0.01 | 0.06 | 0.02 | 0.05 | 0.05 | 0.02 | 0.05 | 0.08 | 0.16 |
| SEQID-01843 | B4FE06 | — | — | 1 | 0.51 | 0.23 | 0.05 | 0.13 | 0.03 | 0.06 | 0.02 | 0.05 | 0.03 | 0.04 | 0.06 | 0.11 | 0.15 |
| SEQID-01844 | B6TB84 | — | — | 1 | 0.45 | 0.21 | 0.06 | 0.10 | 0.03 | 0.08 | 0.02 | 0.08 | 0.03 | 0.02 | 0.05 | 0.07 | 0.07 |
| SEQID-01845 | A2SZW8 | — | — | 1 | 0.42 | 0.21 | 0.06 | 0.08 | 0.03 | 0.06 | 0.01 | 0.09 | 0.02 | 0.03 | 0.06 | 0.08 | 0.08 |
| SEQID-01846 | P41980 | — | — | 1 | 0.47 | 0.18 | 0.07 | 0.07 | 0.02 | 0.07 | 0.01 | 0.06 | 0.04 | 0.03 | 0.04 | 0.07 | 0.09 |
| SEQID-01847 | C4J9Y2 | — | — | 1 | 0.46 | 0.21 | 0.09 | 0.04 | 0.06 | 0.09 | 0.03 | 0.06 | 0.05 | 0.04 | 0.03 | 0.11 | 0.11 |
| SEQID-01848 | B4F848 | — | — | 0 | 0.49 | 0.23 | 0.08 | 0.05 | 0.03 | 0.08 | 0.01 | 0.04 | 0.05 | 0.04 | 0.06 | 0.13 | 0.07 |
| SEQID-01849 | B6TKC5 | — | — | 1 | 0.47 | 0.21 | 0.07 | 0.06 | 0.01 | 0.07 | 0.02 | 0.02 | 0.05 | 0.04 | 0.03 | 0.07 | 0.10 |
| SEQID-01850 | P29023 | — | — | 1 | 0.34 | 0.13 | 0.03 | 0.03 | 0.06 | 0.03 | 0.06 | 0.07 | 0.03 | 0.02 | 0.02 | 0.09 | 0.05 | 0.04 |

TABLE 1-continued

| SEQID | ID | | | | | | | | | | | | | | | |
|---|---|---|---|---|---|---|---|---|---|---|---|---|---|---|---|---|
| SEQID-01851 | B4F8K1 | — | 1 | 0.47 | 0.22 | 0.04 | 0.04 | 0.07 | 0.01 | 0.00 | 0.04 | 0.11 | 0.03 | 0.02 | 0.07 | 0.10 | 0.13 |
| SEQID-01852 | B4FXR6 | — | 1 | 0.26 | 0.08 | 0.05 | 0.05 | 0.00 | 0.06 | 0.05 | 0.02 | 0.05 | 0.19 | 0.04 | 0.02 | 0.02 | 0.03 |
| SEQID-01853 | Q41814 | — | 0 | 0.40 | 0.03 | 0.03 | 0.03 | 0.02 | 0.01 | 0.00 | 0.00 | 0.02 | 0.02 | 0.02 | 0.00 | 0.02 | 0.15 |
| SEQID-01854 | B4F9T3 | — | 1 | 0.41 | 0.22 | 0.09 | 0.09 | 0.05 | 0.06 | 0.02 | 0.03 | 0.09 | 0.05 | 0.02 | 0.07 | 0.07 | 0.06 |
| SEQID-01855 | Q6XZ78 | — | 1 | 0.48 | 0.22 | 0.09 | 0.06 | 0.02 | 0.08 | 0.02 | 0.01 | 0.06 | 0.05 | 0.02 | 0.04 | 0.11 | 0.08 |
| SEQID-01856 | B4FRJ1 | — | 0 | 0.48 | 0.25 | 0.07 | 0.05 | 0.05 | 0.06 | 0.02 | 0.03 | 0.07 | 0.06 | 0.01 | 0.05 | 0.11 | 0.09 |
| SEQID-01857 | P93629 | — | 1 | 0.51 | 0.23 | 0.07 | 0.03 | 0.04 | 0.06 | 0.04 | 0.01 | 0.04 | 0.07 | 0.06 | 0.06 | 0.06 | 0.08 |
| SEQID-01858 | B4FRI1 | — | 1 | 0.43 | 0.19 | 0.05 | 0.04 | 0.03 | 0.09 | 0.06 | 0.04 | 0.04 | 0.06 | 0.03 | 0.04 | 0.08 | 0.07 |
| SEQID-01859 | B6TGG7 | — | 1 | 0.44 | 0.21 | 0.11 | 0.07 | 0.05 | 0.06 | 0.02 | 0.03 | 0.03 | 0.05 | 0.03 | 0.08 | 0.06 | 0.06 |
| SEQID-01860 | P30792 | — | 1 | 0.46 | 0.23 | 0.07 | 0.08 | 0.05 | 0.06 | 0.02 | 0.02 | 0.05 | 0.06 | 0.03 | 0.08 | 0.09 | 0.07 |
| SEQID-01861 | B6TZ53 | — | 1 | 0.51 | 0.25 | 0.06 | 0.06 | 0.05 | 0.09 | 0.01 | 0.03 | 0.04 | 0.05 | 0.03 | 0.08 | 0.11 | 0.04 |
| SEQID-01862 | B6SH97 | — | 1 | 0.44 | 0.22 | 0.03 | 0.07 | 0.03 | 0.07 | 0.01 | 0.03 | 0.03 | 0.04 | 0.03 | 0.07 | 0.09 | 0.06 |
| SEQID-01863 | B7ZZ42 | — | 1 | 0.45 | 0.21 | 0.06 | 0.10 | 0.05 | 0.06 | 0.01 | 0.04 | 0.07 | 0.07 | 0.04 | 0.07 | 0.07 | 0.09 |
| SEQID-01864 | K7UD35 | — | 1 | 0.47 | 0.21 | 0.06 | 0.11 | 0.03 | 0.08 | 0.01 | 0.04 | 0.04 | 0.10 | 0.04 | 0.07 | 0.10 | 0.05 |
| SEQID-01865 | Q9TV61 | — | 1 | 0.45 | 0.19 | 0.05 | 0.05 | 0.04 | 0.04 | 0.01 | 0.08 | 0.02 | 0.15 | 0.02 | 0.05 | 0.10 | 0.12 |
| SEQID-01866 | F1SS64 | — | 1 | 0.45 | 0.19 | 0.05 | 0.07 | 0.04 | 0.05 | 0.01 | 0.08 | 0.03 | 0.15 | 0.02 | 0.05 | 0.10 | 0.12 |
| SEQID-01867 | Q9TV62 | — | 1 | 0.45 | 0.13 | 0.05 | 0.07 | 0.04 | 0.05 | 0.02 | 0.07 | 0.03 | 0.15 | 0.02 | 0.05 | 0.10 | 0.12 |
| SEQID-01868 | P79293 | — | 1 | 0.44 | 0.19 | 0.05 | 0.08 | 0.05 | 0.06 | 0.01 | 0.03 | 0.03 | 0.12 | 0.02 | 0.04 | 0.11 | 0.09 |
| SEQID-01869 | P68137 | — | 1 | 0.47 | 0.20 | 0.05 | 0.05 | 0.03 | 0.06 | 0.01 | 0.03 | 0.03 | 0.09 | 0.04 | 0.08 | 0.07 | 0.06 |
| SEQID-01870 | I3L8Q0 | — | 1 | 0.45 | 0.19 | 0.06 | 0.07 | 0.02 | 0.06 | 0.03 | 0.03 | 0.04 | 0.12 | 0.03 | 0.08 | 0.05 | 0.09 |
| SEQID-01871 | F1RQQ8 | — | 1 | 0.45 | 0.21 | 0.05 | 0.10 | 0.06 | 0.06 | 0.01 | 0.04 | 0.04 | 0.09 | 0.03 | 0.06 | 0.09 | 0.06 |
| SEQID-01872 | F1RHL9 | — | 1 | 0.44 | 0.20 | 0.05 | 0.09 | 0.05 | 0.06 | 0.01 | 0.07 | 0.03 | 0.11 | 0.02 | 0.07 | 0.09 | 0.07 |
| SEQID-01873 | Q5XLD3 | — | 1 | 0.50 | 0.20 | 0.02 | 0.07 | 0.05 | 0.07 | 0.01 | 0.03 | 0.04 | 0.08 | 0.04 | 0.03 | 0.10 | 0.10 |
| SEQID-01874 | F1RUN2 | — | 1 | 0.46 | 0.19 | 0.05 | 0.07 | 0.02 | 0.05 | 0.01 | 0.04 | 0.04 | 0.11 | 0.04 | 0.04 | 0.10 | 0.11 |
| SEQID-01875 | Q1KYT0 | — | 1 | 0.48 | 0.23 | 0.06 | 0.06 | 0.05 | 0.05 | 0.05 | 0.03 | 0.03 | 0.08 | 0.02 | 0.06 | 0.11 | 0.10 |
| SEQID-01876 | F1RFH9 | — | 1 | 0.49 | 0.25 | 0.06 | 0.07 | 0.04 | 0.05 | 0.02 | 0.04 | 0.04 | 0.09 | 0.02 | 0.06 | 0.09 | 0.06 |
| SEQID-01877 | F15HL9 | — | 1 | 0.48 | 0.23 | 0.08 | 0.08 | 0.05 | 0.05 | 0.02 | 0.03 | 0.03 | 0.09 | 0.03 | 0.07 | 0.10 | 0.09 |
| SEQID-01878 | F1RU49 | — | 1 | 0.43 | 0.20 | 0.06 | 0.10 | 0.06 | 0.06 | 0.03 | 0.03 | 0.05 | 0.11 | 0.03 | 0.05 | 0.08 | 0.06 |
| SEQID-01879 | P00355 | — | 1 | 0.52 | 0.22 | 0.06 | 0.04 | 0.04 | 0.05 | 0.01 | 0.02 | 0.03 | 0.04 | 0.04 | 0.07 | 0.06 | 0.09 |
| SEQID-01880 | P11607 | — | 1 | 0.50 | 0.25 | 0.05 | 0.06 | 0.04 | 0.05 | 0.03 | 0.03 | 0.05 | 0.09 | 0.01 | 0.07 | 0.09 | 0.07 |
| SEQID-01881 | F1SR18 | — | 1 | 0.46 | 0.20 | 0.04 | 0.06 | 0.04 | 0.06 | 0.02 | 0.03 | 0.03 | 0.09 | 0.02 | 0.07 | 0.06 | 0.11 |
| SEQID-01882 | F1SFA7 | — | 1 | 0.25 | 0.12 | 0.07 | 0.09 | 0.07 | 0.04 | 0.01 | 0.01 | 0.02 | 0.06 | 0.17 | 0.03 | 0.05 | 0.05 |
| SEQID-01883 | F1SHW9 | — | 1 | 0.47 | 0.15 | 0.05 | 0.03 | 0.04 | 0.06 | 0.05 | 0.02 | 0.05 | 0.06 | 0.01 | 0.05 | 0.07 | 0.16 |
| SEQID-01884 | Q9GIV4 | — | 1 | 0.47 | 0.11 | 0.04 | 0.04 | 0.04 | 0.05 | 0.10 | 0.01 | 0.04 | 0.05 | 0.06 | 0.02 | 0.03 | 0.14 |
| SEQID-01885 | A1XQT6 | — | 0 | 0.44 | 0.18 | 0.08 | 0.03 | 0.08 | 0.05 | 0.01 | 0.02 | 0.03 | 0.14 | 0.01 | 0.06 | 0.08 | 0.12 |
| SEQID-01886 | D0G7F6 | — | 1 | 0.49 | 0.23 | 0.08 | 0.05 | 0.08 | 0.05 | 0.01 | 0.04 | 0.03 | 0.09 | 0.03 | 0.06 | 0.07 | 0.10 |
| SEQID-01887 | P1S960 | — | 1 | 0.44 | 0.21 | 0.06 | 0.08 | 0.05 | 0.05 | 0.02 | 0.04 | 0.04 | 0.11 | 0.05 | 0.06 | 0.07 | 0.10 |
| SEQID-01888 | F1RZQ6 | — | 1 | 0.50 | 0.21 | 0.07 | 0.03 | 0.03 | 0.05 | 0.01 | 0.05 | 0.05 | 0.02 | 0.01 | 0.04 | 0.11 | 0.05 |
| SEQID-01889 | Q5XLD2 | — | 1 | 0.49 | 0.16 | 0.06 | 0.05 | 0.03 | 0.06 | 0.02 | 0.04 | 0.04 | 0.10 | 0.01 | 0.06 | 0.09 | 0.09 |
| SEQID-01890 | Q75IB7 | — | 1 | 0.52 | 0.23 | 0.06 | 0.04 | 0.05 | 0.05 | 0.01 | 0.03 | 0.02 | 0.08 | 0.01 | 0.05 | 0.05 | 0.11 |
| SEQID-01891 | F1RVL5 | — | 1 | 0.46 | 0.20 | 0.04 | 0.05 | 0.04 | 0.06 | 0.02 | 0.02 | 0.05 | 0.10 | 0.05 | 0.05 | 0.09 | 0.12 |
| SEQID-01892 | P00339 | — | 1 | 0.54 | 0.28 | 0.04 | 0.03 | 0.02 | 0.05 | 0.03 | 0.03 | 0.04 | 0.07 | 0.03 | 0.05 | 0.07 | 0.09 |
| SEQID-01893 | F1RH20 | — | 1 | 0.46 | 0.20 | 0.04 | 0.07 | 0.04 | 0.06 | 0.01 | 0.04 | 0.04 | 0.11 | 0.04 | 0.07 | 0.11 | 0.09 |
| SEQID-01894 | Q55154 | — | 1 | 0.49 | 0.18 | 0.04 | 0.06 | 0.04 | 0.07 | 0.02 | 0.03 | 0.03 | 0.06 | 0.02 | 0.05 | 0.07 | 0.10 |
| SEQID-01895 | B5KJG2 | — | 1 | 0.47 | 0.18 | 0.06 | 0.06 | 0.04 | 0.07 | 0.01 | 0.02 | 0.02 | 0.10 | 0.06 | 0.04 | 0.09 | 0.09 |
| SEQID-01896 | F1SHX0 | — | 1 | 0.47 | 0.17 | 0.04 | 0.10 | 0.04 | 0.05 | 0.01 | 0.03 | 0.03 | 0.07 | 0.04 | 0.06 | 0.09 | 0.09 |
| SEQID-01897 | P02540 | — | 1 | 0.37 | 0.19 | 0.06 | 0.07 | 0.04 | 0.07 | 0.00 | 0.05 | 0.05 | 0.14 | 0.05 | 0.05 | 0.07 | 0.13 |
| SEQID-01898 | F1SE14 | — | 1 | 0.43 | 0.22 | 0.06 | 0.13 | 0.04 | 0.05 | 0.01 | 0.08 | 0.04 | 0.06 | 0.02 | 0.04 | 0.10 | 0.05 |
| SEQID-01899 | Q2HYU2 | — | 1 | 0.48 | 0.22 | 0.05 | 0.07 | 0.04 | 0.06 | 0.01 | 0.04 | 0.04 | 0.06 | 0.05 | 0.09 | 0.03 | 0.08 |
| SEQID-01900 | F1SM75 | — | 1 | 0.44 | 0.18 | 0.05 | 0.09 | 0.05 | 0.05 | 0.02 | 0.04 | 0.05 | 0.07 | 0.03 | 0.05 | 0.09 | 0.06 |
| SEQID-01901 | Q4P585 | — | 1 | 0.43 | 0.16 | 0.03 | 0.07 | 0.03 | 0.05 | 0.01 | 0.02 | 0.03 | 0.10 | 0.05 | 0.05 | 0.07 | 0.09 |
| SEQID-01902 | Q75NG9 | — | 1 | 0.38 | 0.14 | 0.05 | 0.12 | 0.04 | 0.06 | 0.00 | 0.06 | 0.06 | 0.21 | 0.01 | 0.03 | 0.09 | 0.08 |
| SEQID-01903 | F1SQT3 | — | 1 | 0.46 | 0.21 | 0.07 | 0.07 | 0.02 | 0.03 | 0.02 | 0.04 | 0.04 | 0.06 | 0.04 | 0.04 | 0.10 | 0.07 |

TABLE 1-continued

| SEQID | ID | | | | | | | | | | | | | | |
|---|---|---|---|---|---|---|---|---|---|---|---|---|---|---|---|
| SEQID-01904 | P33198 | — | 1 | 0.50 | 0.19 | 0.05 | 0.07 | 0.04 | 0.07 | 0.02 | 0.05 | 0.05 | 0.04 | 0.07 | 0.07 | 0.09 |
| SEQID-01905 | F1SMN5 | — | 1 | 0.44 | 0.20 | 0.05 | 0.06 | 0.03 | 0.06 | 0.02 | 0.09 | 0.03 | 0.06 | 0.05 | 0.05 | 0.07 |
| SEQID-01906 | Q2HYU1 | — | 1 | 0.44 | 0.21 | 0.04 | 0.12 | 0.04 | 0.07 | 0.02 | 0.07 | 0.04 | 0.05 | 0.05 | 0.10 | 0.06 |
| SEQID-01907 | P08059 | — | 1 | 0.52 | 0.20 | 0.04 | 0.06 | 0.05 | 0.05 | 0.00 | 0.07 | 0.05 | 0.01 | 0.06 | 0.10 | 0.08 |
| SEQID-01908 | F1SG00 | — | 0 | 0.38 | 0.17 | 0.07 | 0.08 | 0.02 | 0.07 | 0.00 | 0.25 | 0.07 | 0.01 | 0.03 | 0.11 | 0.13 |
| SEQID-01909 | F1RPS8 | — | 0 | 0.45 | 0.25 | 0.07 | 0.09 | 0.03 | 0.06 | 0.00 | 0.07 | 0.05 | 0.05 | 0.08 | 0.10 | 0.07 |
| SEQID-01910 | P16276 | — | 1 | 0.47 | 0.22 | 0.05 | 0.07 | 0.05 | 0.06 | 0.02 | 0.06 | 0.04 | 0.05 | 0.06 | 0.09 | 0.09 |
| SEQID-01911 | I3L953 | — | 1 | 0.44 | 0.22 | 0.06 | 0.07 | 0.03 | 0.06 | 0.02 | 0.10 | 0.06 | 0.05 | 0.03 | 0.09 | 0.05 |
| SEQID-01912 | P01965 | — | 0 | 0.55 | 0.22 | 0.09 | 0.10 | 0.01 | 0.05 | 0.01 | 0.02 | 0.03 | 0.10 | 0.00 | 0.14 | 0.09 |
| SEQID-01913 | P02067 | — | 1 | 0.54 | 0.26 | 0.06 | 0.03 | 0.04 | 0.09 | 0.00 | 0.06 | 0.04 | 0.07 | 0.01 | 0.13 | 0.09 |
| SEQID-01914 | Q7M2W6 | — | 1 | 0.48 | 0.18 | 0.03 | 0.05 | 0.06 | 0.06 | 0.00 | 0.09 | 0.02 | 0.06 | 0.06 | 0.08 | 0.06 |
| SEQID-01915 | F1RT61 | — | 0 | 0.18 | 0.06 | 0.09 | 0.12 | 0.01 | 0.03 | 0.01 | 0.09 | 0.04 | 0.02 | 0.06 | 0.03 | 0.05 |
| SEQID-01916 | I3LB76 | — | 1 | 0.46 | 0.19 | 0.05 | 0.09 | 0.03 | 0.05 | 0.01 | 0.06 | 0.04 | 0.21 | 0.01 | 0.12 | 0.14 |
| SEQID-01917 | F1RM62 | — | 0 | 0.38 | 0.22 | 0.10 | 0.14 | 0.02 | 0.03 | 0.00 | 0.13 | 0.03 | 0.03 | 0.02 | 0.11 | 0.02 |
| SEQID-01918 | F6PSL2 | — | 1 | 0.49 | 0.16 | 0.05 | 0.10 | 0.00 | 0.08 | 0.01 | 0.10 | 0.04 | 0.06 | 0.03 | 0.15 | 0.07 |
| SEQID-01919 | P00346 | — | 1 | 0.49 | 0.25 | 0.05 | 0.05 | 0.06 | 0.03 | 0.00 | 0.12 | 0.04 | 0.03 | 0.06 | 0.10 | 0.11 |
| SEQID-01920 | P11708 | — | 1 | 0.51 | 0.25 | 0.07 | 0.05 | 0.04 | 0.08 | 0.00 | 0.06 | 0.04 | 0.03 | 0.05 | 0.05 | 0.09 |
| SEQID-01921 | F1RJ25 | — | 1 | 0.41 | 0.22 | 0.06 | 0.04 | 0.04 | 0.08 | 0.02 | 0.06 | 0.03 | 0.03 | 0.07 | 0.10 | 0.11 |
| SEQID-01922 | F1SLA0 | — | 0 | 0.45 | 0.25 | 0.08 | 0.03 | 0.04 | 0.05 | 0.02 | 0.09 | 0.05 | 0.02 | 0.06 | 0.09 | 0.07 |
| SEQID-01923 | F1RK48 | — | 1 | 0.35 | 0.25 | 0.08 | 0.07 | 0.02 | 0.06 | 0.00 | 0.08 | 0.06 | 0.05 | 0.07 | 0.10 | 0.05 |
| SEQID-01924 | F1SU23 | — | 1 | 0.39 | 0.16 | 0.06 | 0.07 | 0.03 | 0.05 | 0.01 | 0.15 | 0.05 | 0.06 | 0.04 | 0.09 | 0.05 |
| SEQID-01925 | I3LIX2 | — | 1 | 0.23 | 0.09 | 0.05 | 0.11 | 0.03 | 0.09 | 0.01 | 0.05 | 0.03 | 0.03 | 0.01 | 0.11 | 0.06 |
| SEQID-01926 | F1SHA2 | — | 0 | 0.49 | 0.24 | 0.10 | 0.07 | 0.02 | 0.05 | 0.01 | 0.07 | 0.06 | 0.17 | 0.01 | 0.04 | 0.06 |
| SEQID-01927 | F1STM4 | — | 0 | 0.52 | 0.21 | 0.05 | 0.04 | 0.04 | 0.04 | 0.04 | 0.10 | 0.03 | 0.05 | 0.07 | 0.10 | 0.07 |
| SEQID-01928 | F1RIS3 | — | 1 | 0.41 | 0.22 | 0.06 | 0.06 | 0.04 | 0.05 | 0.01 | 0.07 | 0.03 | 0.04 | 0.03 | 0.06 | 0.11 |
| SEQID-01929 | I3LP30 | — | 1 | 0.49 | 0.22 | 0.07 | 0.11 | 0.00 | 0.04 | 0.03 | 0.10 | 0.09 | 0.04 | 0.02 | 0.14 | 0.05 |
| SEQID-01930 | F1S557 | — | 1 | 0.45 | 0.21 | 0.03 | 0.06 | 0.05 | 0.04 | 0.01 | 0.15 | 0.03 | 0.01 | 0.05 | 0.13 | 0.13 |
| SEQID-01931 | B5DGM7 | — | 1 | 0.47 | 0.19 | 0.04 | 0.08 | 0.04 | 0.05 | 0.02 | 0.08 | 0.05 | 0.04 | 0.06 | 0.10 | 0.06 |
| SEQID-01932 | B5DGR2 | — | 1 | 0.53 | 0.22 | 0.07 | 0.06 | 0.05 | 0.07 | 0.02 | 0.07 | 0.05 | 0.04 | 0.05 | 0.09 | 0.09 |
| SEQID-01933 | B5DGM8 | — | 1 | 0.47 | 0.19 | 0.07 | 0.05 | 0.04 | 0.05 | 0.01 | 0.05 | 0.03 | 0.04 | 0.07 | 0.05 | 0.09 |
| SEQID-01934 | B5DGQ6 | — | 1 | 0.48 | 0.22 | 0.07 | 0.06 | 0.05 | 0.08 | 0.02 | 0.06 | 0.03 | 0.04 | 0.05 | 0.09 | 0.08 |
| SEQID-01935 | B5DGQ7 | — | 1 | 0.48 | 0.21 | 0.05 | 0.05 | 0.05 | 0.08 | 0.01 | 0.07 | 0.03 | 0.03 | 0.07 | 0.08 | 0.11 |
| SEQID-01936 | B5DG40 | — | 1 | 0.46 | 0.20 | 0.05 | 0.07 | 0.03 | 0.06 | 0.02 | 0.07 | 0.04 | 0.03 | 0.07 | 0.08 | 0.11 |
| SEQID-01937 | B5DGP0 | — | 1 | 0.50 | 0.20 | 0.02 | 0.07 | 0.05 | 0.09 | 0.00 | 0.08 | 0.04 | 0.05 | 0.09 | 0.09 | 0.06 |
| SEQID-01938 | B5DGL3 | — | 1 | 0.51 | 0.23 | 0.07 | 0.04 | 0.05 | 0.08 | 0.01 | 0.08 | 0.02 | 0.05 | 0.04 | 0.05 | 0.10 |
| SEQID-01939 | B5DGG5 | — | 1 | 0.50 | 0.19 | 0.03 | 0.07 | 0.04 | 0.08 | 0.02 | 0.08 | 0.03 | 0.05 | 0.07 | 0.07 | 0.11 |
| SEQID-01940 | Q91472 | — | 0 | 0.41 | 0.18 | 0.07 | 0.06 | 0.04 | 0.08 | 0.01 | 0.07 | 0.03 | 0.05 | 0.04 | 0.09 | 0.10 |
| SEQID-01941 | B5DGU1 | — | 1 | 0.49 | 0.21 | 0.06 | 0.09 | 0.03 | 0.06 | 0.00 | 0.22 | 0.01 | 0.00 | 0.04 | 0.11 | 0.15 |
| SEQID-01942 | B5DH12 | — | 1 | 0.43 | 0.18 | 0.08 | 0.04 | 0.03 | 0.06 | 0.02 | 0.08 | 0.04 | 0.04 | 0.08 | 0.07 | 0.09 |
| SEQID-01943 | B5DG55 | — | 0 | 0.48 | 0.21 | 0.06 | 0.08 | 0.03 | 0.08 | 0.00 | 0.11 | 0.04 | 0.01 | 0.07 | 0.07 | 0.10 |
| SEQID-01944 | B5DFX8 | — | 1 | 0.53 | 0.19 | 0.05 | 0.03 | 0.05 | 0.06 | 0.01 | 0.09 | 0.02 | 0.03 | 0.06 | 0.09 | 0.10 |
| SEQID-01945 | B5DGT1 | — | 0 | 0.43 | 0.18 | 0.08 | 0.04 | 0.04 | 0.07 | 0.02 | 0.09 | 0.04 | 0.04 | 0.06 | 0.08 | 0.09 |
| SEQID-01946 | Q7ZZN0 | — | 1 | 0.46 | 0.18 | 0.06 | 0.04 | 0.03 | 0.06 | 0.01 | 0.09 | 0.04 | 0.05 | 0.04 | 0.08 | 0.12 |
| SEQID-01947 | B5DGT9 | — | 1 | 0.52 | 0.21 | 0.06 | 0.07 | 0.04 | 0.06 | 0.00 | 0.14 | 0.04 | 0.04 | 0.07 | 0.09 | 0.10 |
| SEQID-01948 | O13093 | — | 1 | 0.54 | 0.18 | 0.05 | 0.06 | 0.03 | 0.07 | 0.02 | 0.09 | 0.02 | 0.02 | 0.04 | 0.07 | 0.10 |
| SEQID-01949 | B5DGM5 | — | 1 | 0.49 | 0.23 | 0.05 | 0.07 | 0.01 | 0.09 | 0.00 | 0.14 | 0.05 | 0.05 | 0.07 | 0.09 | 0.20 |
| SEQID-01950 | B5DG45 | — | 0 | 0.43 | 0.18 | 0.07 | 0.04 | 0.04 | 0.06 | 0.01 | 0.09 | 0.02 | 0.03 | 0.06 | 0.09 | 0.14 |
| SEQID-01951 | B5OH15 | — | 0 | 0.55 | 0.17 | 0.10 | 0.01 | 0.01 | 0.11 | 0.02 | 0.10 | 0.03 | 0.00 | 0.06 | 0.05 | 0.11 |
| SEQID-01952 | B5X1G7 | — | 1 | 0.49 | 0.26 | 0.07 | 0.06 | 0.02 | 0.07 | 0.03 | 0.09 | 0.03 | 0.02 | 0.06 | 0.08 | 0.10 |
| SEQID-01953 | B5DGZ4 | — | 1 | 0.39 | 0.14 | 0.05 | 0.11 | 0.04 | 0.05 | 0.00 | 0.25 | 0.05 | 0.01 | 0.07 | 0.09 | 0.17 |
| SEQID-01954 | Q98SJ9 | — | 1 | 0.57 | 0.26 | 0.05 | 0.03 | 0.06 | 0.04 | 0.03 | 0.09 | 0.04 | 0.05 | 0.04 | 0.06 | 0.10 |
| SEQID-01955 | B5DG10 | — | 1 | 0.52 | 0.22 | 0.06 | 0.05 | 0.04 | 0.05 | 0.01 | 0.07 | 0.02 | 0.05 | 0.08 | 0.06 | 0.12 |
| SEQID-01956 | B5RI24 | — | 1 | 0.43 | 0.20 | 0.05 | 0.07 | 0.05 | 0.08 | 0.01 | 0.10 | 0.08 | 0.02 | 0.08 | 0.08 | 0.04 |

TABLE 1-continued

| | | | | | | | | | | | | | | |
|---|---|---|---|---|---|---|---|---|---|---|---|---|---|---|
| SEQID-01957 | B5DGZ1 | — | 1 | 0.51 | 0.20 | 0.07 | 0.03 | 0.05 | 0.01 | 0.05 | 0.03 | 0.05 | 0.01 | 0.09 | 0.06 | 0.10 |
| SEQID-01958 | B5DGS2 | — | 1 | 0.49 | 0.20 | 0.05 | 0.04 | 0.07 | 0.02 | 0.06 | 0.06 | 0.04 | 0.03 | 0.06 | 0.09 | 0.10 |
| SEQID-01959 | B5DFT9 | — | 1 | 0.46 | 0.19 | 0.03 | 0.05 | 0.08 | 0.02 | 0.04 | 0.06 | 0.03 | 0.04 | 0.04 | 0.10 | 0.06 |
| SEQID-01960 | B5DG78 | — | 0 | 0.45 | 0.24 | 0.07 | 0.03 | 0.06 | 0.01 | 0.05 | 0.06 | 0.03 | 0.03 | 0.07 | 0.07 | 0.07 |
| SEQID-01961 | B5DG72 | — | 1 | 0.50 | 0.21 | 0.05 | 0.04 | 0.07 | 0.01 | 0.03 | 0.05 | 0.03 | 0.03 | 0.08 | 0.09 | 0.09 |
| SEQID-01962 | 406714392 | — | 1 | 0.41 | 0.20 | 0.05 | 0.05 | 0.04 | 0.00 | 0.06 | 0.09 | 0.04 | 0.01 | 0.06 | 0.09 | 0.06 |
| SEQID-01963 | 409935420 | — | 1 | 0.42 | 0.20 | 0.05 | 0.05 | 0.06 | 0.00 | 0.06 | 0.09 | 0.04 | 0.01 | 0.07 | 0.09 | 0.06 |
| SEQID-01964 | 291565678 | — | 1 | 0.45 | 0.23 | 0.09 | 0.05 | 0.04 | 0.00 | 0.06 | 0.09 | 0.04 | 0.01 | 0.07 | 0.09 | 0.08 |
| SEQID-01965 | 291568131 | — | 1 | 0.40 | 0.21 | 0.07 | 0.04 | 0.07 | 0.00 | 0.03 | 0.12 | 0.04 | 0.02 | 0.06 | 0.09 | 0.09 |
| SEQID-01966 | 406715237 | — | 1 | 0.42 | 0.22 | 0.09 | 0.03 | 0.09 | 0.00 | 0.05 | 0.10 | 0.03 | 0.01 | 0.06 | 0.08 | 0.08 |
| SEQID-01967 | 406714893 | — | 1 | 0.45 | 0.22 | 0.05 | 0.04 | 0.08 | 0.02 | 0.04 | 0.10 | 0.04 | 0.01 | 0.06 | 0.08 | 0.07 |
| SEQID-01968 | 291571801 | — | 1 | 0.45 | 0.22 | 0.05 | 0.04 | 0.07 | 0.00 | 0.03 | 0.10 | 0.04 | 0.01 | 0.06 | 0.08 | 0.07 |
| SEQID-01969 | 406715272 | — | 1 | 0.44 | 0.23 | 0.07 | 0.05 | 0.05 | 0.02 | 0.04 | 0.11 | 0.05 | 0.03 | 0.09 | 0.07 | 0.05 |
| SEQID-01970 | 406712836 | — | 0 | 0.43 | 0.21 | 0.09 | 0.04 | 0.06 | 0.01 | 0.05 | 0.08 | 0.04 | 0.05 | 0.07 | 0.07 | 0.05 |
| SEQID-01971 | 406716509 | — | 1 | 0.38 | 0.14 | 0.07 | 0.02 | 0.04 | 0.00 | 0.17 | 0.10 | 0.01 | 0.02 | 0.02 | 0.07 | 0.07 |
| SEQID-01972 | 406712937 | — | 1 | 0.39 | 0.20 | 0.10 | 0.05 | 0.07 | 0.00 | 0.09 | 0.10 | 0.03 | 0.01 | 0.07 | 0.10 | 0.07 |
| SEQID-01973 | 304281792 | — | 1 | 0.38 | 0.19 | 0.06 | 0.04 | 0.05 | 0.00 | 0.06 | 0.06 | 0.03 | 0.02 | 0.08 | 0.06 | 0.06 |
| SEQID-01974 | 406711415 | — | 1 | 0.48 | 0.25 | 0.10 | 0.03 | 0.07 | 0.00 | 0.02 | 0.05 | 0.04 | 0.03 | 0.07 | 0.09 | 0.05 |
| SEQID-01975 | 291566625 | — | 1 | 0.49 | 0.25 | 0.06 | 0.05 | 0.04 | 0.01 | 0.02 | 0.05 | 0.04 | 0.03 | 0.06 | 0.09 | 0.06 |
| SEQID-01976 | 406712246 | — | 1 | 0.40 | 0.17 | 0.06 | 0.08 | 0.08 | 0.01 | 0.09 | 0.05 | 0.08 | 0.01 | 0.05 | 0.07 | 0.06 |
| SEQID-01977 | 406715559 | — | 0 | 0.57 | 0.23 | 0.04 | 0.04 | 0.11 | 0.00 | 0.04 | 0.07 | 0.03 | 0.01 | 0.05 | 0.07 | 0.04 |
| SEQID-01978 | 406716162 | — | 1 | 0.44 | 0.25 | 0.06 | 0.03 | 0.04 | 0.00 | 0.06 | 0.03 | 0.04 | 0.07 | 0.07 | 0.10 | 0.04 |
| SEQID-01979 | 406711547 | — | 1 | 0.40 | 0.20 | 0.05 | 0.05 | 0.12 | 0.01 | 0.04 | 0.13 | 0.04 | 0.02 | 0.09 | 0.10 | 0.07 |
| SEQID-01980 | 406715412 | — | 1 | 0.42 | 0.22 | 0.06 | 0.06 | 0.08 | 0.00 | 0.04 | 0.05 | 0.06 | 0.01 | 0.07 | 0.06 | 0.02 |
| SEQID-01981 | 406712949 | — | 1 | 0.49 | 0.22 | 0.04 | 0.04 | 0.11 | 0.00 | 0.05 | 0.09 | 0.04 | 0.02 | 0.06 | 0.09 | 0.06 |
| SEQID-01982 | 291570166 | — | 1 | 0.44 | 0.17 | 0.06 | 0.03 | 0.09 | 0.00 | 0.07 | 0.06 | 0.05 | 0.03 | 0.08 | 0.06 | 0.07 |
| SEQID-01983 | 291569320 | — | 0 | 0.49 | 0.25 | 0.04 | 0.04 | 0.07 | 0.00 | 0.08 | 0.05 | 0.05 | 0.03 | 0.07 | 0.07 | 0.07 |
| SEQID-01984 | 291565542 | — | 1 | 0.47 | 0.22 | 0.06 | 0.06 | 0.08 | 0.00 | 0.03 | 0.09 | 0.05 | 0.03 | 0.03 | 0.06 | 0.07 |
| SEQID-01985 | 406714412 | — | 0 | 0.42 | 0.21 | 0.07 | 0.05 | 0.06 | 0.01 | 0.03 | 0.09 | 0.04 | 0.04 | 0.05 | 0.09 | 0.06 |
| SEQID-01986 | 406711071 | — | 0 | 0.47 | 0.15 | 0.05 | 0.04 | 0.09 | 0.00 | 0.07 | 0.07 | 0.10 | 0.00 | 0.04 | 0.09 | 0.11 |
| SEQID-01987 | 406712053 | — | 1 | 0.45 | 0.27 | 0.09 | 0.04 | 0.07 | 0.00 | 0.05 | 0.11 | 0.06 | 0.02 | 0.09 | 0.09 | 0.0a |
| SEQID-01988 | P13550 | — | 1 | 0.45 | 0.19 | 0.05 | 0.04 | 0.06 | 0.01 | 0.04 | 0.08 | 0.04 | 0.03 | 0.05 | 0.09 | 0.06 |
| SEQID-01989 | 406715415 | — | 1 | 0.45 | 0.24 | 0.09 | 0.05 | 0.09 | 0.00 | 0.07 | 0.11 | 0.05 | 0.02 | 0.08 | 0.07 | 0.06 |
| SEQID-01990 | 291570822 | — | 1 | 0.44 | 0.25 | 0.04 | 0.04 | 0.08 | 0.00 | 0.05 | 0.10 | 0.04 | 0.02 | 0.04 | 0.09 | 0.05 |
| SEQID-01991 | 157042617 | — | 1 | 0.49 | 0.19 | 0.02 | 0.03 | 0.07 | 0.02 | 0.04 | 0.07 | 0.05 | 0.01 | 0.03 | 0.05 | 0.07 |
| SEQID-01992 | 406711121 | — | 0 | 0.36 | 0.18 | 0.05 | 0.05 | 0.14 | 0.00 | 0.07 | 0.10 | 0.04 | 0.01 | 0.03 | 0.08 | 0.02 |
| SEQID-01993 | 406715081 | — | 0 | 0.46 | 0.22 | 0.05 | 0.06 | 0.07 | 0.01 | 0.03 | 0.07 | 0.03 | 0.01 | 0.07 | 0.10 | 0.05 |
| SEQID-01994 | 406713986 | — | 0 | 0.50 | 0.19 | 0.06 | 0.06 | 0.07 | 0.00 | 0.02 | 0.05 | 0.06 | 0.03 | 0.05 | 0.07 | 0.03 |
| SEQID-01995 | 291570872 | — | 0 | 0.42 | 0.25 | 0.07 | 0.07 | 0.08 | 0.00 | 0.03 | 0.08 | 0.05 | 0.00 | 0.08 | 0.10 | 0.06 |
| SEQID-01996 | 406715991 | — | 1 | 0.48 | 0.27 | 0.07 | 0.07 | 0.06 | 0.00 | 0.03 | 0.09 | 0.06 | 0.00 | 0.09 | 0.09 | 0.09 |
| SEQID-01997 | 409938508 | — | 0 | 0.46 | 0.21 | 0.05 | 0.06 | 0.04 | 0.01 | 0.04 | 0.11 | 0.06 | 0.03 | 0.06 | 0.09 | 0.06 |
| SEQID-01998 | 291571972 | — | 1 | 0.45 | 0.19 | 0.05 | 0.05 | 0.05 | 0.00 | 0.04 | 0.06 | 0.04 | 0.03 | 0.05 | 0.09 | 0.07 |
| SEQID-01999 | 291565665 | — | 1 | 0.51 | 0.20 | 0.06 | 0.05 | 0.05 | 0.01 | 0.05 | 0.08 | 0.06 | 0.02 | 0.05 | 0.09 | 0.03 |
| SEQID-02000 | 291568537 | — | 0 | 0.41 | 0.15 | 0.05 | 0.05 | 0.04 | 0.00 | 0.04 | 0.05 | 0.05 | 0.03 | 0.04 | 0.08 | 0.11 |
| SEQID-02001 | 1524355 | — | 1 | 0.49 | 0.16 | 0.04 | 0.04 | 0.06 | 0.01 | 0.05 | 0.10 | 0.05 | 0.01 | 0.05 | 0.07 | 0.13 |
| SEQID-02002 | 157042618 | — | 0 | 0.40 | 0.23 | 0.07 | 0.05 | 0.03 | 0.01 | 0.01 | 0.12 | 0.05 | 0.00 | 0.08 | 0.09 | 0.04 |
| SEQID-02003 | 291568724 | — | 0 | 0.35 | 0.19 | 0.04 | 0.02 | 0.05 | 0.01 | 0.07 | 0.11 | 0.04 | 0.01 | 0.05 | 0.09 | 0.03 |
| SEQID-02004 | 406716541 | — | 0 | 0.45 | 0.25 | 0.05 | 0.03 | 0.05 | 0.01 | 0.05 | 0.08 | 0.05 | 0.01 | 0.07 | 0.09 | 0.06 |
| SEQID-02005 | 291568009 | — | 0 | 0.44 | 0.22 | 0.06 | 0.03 | 0.06 | 0.01 | 0.05 | 0.09 | 0.05 | 0.01 | 0.06 | 0.09 | 0.09 |
| SEQID-02006 | 291567743 | — | 1 | 0.45 | 0.21 | 0.06 | 0.04 | 0.07 | 0.00 | 0.04 | 0.06 | 0.04 | 0.03 | 0.06 | 0.09 | 0.06 |
| SEQID-02007 | 291569369 | — | 0 | 0.56 | 0.21 | 0.06 | 0.04 | 0.04 | 0.01 | 0.04 | 0.03 | 0.06 | 0.07 | 0.06 | 0.10 | 0.03 |
| SEQID-02008 | 2114199 | — | 0 | 0.38 | 0.17 | 0.02 | 0.04 | 0.04 | 0.00 | 0.05 | 0.12 | 0.05 | 0.02 | 0.04 | 0.11 | 0.10 |
| SEQID-02009 | 406716545 | — | 1 | 0.41 | 0.23 | 0.09 | 0.04 | 0.07 | 0.01 | 0.04 | 0.04 | 0.04 | 0.00 | 0.08 | 0.09 | 0.06 |
| SEQID-02009 | 406716545 | — | 1 | 0.52 | 0.24 | 0.06 | 0.05 | 0.05 | 0.00 | 0.03 | 0.05 | 0.07 | 0.04 | 0.07 | 0.11 | 0.03 |

TABLE 1-continued

| | | | | | | | | | | | | | | | | |
|---|---|---|---|---|---|---|---|---|---|---|---|---|---|---|---|---|
| SEQID-02010 | 406710610 | — | — | 1 | 0.46 | 0.20 | 0.04 | 0.07 | 0.06 | 0.07 | 0.01 | 0.05 | 0.07 | 0.03 | 0.04 | 0.06 | 0.10 | 0.06 |
| SEQID-02011 | 406712941 | — | — | 1 | 0.43 | 0.22 | 0.05 | 0.07 | 0.04 | 0.06 | 0.02 | 0.05 | 0.08 | 0.06 | 0.03 | 0.06 | 0.10 | 0.05 |
| SEQID-02012 | 406712920 | — | — | 0 | 0.42 | 0.19 | 0.03 | 0.04 | 0.05 | 0.05 | 0.00 | 0.16 | 0.09 | 0.01 | 0.02 | 0.05 | 0.12 | 0.09 |
| SEQID-02013 | 406716507 | — | — | 1 | 0.44 | 0.25 | 0.04 | 0.10 | 0.05 | 0.06 | 0.01 | 0.06 | 0.09 | 0.02 | 0.02 | 0.07 | 0.12 | 0.04 |
| SEQID-02014 | 406714835 | — | — | 1 | 0.38 | 0.17 | 0.05 | 0.03 | 0.02 | 0.02 | 0.01 | 0.24 | 0.18 | 0.01 | 0.03 | 0.02 | 0.06 | 0.07 |
| SEQID-02015 | 291566055 | — | — | 1 | 0.49 | 0.16 | 0.03 | 0.05 | 0.05 | 0.06 | 0.01 | 0.03 | 0.08 | 0.05 | 0.06 | 0.04 | 0.09 | 0.05 |
| SEQID-02016 | 409939478 | — | — | 0 | 0.39 | 0.05 | 0.08 | 0.00 | 0.00 | 0.07 | 0.02 | 0.01 | 0.15 | 0.00 | 0.01 | 0.01 | 0.00 | 0.23 |
| SEQID-02017 | P72503 | — | — | 0 | 0.38 | 0.22 | 0.11 | 0.09 | 0.04 | 0.07 | 0.01 | 0.04 | 0.06 | 0.05 | 0.01 | 0.06 | 0.09 | 0.03 |
| SEQID-02018 | 291568270 | — | — | 1 | 0.42 | 0.22 | 0.03 | 0.10 | 0.03 | 0.06 | 0.01 | 0.05 | 0.13 | 0.02 | 0.03 | 0.07 | 0.05 | 0.07 |
| SEQID-02019 | 406714163 | — | — | 1 | 0.49 | 0.23 | 0.06 | 0.05 | 0.06 | 0.02 | 0.01 | 0.03 | 0.06 | 0.05 | 0.03 | 0.07 | 0.09 | 0.00 |
| SEQID-02020 | 406713173 | — | — | 1 | 0.44 | 0.24 | 0.07 | 0.11 | 0.03 | 0.07 | 0.00 | 0.05 | 0.08 | 0.03 | 0.01 | 0.07 | 0.10 | 0.04 |
| SEQID-02021 | 406711712 | — | — | 1 | 0.45 | 0.21 | 0.07 | 0.09 | 0.04 | 0.04 | 0.01 | 0.04 | 0.12 | 0.05 | 0.01 | 0.05 | 0.07 | 0.12 |
| SEQID-02022 | 291566390 | — | — | 1 | 0.43 | 0.25 | 0.07 | 0.10 | 0.04 | 0.06 | 0.01 | 0.07 | 0.08 | 0.02 | 0.00 | 0.05 | 0.13 | 0.07 |
| SEQID-02023 | 291565971 | — | — | 1 | 0.49 | 0.23 | 0.07 | 0.07 | 0.04 | 0.06 | 0.01 | 0.03 | 0.09 | 0.04 | 0.03 | 0.08 | 0.08 | 0.07 |
| SEQID-02024 | 291570193 | — | — | 1 | 0.46 | 0.19 | 0.04 | 0.04 | 0.06 | 0.07 | 0.01 | 0.04 | 0.08 | 0.05 | 0.05 | 0.06 | 0.09 | 0.05 |
| SEQID-02025 | 406711224 | — | — | 1 | 0.45 | 0.21 | 0.05 | 0.06 | 0.05 | 0.06 | 0.01 | 0.06 | 0.09 | 0.05 | 0.01 | 0.06 | 0.09 | 0.08 |
| SEQID-02026 | 409938720 | — | — | 1 | 0.45 | 0.22 | 0.06 | 0.09 | 0.04 | 0.05 | 0.01 | 0.05 | 0.12 | 0.03 | 0.01 | 0.06 | 0.06 | 0.12 |
| SEQID-02027 | 406715510 | — | — | 1 | 0.42 | 0.19 | 0.05 | 0.16 | 0.05 | 0.05 | 0.02 | 0.02 | 0.05 | 0.04 | 0.00 | 0.07 | 0.05 | 0.16 |
| SEQID-02028 | 406716632 | — | — | 0 | 0.42 | 0.15 | 0.05 | 0.03 | 0.02 | 0.03 | 0.01 | 0.02 | 0.16 | 0.06 | 0.00 | 0.03 | 0.05 | 0.15 |
| SEQID-02029 | 291567489 | — | — | 1 | 0.43 | 0.22 | 0.06 | 0.06 | 0.03 | 0.02 | 0.00 | 0.03 | 0.09 | 0.01 | 0.00 | 0.07 | 0.07 | 0.11 |
| SEQID-02030 | 406715202 | — | — | 1 | 0.42 | 0.21 | 0.04 | 0.10 | 0.04 | 0.04 | 0.01 | 0.05 | 0.05 | 0.04 | 0.03 | 0.08 | 0.09 | 0.09 |
| SEQID-02031 | 291572127 | — | — | 1 | 0.40 | 0.21 | 0.04 | 0.11 | 0.04 | 0.04 | 0.01 | 0.03 | 0.11 | 0.05 | 0.01 | 0.07 | 0.07 | 0.04 |
| SEQID-02032 | 406710632 | — | — | 1 | 0.45 | 0.27 | 0.08 | 0.07 | 0.08 | 0.05 | 0.01 | 0.10 | 0.08 | 0.03 | 0.00 | 0.08 | 0.10 | 0.02 |
| SEQID-02033 | 291569653 | — | — | 1 | 0.45 | 0.22 | 0.06 | 0.03 | 0.06 | 0.04 | 0.01 | 0.08 | 0.07 | 0.03 | 0.01 | 0.08 | 0.10 | 0.08 |
| SEQID-02034 | 291568318 | — | — | 1 | 0.44 | 0.25 | 0.04 | 0.12 | 0.04 | 0.05 | 0.01 | 0.04 | 0.09 | 0.04 | 0.01 | 0.04 | 0.10 | 0.06 |
| SEQID-02035 | 10303060 | — | — | 0 | 0.39 | 0.16 | 0.10 | 0.09 | 0.02 | 0.06 | 0.02 | 0.09 | 0.04 | 0.03 | 0.02 | 0.07 | 0.11 | 0.06 |
| SEQID-02036 | 406714441 | — | — | 0 | 0.42 | 0.09 | 0.12 | 0.06 | 0.05 | 0.05 | 0.00 | 0.02 | 0.08 | 0.04 | 0.00 | 0.05 | 0.07 | 0.09 |
| SEQID-02037 | 406713507 | — | — | 1 | 0.49 | 0.24 | 0.07 | 0.06 | 0.03 | 0.06 | 0.00 | 0.06 | 0.19 | 0.03 | 0.00 | 0.01 | 0.04 | 0.16 |
| SEQID-02038 | 406715512 | — | — | 1 | 0.43 | 0.22 | 0.07 | 0.15 | 0.03 | 0.07 | 0.01 | 0.05 | 0.03 | 0.03 | 0.00 | 0.09 | 0.09 | 0.11 |
| SEQID-02039 | 406716252 | — | — | 0 | 0.36 | 0.19 | 0.08 | 0.09 | 0.07 | 0.04 | 0.01 | 0.13 | 0.03 | 0.04 | 0.00 | 0.04 | 0.11 | 0.09 |
| SEQID-02040 | 291571590 | — | — | 0 | 0.43 | 0.21 | 0.06 | 0.06 | 0.04 | 0.04 | 0.01 | 0.04 | 0.13 | 0.05 | 0.00 | 0.04 | 0.11 | 0.09 |
| SEQID-02041 | 291571517 | — | — | 1 | 0.39 | 0.20 | 0.06 | 0.10 | 0.03 | 0.05 | 0.01 | 0.07 | 0.03 | 0.04 | 0.02 | 0.07 | 0.09 | 0.07 |
| SEQID-02042 | 155676168 | — | — | 1 | 0.50 | 0.24 | 0.06 | 0.07 | 0.05 | 0.14 | 0.01 | 0.05 | 0.09 | 0.07 | 0.03 | 0.08 | 0.09 | 0.06 |
| SEQID-02043 | 291565929 | — | — | 0 | 0.49 | 0.21 | 0.11 | 0.01 | 0.00 | 0.07 | 0.00 | 0.04 | 0.18 | 0.02 | 0.00 | 0.06 | 0.10 | 0.14 |
| SEQID-02044 | 291565691 | — | — | 0 | 0.42 | 0.08 | 0.14 | 0.06 | 0.04 | 0.05 | 0.00 | 0.01 | 0.10 | 0.05 | 0.00 | 0.06 | 0.04 | 0.17 |
| SEQID-02045 | 406713937 | — | — | 0 | 0.49 | 0.30 | 0.05 | 0.09 | 0.05 | 0.03 | 0.00 | 0.06 | 0.08 | 0.03 | 0.01 | 0.08 | 0.15 | 0.06 |
| SEQID-02046 | 291572098 | — | — | 1 | 0.41 | 0.21 | 0.06 | 0.09 | 0.06 | 0.06 | 0.01 | 0.04 | 0.09 | 0.04 | 0.01 | 0.03 | 0.05 | 0.13 |
| SEQID-02047 | 291571140 | — | — | 0 | 0.47 | 0.25 | 0.05 | 0.00 | 0.08 | 0.09 | 0.01 | 0.04 | 0.06 | 0.05 | 0.04 | 0.04 | 0.10 | 0.08 |
| SEQID-02048 | 291713289 | — | — | 1 | 0.45 | 0.20 | 0.04 | 0.10 | 0.03 | 0.05 | 0.00 | 0.05 | 0.09 | 0.03 | 0.03 | 0.04 | 0.10 | 0.07 |
| SEQID-02049 | 406714641 | — | — | 1 | 0.54 | 0.22 | 0.05 | 0.06 | 0.04 | 0.04 | 0.02 | 0.03 | 0.06 | 0.02 | 0.02 | 0.05 | 0.06 | 0.08 |
| SEQID-02050 | 406712535 | — | — | 1 | 0.40 | 0.20 | 0.04 | 0.11 | 0.04 | 0.05 | 0.01 | 0.04 | 0.08 | 0.04 | 0.01 | 0.08 | 0.07 | 0.02 |
| SEQID-02051 | 291567799 | — | — | 1 | 0.43 | 0.24 | 0.05 | 0.04 | 0.05 | 0.05 | 0.01 | 0.07 | 0.07 | 0.04 | 0.01 | 0.07 | 0.09 | 0.01 |
| SEQID-02052 | 291569929 | — | — | 0 | 0.45 | 0.21 | 0.06 | 0.18 | 0.01 | 0.01 | 0.02 | 0.06 | 0.04 | 0.02 | 0.05 | 0.05 | 0.09 | 0.07 |
| SEQID-02053 | 406716396 | — | — | 1 | 0.37 | 0.24 | 0.05 | 0.09 | 0.03 | 0.03 | 0.00 | 0.06 | 0.09 | 0.03 | 0.00 | 0.08 | 0.11 | 0.08 |
| SEQID-02054 | 226536926 | — | — | 1 | 0.52 | 0.13 | 0.06 | 0.09 | 0.06 | 0.06 | 0.01 | 0.07 | 0.09 | 0.04 | 0.00 | 0.03 | 0.05 | 0.13 |
| SEQID-02055 | 291566672 | — | — | 0 | 0.45 | 0.17 | 0.09 | 0.00 | 0.08 | 0.05 | 0.01 | 0.04 | 0.06 | 0.04 | 0.04 | 0.04 | 0.10 | 0.08 |
| SEQID-02056 | 291567524 | — | — | 1 | 0.47 | 0.20 | 0.05 | 0.10 | 0.03 | 0.04 | 0.01 | 0.05 | 0.09 | 0.04 | 0.03 | 0.04 | 0.10 | 0.07 |
| SEQID-02057 | 291571685 | — | — | 1 | 0.54 | 0.22 | 0.06 | 0.06 | 0.04 | 0.05 | 0.02 | 0.03 | 0.06 | 0.05 | 0.03 | 0.05 | 0.11 | 0.01 |
| SEQID-02058 | 406711744 | — | — | 0 | 0.46 | 0.22 | 0.04 | 0.10 | 0.04 | 0.05 | 0.01 | 0.02 | 0.08 | 0.05 | 0.03 | 0.08 | 0.07 | 0.04 |
| SEQID-02059 | 291567802 | — | — | 1 | 0.52 | 0.23 | 0.06 | 0.04 | 0.06 | 0.06 | 0.01 | 0.06 | 0.07 | 0.04 | 0.03 | 0.06 | 0.08 | 0.05 |
| SEQID-02060 | 406712317 | — | — | 0 | 0.44 | 0.32 | 0.06 | 0.08 | 0.03 | 0.02 | 0.00 | 0.20 | 0.04 | 0.04 | 0.00 | 0.12 | 0.12 | 0.03 |
| SEQID-02061 | 406715474 | — | — | 1 | 0.44 | 0.26 | 0.06 | 0.09 | 0.04 | 0.04 | 0.00 | 0.05 | 0.11 | 0.05 | 0.03 | 0.03 | 0.13 | 0.09 |
| SEQID-02062 | 291569833 | — | — | 1 | 0.43 | 0.24 | 0.07 | 0.11 | 0.04 | 0.07 | 0.00 | 0.06 | 0.09 | 0.04 | 0.01 | 0.06 | 0.10 | 0.05 |

TABLE 1-continued

| | | | | | | | | | | | | | | | |
|---|---|---|---|---|---|---|---|---|---|---|---|---|---|---|---|
| SEQID-02063 | 406715203 | — | 1 | 0.43 | 0.22 | 0.04 | 0.11 | 0.05 | 0.07 | 0.01 | 0.05 | 0.06 | 0.04 | 0.02 | 0.08 | 0.10 | 0.03 |
| SEQID-02064 | 406715533 | — | 1 | 0.45 | 0.23 | 0.05 | 0.06 | 0.04 | 0.05 | 0.01 | 0.06 | 0.10 | 0.04 | 0.02 | 0.05 | 0.11 | 0.05 |
| SEQID-02065 | 291570764 | — | 1 | 0.48 | 0.23 | 0.07 | 0.06 | 0.05 | 0.06 | 0.01 | 0.03 | 0.03 | 0.04 | 0.03 | 0.08 | 0.09 | 0.06 |
| SEQID-02066 | 291570294 | — | 1 | 0.45 | 0.20 | 0.06 | 0.06 | 0.05 | 0.06 | 0.02 | 0.04 | 0.07 | 0.06 | 0.02 | 0.06 | 0.03 | 0.07 |
| SEQID-02067 | 291565677 | — | 0 | 0.46 | 0.26 | 0.07 | 0.10 | 0.02 | 0.07 | 0.01 | 0.01 | 0.11 | 0.03 | 0.00 | 0.05 | 0.09 | 0.12 |
| SEQID-02068 | 406713927 | — | 0 | 0.44 | 0.09 | 0.05 | 0.06 | 0.01 | 0.07 | 0.00 | 0.02 | 0.08 | 0.03 | 0.01 | 0.02 | 0.06 | 0.15 |
| SEQID-02069 | 291565882 | — | 1 | 0.44 | 0.24 | 0.12 | 0.10 | 0.02 | 0.05 | 0.00 | 0.02 | 0.08 | 0.06 | 0.02 | 0.07 | 0.07 | 0.04 |
| SEQID-02070 | 291570798 | — | 0 | 0.44 | 0.23 | 0.06 | 0.13 | 0.02 | 0.03 | 0.00 | 0.07 | 0.13 | 0.03 | 0.02 | 0.06 | 0.08 | 0.08 |
| SEQID-02071 | 406711359 | — | 1 | 0.46 | 0.22 | 0.09 | 0.07 | 0.02 | 0.05 | 0.01 | 0.06 | 0.07 | 0.04 | 0.02 | 0.06 | 0.13 | 0.06 |
| SEQID-02072 | 291566660 | — | 1 | 0.46 | 0.22 | 0.09 | 0.07 | 0.02 | 0.05 | 0.00 | 0.05 | 0.08 | 0.05 | 0.02 | 0.09 | 0.13 | 0.06 |
| SEQID-02073 | 291565124 | — | 0 | 0.41 | 0.24 | 0.04 | 0.14 | 0.06 | 0.05 | 0.02 | 0.03 | 0.05 | 0.03 | 0.00 | 0.09 | 0.09 | 0.03 |
| SEQID-02074 | 406711662 | — | 1 | 0.48 | 0.28 | 0.06 | 0.06 | 0.03 | 0.04 | 0.04 | 0.03 | 0.05 | 0.06 | 0.00 | 0.09 | 0.12 | 0.03 |
| SEQID-02075 | 406715358 | — | 1 | 0.42 | 0.19 | 0.03 | 0.09 | 0.03 | 0.06 | 0.04 | 0.04 | 0.10 | 0.02 | 0.03 | 0.05 | 0.08 | 0.09 |
| SEQID-02076 | 291568477 | — | 1 | 0.46 | 0.21 | 0.03 | 0.05 | 0.06 | 0.10 | 0.00 | 0.05 | 0.05 | 0.02 | 0.02 | 0.06 | 0.09 | 0.09 |
| SEQID-02077 | 291567784 | — | 1 | 0.49 | 0.21 | 0.03 | 0.09 | 0.06 | 0.03 | 0.01 | 0.05 | 0.06 | 0.07 | 0.03 | 0.05 | 0.09 | 0.11 |
| SEQID-02078 | 406711814 | — | 1 | 0.49 | 0.27 | 0.06 | 0.07 | 0.04 | 0.07 | 0.01 | 0.04 | 0.06 | 0.04 | 0.03 | 0.09 | 0.11 | 0.05 |
| SEQID-02079 | 406714225 | — | 1 | 0.38 | 0.18 | 0.03 | 0.03 | 0.09 | 0.06 | 0.01 | 0.06 | 0.03 | 0.02 | 0.01 | 0.04 | 0.11 | 0.04 |
| SEQID-02080 | 291566562 | — | 1 | 0.49 | 0.19 | 0.04 | 0.09 | 0.04 | 0.05 | 0.00 | 0.02 | 0.10 | 0.05 | 0.04 | 0.05 | 0.10 | 0.07 |
| SEQID-02081 | 291566243 | — | 1 | 0.44 | 0.19 | 0.05 | 0.06 | 0.03 | 0.05 | 0.00 | 0.04 | 0.09 | 0.02 | 0.06 | 0.05 | 0.03 | 0.05 |
| SEQID-02082 | 291568601 | — | 1 | 0.49 | 0.22 | 0.07 | 0.04 | 0.07 | 0.10 | 0.01 | 0.09 | 0.08 | 0.03 | 0.03 | 0.09 | 0.09 | 0.05 |
| SEQID-02083 | 291568927 | — | 1 | 0.44 | 0.21 | 0.06 | 0.07 | 0.06 | 0.06 | 0.01 | 0.06 | 0.06 | 0.07 | 0.02 | 0.06 | 0.09 | 0.06 |
| SEQID-02084 | 291570378 | — | 1 | 0.46 | 0.17 | 0.04 | 0.03 | 0.03 | 0.05 | 0.01 | 0.05 | 0.07 | 0.05 | 0.03 | 0.06 | 0.06 | 0.06 |
| SEQID-02085 | 406712979 | — | 0 | 0.39 | 0.20 | 0.08 | 0.04 | 0.04 | 0.04 | 0.01 | 0.10 | 0.10 | 0.02 | 0.04 | 0.06 | 0.12 | 0.04 |
| SEQID-02086 | 291571158 | — | 0 | 0.47 | 0.27 | 0.07 | 0.06 | 0.04 | 0.04 | 0.01 | 0.05 | 0.10 | 0.03 | 0.03 | 0.05 | 0.09 | 0.05 |
| SEQID-02087 | 291570621 | — | 1 | 0.44 | 0.22 | 0.05 | 0.09 | 0.03 | 0.05 | 0.01 | 0.06 | 0.07 | 0.05 | 0.02 | 0.06 | 0.09 | 0.04 |
| SEQID-02088 | 291567536 | — | 0 | 0.42 | 0.24 | 0.05 | 0.04 | 0.05 | 0.06 | 0.00 | 0.09 | 0.11 | 0.04 | 0.01 | 0.05 | 0.09 | 0.06 |
| SEQID-02089 | 291568759 | — | 0 | 0.49 | 0.38 | 0.09 | 0.06 | 0.09 | 0.09 | 0.00 | 0.02 | 0.14 | 0.02 | 0.01 | 0.07 | 0.09 | 0.01 |
| SEQID-02090 | 291566375 | — | 1 | 0.49 | 0.20 | 0.05 | 0.03 | 0.01 | 0.05 | 0.00 | 0.02 | 0.10 | 0.02 | 0.00 | 0.09 | 0.10 | 0.05 |
| SEQID-02091 | 406715888 | — | 0 | 0.36 | 0.19 | 0.04 | 0.18 | 0.03 | 0.04 | 0.00 | 0.09 | 0.07 | 0.04 | 0.01 | 0.13 | 0.06 | 0.03 |
| SEQID-02092 | 291567786 | — | 0 | 0.47 | 0.23 | 0.04 | 0.16 | 0.03 | 0.06 | 0.01 | 0.05 | 0.10 | 0.03 | 0.00 | 0.06 | 0.03 | 0.07 |
| SEQID-02093 | 406715491 | — | 0 | 0.41 | 0.21 | 0.05 | 0.23 | 0.02 | 0.05 | 0.00 | 0.03 | 0.08 | 0.01 | 0.01 | 0.05 | 0.08 | 0.09 |
| SEQID-02094 | 291568112 | — | 0 | 0.46 | 0.18 | 0.06 | 0.03 | 0.05 | 0.06 | 0.00 | 0.05 | 0.05 | 0.05 | 0.01 | 0.06 | 0.12 | 0.08 |
| SEQID-02095 | 291565897 | — | 1 | 0.52 | 0.24 | 0.05 | 0.03 | 0.03 | 0.12 | 0.00 | 0.03 | 0.04 | 0.04 | 0.03 | 0.04 | 0.07 | 0.09 |
| SEQID-02096 | 291568829 | — | 0 | 0.41 | 0.25 | 0.08 | 0.09 | 0.02 | 0.04 | 0.01 | 0.04 | 0.11 | 0.03 | 0.01 | 0.08 | 0.10 | 0.03 |
| SEQID-02097 | 291567800 | — | 0 | 0.46 | 0.26 | 0.07 | 0.11 | 0.06 | 0.09 | 0.00 | 0.06 | 0.06 | 0.03 | 0.01 | 0.06 | 0.12 | 0.03 |
| SEQID-02098 | 291567422 | — | 1 | 0.38 | 0.12 | 0.07 | 0.07 | 0.07 | 0.05 | 0.01 | 0.07 | 0.07 | 0.03 | 0.01 | 0.05 | 0.07 | 0.12 |
| SEQID-02099 | 406715501 | — | 1 | 0.48 | 0.23 | 0.04 | 0.10 | 0.07 | 0.05 | 0.00 | 0.07 | 0.09 | 0.04 | 0.00 | 0.03 | 0.05 | 0.11 |
| SEQID-02100 | 406716242 | — | 1 | 0.42 | 0.19 | 0.08 | 0.06 | 0.06 | 0.09 | 0.01 | 0.07 | 0.08 | 0.04 | 0.01 | 0.10 | 0.08 | 0.07 |
| SEQID-02101 | 291567386 | — | 1 | 0.43 | 0.22 | 0.05 | 0.03 | 0.02 | 0.07 | 0.02 | 0.07 | 0.09 | 0.01 | 0.04 | 0.04 | 0.11 | 0.09 |
| SEQID-02102 | 406716309 | — | 0 | 0.43 | 0.16 | 0.05 | 0.05 | 0.05 | 0.08 | 0.02 | 0.09 | 0.09 | 0.02 | 0.02 | 0.09 | 0.07 | 0.07 |
| SEQID-02103 | 291565931 | — | 1 | 0.48 | 0.24 | 0.06 | 0.09 | 0.04 | 0.07 | 0.01 | 0.05 | 0.05 | 0.04 | 0.07 | 0.06 | 0.04 | 0.05 |
| SEQID-02104 | 291566379 | — | 1 | 0.45 | 0.21 | 0.03 | 0.03 | 0.01 | 0.07 | 0.01 | 0.06 | 0.03 | 0.03 | 0.01 | 0.05 | 0.12 | 0.09 |
| SEQID-02105 | 291571503 | — | 1 | 0.43 | 0.23 | 0.06 | 0.09 | 0.03 | 0.04 | 0.02 | 0.05 | 0.03 | 0.03 | 0.00 | 0.07 | 0.09 | 0.05 |
| SEQID-02106 | 406715051 | — | 1 | 0.49 | 0.24 | 0.04 | 0.10 | 0.02 | 0.06 | 0.01 | 0.08 | 0.05 | 0.03 | 0.00 | 0.07 | 0.10 | 0.09 |
| SEQID-02107 | 291566214 | — | 0 | 0.47 | 0.23 | 0.04 | 0.04 | 0.05 | 0.06 | 0.00 | 0.07 | 0.05 | 0.04 | 0.01 | 0.07 | 0.10 | 0.09 |
| SEQID-02108 | 291567378 | — | 1 | 0.46 | 0.23 | 0.07 | 0.03 | 0.07 | 0.07 | 0.01 | 0.07 | 0.06 | 0.05 | 0.04 | 0.08 | 0.09 | 0.05 |
| SEQID-02109 | 291572086 | — | 1 | 0.45 | 0.25 | 0.05 | 0.05 | 0.06 | 0.08 | 0.02 | 0.09 | 0.09 | 0.05 | 0.02 | 0.08 | 0.11 | 0.07 |
| SEQID-02110 | 291568330 | — | 1 | 0.46 | 0.18 | 0.05 | 0.09 | 0.02 | 0.02 | 0.02 | 0.05 | 0.07 | 0.04 | 0.03 | 0.05 | 0.07 | 0.06 |
| SEQID-02111 | 291565792 | — | 0 | 0.58 | 0.36 | 0.07 | 0.05 | 0.04 | 0.04 | 0.01 | 0.09 | 0.04 | 0.04 | 0.03 | 0.12 | 0.16 | 0.06 |
| SEQID-02112 | 291566578 | — | 1 | 0.43 | 0.24 | 0.03 | 0.10 | 0.04 | 0.06 | 0.00 | 0.05 | 0.11 | 0.05 | 0.01 | 0.06 | 0.09 | 0.03 |
| SEQID-02113 | 291566922 | — | 1 | 0.46 | 0.27 | 0.05 | 0.09 | 0.02 | 0.09 | 0.01 | 0.04 | 0.08 | 0.05 | 0.02 | 0.09 | 0.10 | 0.05 |
| SEQID-02114 | 406713771 | — | 1 | 0.42 | 0.22 | 0.05 | 0.03 | 0.07 | 0.05 | 0.01 | 0.06 | 0.06 | 0.05 | 0.02 | 0.06 | 0.08 | 0.06 |
| SEQID-02115 | 291566950 | — | 1 | 0.45 | 0.22 | 0.07 | 0.07 | 0.04 | 0.06 | 0.02 | 0.04 | 0.08 | 0.05 | 0.01 | 0.07 | 0.09 | 0.05 |

TABLE 1-continued

| SEQID | ID | | | | | | | | | | | | | | | |
|---|---|---|---|---|---|---|---|---|---|---|---|---|---|---|---|---|
| SEQID-02116 | 406712549 | — | 1 | 0.46 | 0.24 | 0.05 | 0.09 | 0.04 | 0.06 | 0.01 | 0.04 | 0.09 | 0.03 | 0.03 | 0.06 | 0.11 | 0.06 |
| SEQID-02117 | 17974193 | — | 0 | 0.53 | 0.19 | 0.02 | 0.12 | 0.04 | 0.01 | 0.01 | 0.08 | 0.05 | 0.04 | 0.00 | 0.04 | 0.07 | 0.10 |
| SEQID-02118 | 291569292 | — | 0 | 0.48 | 0.21 | 0.06 | 0.11 | 0.03 | 0.03 | 0.00 | 0.04 | 0.14 | 0.02 | 0.02 | 0.09 | 0.07 | 0.14 |
| SEQID-02119 | 291569856 | — | 0 | 0.44 | 0.28 | 0.06 | 0.10 | 0.02 | 0.03 | 0.01 | 0.02 | 0.11 | 0.05 | 0.00 | 0.02 | 0.03 | 0.03 |
| SEQID-02120 | 291569285 | — | 0 | 0.33 | 0.13 | 0.04 | 0.15 | 0.03 | 0.07 | 0.01 | 0.01 | 0.12 | 0.09 | 0.00 | 0.08 | 0.05 | 0.04 |
| SEQID-02121 | 406714138 | — | 0 | 0.47 | 0.23 | 0.03 | 0.12 | 0.02 | 0.05 | 0.01 | 0.06 | 0.11 | 0.06 | 0.04 | 0.02 | 0.06 | 0.09 |
| SEQID-02122 | 291570835 | — | 1 | 0.68 | 0.36 | 0.03 | 0.02 | 0.03 | 0.02 | 0.01 | 0.02 | 0.03 | 0.06 | 0.03 | 0.18 | 0.14 | 0.09 |
| SEQID-02123 | 291568903 | — | 0 | 0.39 | 0.20 | 0.09 | 0.11 | 0.05 | 0.04 | 0.00 | 0.04 | 0.05 | 0.08 | 0.01 | 0.02 | 0.10 | 0.04 |
| SEQID-02124 | 291567801 | — | 0 | 0.37 | 0.19 | 0.07 | 0.15 | 0.04 | 0.03 | 0.00 | 0.06 | 0.05 | 0.02 | 0.00 | 0.05 | 0.10 | 0.05 |
| SEQID-02125 | 406713999 | — | 0 | 0.41 | 0.24 | 0.10 | 0.07 | 0.03 | 0.04 | 0.00 | 0.11 | 0.12 | 0.08 | 0.01 | 0.10 | 0.13 | 0.09 |
| SEQID-02126 | 291570409 | — | 0 | 0.52 | 0.23 | 0.07 | 0.03 | 0.03 | 0.09 | 0.00 | 0.05 | 0.09 | 0.02 | 0.00 | 0.04 | 0.12 | 0.08 |
| SEQID-02127 | P13577 | — | 0 | 0.40 | 0.17 | 0.07 | 0.21 | 0.03 | 0.03 | 0.02 | 0.01 | 0.09 | 0.05 | 0.04 | 0.03 | 0.06 | 0.05 |
| SEQID-02128 | 406714844 | — | 1 | 0.45 | 0.23 | 0.06 | 0.07 | 0.05 | 0.05 | 0.00 | 0.07 | 0.07 | 0.03 | 0.03 | 0.06 | 0.10 | 0.06 |
| SEQID-02129 | 406713988 | — | 0 | 0.36 | 0.25 | 0.10 | 0.12 | 0.05 | 0.03 | 0.00 | 0.10 | 0.15 | 0.03 | 0.01 | 0.07 | 0.14 | 0.05 |
| SEQID-02130 | 406713332 | — | 1 | 0.49 | 0.25 | 0.09 | 0.06 | 0.05 | 0.06 | 0.00 | 0.03 | 0.07 | 0.06 | 0.01 | 0.10 | 0.06 | 0.09 |
| SEQID-02131 | 406713096 | — | 1 | 0.44 | 0.23 | 0.04 | 0.06 | 0.04 | 0.05 | 0.00 | 0.03 | 0.09 | 0.05 | 0.01 | 0.07 | 0.09 | 0.09 |
| SEQID-02132 | 291571396 | — | 0 | 0.44 | 0.24 | 0.04 | 0.09 | 0.05 | 0.04 | 0.01 | 0.07 | 0.12 | 0.06 | 0.03 | 0.08 | 0.03 | 0.04 |
| SEQID-02133 | 291570518 | — | 1 | 0.43 | 0.22 | 0.07 | 0.08 | 0.05 | 0.07 | 0.01 | 0.05 | 0.11 | 0.02 | 0.00 | 0.06 | 0.11 | 0.07 |
| SEQID-02134 | 406714445 | — | 1 | 0.48 | 0.23 | 0.03 | 0.03 | 0.04 | 0.06 | 0.02 | 0.02 | 0.06 | 0.05 | 0.05 | 0.05 | 0.11 | 0.06 |
| SEQID-02135 | 291566643 | — | 1 | 0.37 | 0.21 | 0.05 | 0.03 | 0.09 | 0.06 | 0.00 | 0.05 | 0.04 | 0.12 | 0.00 | 0.07 | 0.09 | 0.01 |
| SEQID-02136 | 291568361 | — | 0 | 0.44 | 0.27 | 0.06 | 0.08 | 0.03 | 0.04 | 0.02 | 0.06 | 0.05 | 0.02 | 0.01 | 0.13 | 0.12 | 0.07 |
| SEQID-02137 | 291568800 | — | 1 | 0.46 | 0.24 | 0.07 | 0.09 | 0.03 | 0.09 | 0.01 | 0.05 | 0.07 | 0.04 | 0.03 | 0.07 | 0.10 | 0.04 |
| SEQID-02138 | 406712435 | — | 1 | 0.44 | 0.25 | 0.07 | 0.04 | 0.04 | 0.05 | 0.01 | 0.07 | 0.08 | 0.05 | 0.01 | 0.09 | 0.12 | 0.05 |
| SEQID-02139 | 291571840 | — | 1 | 0.47 | 0.25 | 0.05 | 0.07 | 0.05 | 0.06 | 0.01 | 0.05 | 0.09 | 0.04 | 0.03 | 0.05 | 0.09 | 0.05 |
| SEQID-02140 | 291571996 | — | 0 | 0.45 | 0.26 | 0.09 | 0.05 | 0.04 | 0.07 | 0.01 | 0.06 | 0.10 | 0.03 | 0.01 | 0.06 | 0.12 | 0.09 |
| SEQID-02141 | 406716058 | — | 0 | 0.40 | 0.19 | 0.04 | 0.12 | 0.04 | 0.05 | 0.02 | 0.03 | 0.10 | 0.05 | 0.01 | 0.06 | 0.10 | 0.07 |
| SEQID-02142 | 291568019 | — | 1 | 0.43 | 0.21 | 0.07 | 0.10 | 0.04 | 0.07 | 0.01 | 0.02 | 0.07 | 0.07 | 0.02 | 0.08 | 0.08 | 0.06 |
| SEQID-02143 | 291570518 | — | 1 | 0.48 | 0.23 | 0.04 | 0.06 | 0.04 | 0.06 | 0.01 | 0.05 | 0.11 | 0.04 | 0.02 | 0.06 | 0.07 | 0.07 |
| SEQID-02144 | 291566657 | — | 1 | 0.57 | 0.32 | 0.06 | 0.06 | 0.03 | 0.04 | 0.01 | 0.02 | 0.06 | 0.05 | 0.05 | 0.07 | 0.11 | 0.06 |
| SEQID-02145 | 406711605 | — | 1 | 0.49 | 0.27 | 0.09 | 0.04 | 0.04 | 0.06 | 0.00 | 0.04 | 0.07 | 0.12 | 0.00 | 0.13 | 0.14 | 0.03 |
| SEQID-02146 | 291570777 | — | 1 | 0.46 | 0.30 | 0.07 | 0.08 | 0.04 | 0.06 | 0.00 | 0.05 | 0.07 | 0.02 | 0.04 | 0.07 | 0.10 | 0.06 |
| SEQID-02147 | 406712981 | — | 1 | 0.47 | 0.21 | 0.06 | 0.06 | 0.04 | 0.05 | 0.01 | 0.04 | 0.09 | 0.04 | 0.02 | 0.09 | 0.12 | 0.05 |
| SEQID-02148 | 291569312 | — | 1 | 0.43 | 0.19 | 0.03 | 0.09 | 0.05 | 0.04 | 0.00 | 0.05 | 0.12 | 0.02 | 0.04 | 0.05 | 0.09 | 0.06 |
| SEQID-02149 | 406713557 | — | 1 | 0.40 | 0.24 | 0.04 | 0.12 | 0.04 | 0.04 | 0.00 | 0.12 | 0.10 | 0.02 | 0.02 | 0.04 | 0.12 | 0.03 |
| SEQID-02150 | 291570203 | — | 1 | 0.43 | 0.20 | 0.05 | 0.09 | 0.05 | 0.07 | 0.01 | 0.04 | 0.08 | 0.04 | 0.02 | 0.07 | 0.08 | 0.06 |
| SEQID-02151 | 291565708 | — | 1 | 0.41 | 0.20 | 0.04 | 0.05 | 0.05 | 0.03 | 0.00 | 0.05 | 0.13 | 0.11 | 0.01 | 0.06 | 0.07 | 0.02 |
| SEQID-02152 | 291570064 | — | 1 | 0.45 | 0.22 | 0.03 | 0.07 | 0.03 | 0.07 | 0.00 | 0.03 | 0.17 | 0.03 | 0.03 | 0.07 | 0.10 | 0.06 |
| SEQID-02153 | 291572019 | — | 1 | 0.46 | 0.24 | 0.05 | 0.09 | 0.00 | 0.06 | 0.11 | 0.06 | 0.06 | 0.02 | 0.02 | 0.05 | 0.06 | 0.04 |
| SEQID-02154 | 291568067 | — | 1 | 0.44 | 0.24 | 0.06 | 0.09 | 0.07 | 0.04 | 0.01 | 0.04 | 0.09 | 0.04 | 0.00 | 0.08 | 0.09 | 0.09 |
| SEQID-02155 | 291568693 | — | 1 | 0.37 | 0.21 | 0.04 | 0.07 | 0.04 | 0.03 | 0.03 | 0.05 | 0.11 | 0.02 | 0.01 | 0.06 | 0.12 | 0.10 |
| SEQID-02156 | 291568693 | — | 1 | 0.44 | 0.22 | 0.07 | 0.10 | 0.05 | 0.05 | 0.00 | 0.05 | 0.11 | 0.03 | 0.03 | 0.07 | 0.11 | 0.05 |
| SEQID-02157 | 406713711 | — | 0 | 0.51 | 0.19 | 0.05 | 0.05 | 0.05 | 0.05 | 0.01 | 0.05 | 0.08 | 0.01 | 0.03 | 0.05 | 0.10 | 0.03 |
| SEQID-02158 | 406715505 | — | 0 | 0.42 | 0.24 | 0.04 | 0.15 | 0.04 | 0.00 | 0.00 | 0.09 | 0.13 | 0.04 | 0.05 | 0.05 | 0.12 | 0.04 |
| SEQID-02159 | 406715222 | — | 0 | 0.39 | 0.12 | 0.03 | 0.19 | 0.03 | 0.04 | 0.00 | 0.00 | 0.17 | 0.01 | 0.03 | 0.04 | 0.18 | 0.08 |
| SEQID-02160 | 291571965 | — | 1 | 0.40 | 0.18 | 0.05 | 0.09 | 0.05 | 0.07 | 0.11 | 0.03 | 0.06 | 0.04 | 0.02 | 0.04 | 0.04 | 0.09 |
| SEQID-02161 | 291570671 | — | 0 | 0.42 | 0.22 | 0.06 | 0.09 | 0.00 | 0.04 | 0.01 | 0.06 | 0.09 | 0.02 | 0.00 | 0.05 | 0.06 | 0.04 |
| SEQID-02162 | 291567416 | — | 0 | 0.44 | 0.16 | 0.10 | 0.07 | 0.07 | 0.04 | 0.03 | 0.05 | 0.11 | 0.01 | 0.01 | 0.06 | 0.03 | 0.09 |
| SEQID-02163 | 157042619 | — | 0 | 0.38 | 0.14 | 0.02 | 0.11 | 0.05 | 0.03 | 0.00 | 0.05 | 0.11 | 0.03 | 0.00 | 0.07 | 0.02 | 0.10 |
| SEQID-02164 | 291566338 | — | 0 | 0.41 | 0.10 | 0.05 | 0.10 | 0.02 | 0.05 | 0.00 | 0.05 | 0.14 | 0.01 | 0.00 | 0.03 | 0.01 | 0.05 |
| SEQID-02165 | 291571410 | — | 1 | 0.48 | 0.24 | 0.06 | 0.04 | 0.06 | 0.05 | 0.00 | 0.04 | 0.08 | 0.04 | 0.00 | 0.06 | 0.06 | 0.13 |
| SEQID-02166 | 291568589 | — | 0 | 0.48 | 0.25 | 0.12 | 0.04 | 0.06 | 0.07 | 0.02 | 0.03 | 0.02 | 0.05 | 0.01 | 0.03 | 0.11 | 0.10 |
| SEQID-02167 | P48852 | — | 0 | 0.48 | 0.24 | 0.05 | 0.16 | 0.01 | 0.09 | 0.02 | 0.08 | 0.08 | 0.03 | 0.03 | 0.05 | 0.09 | 0.05 |
| SEQID-02168 | 291567795 | — | 0 | 0.51 | 0.21 | 0.04 | 0.12 | 0.03 | 0.04 | 0.02 | 0.04 | 0.04 | 0.10 | 0.03 | 0.04 | 0.04 | 0.09 |
| SEQID-02168 | 291566622 | — | 0 | 0.41 | 0.22 | 0.04 | 0.07 | 0.04 | 0.06 | 0.00 | 0.08 | 0.13 | 0.00 | 0.03 | 0.03 | 0.14 | 0.15 |

TABLE 1-continued

| | | | | | | | | | | | | | | |
|---|---|---|---|---|---|---|---|---|---|---|---|---|---|---|
| SEQID-02169 | 406713351 | — | — | 0 | 0.53 | 0.26 | 0.05 | 0.03 | 0.04 | 0.02 | 0.00 | 0.05 | 0.09 | 0.03 | 0.00 | 0.05 | 0.09 | 0.09 |
| SEQID-02170 | 291567797 | — | — | 1 | 0.50 | 0.23 | 0.04 | 0.03 | 0.04 | 0.03 | 0.01 | 0.03 | 0.06 | 0.04 | 0.02 | 0.09 | 0.09 | 0.08 |
| SEQID-02171 | 291565935 | — | — | 0 | 0.45 | 0.26 | 0.03 | 0.15 | 0.02 | 0.02 | 0.00 | 0.07 | 0.09 | 0.04 | 0.01 | 0.12 | 0.04 | 0.08 |
| SEQID-02172 | 406712927 | — | — | 1 | 0.48 | 0.23 | 0.07 | 0.17 | 0.06 | 0.02 | 0.01 | 0.05 | 0.06 | 0.03 | 0.02 | 0.05 | 0.12 | 0.07 |
| SEQID-02173 | 291569027 | — | — | 1 | 0.51 | 0.26 | 0.07 | 0.05 | 0.04 | 0.03 | 0.01 | 0.03 | 0.13 | 0.05 | 0.01 | 0.03 | 0.10 | 0.09 |
| SEQID-02174 | 291566287 | — | — | 1 | 0.47 | 0.26 | 0.05 | 0.03 | 0.04 | 0.06 | 0.01 | 0.09 | 0.07 | 0.04 | 0.01 | 0.06 | 0.13 | 0.04 |
| SEQID-02175 | 406715357 | — | — | 1 | 0.58 | 0.34 | 0.06 | 0.06 | 0.04 | 0.03 | 0.01 | 0.05 | 0.05 | 0.04 | 0.01 | 0.07 | 0.17 | 0.01 |
| SEQID-02176 | 406715137 | — | — | 1 | 0.45 | 0.26 | 0.06 | 0.04 | 0.04 | 0.03 | 0.02 | 0.03 | 0.13 | 0.05 | 0.02 | 0.02 | 0.11 | 0.06 |
| SEQID-02177 | 406710703 | — | — | 1 | 0.40 | 0.15 | 0.05 | 0.06 | 0.00 | 0.03 | 0.01 | 0.07 | 0.08 | 0.04 | 0.02 | 0.09 | 0.07 | 0.05 |
| SEQID-02178 | 291570307 | — | — | 1 | 0.61 | 0.27 | 0.03 | 0.05 | 0.03 | 0.02 | 0.01 | 0.05 | 0.04 | 0.06 | 0.02 | 0.09 | 0.09 | 0.05 |
| SEQID-02179 | 291569898 | — | — | 1 | 0.49 | 0.28 | 0.06 | 0.04 | 0.03 | 0.04 | 0.01 | 0.07 | 0.03 | 0.04 | 0.02 | 0.07 | 0.11 | 0.05 |
| SEQID-02180 | 291570674 | — | — | 1 | 0.45 | 0.27 | 0.03 | 0.04 | 0.06 | 0.04 | 0.01 | 0.03 | 0.06 | 0.05 | 0.02 | 0.08 | 0.10 | 0.06 |
| SEQID-02181 | 291565912 | — | — | 1 | 0.44 | 0.23 | 0.07 | 0.09 | 0.04 | 0.05 | 0.01 | 0.08 | 0.09 | 0.05 | 0.01 | 0.06 | 0.10 | 0.02 |
| SEQID-02182 | 406714269 | — | — | 1 | 0.47 | 0.22 | 0.03 | 0.08 | 0.02 | 0.05 | 0.01 | 0.06 | 0.10 | 0.03 | 0.02 | 0.07 | 0.08 | 0.06 |
| SEQID-02183 | 291571644 | — | — | 1 | 0.43 | 0.26 | 0.05 | 0.08 | 0.03 | 0.07 | 0.01 | 0.07 | 0.05 | 0.04 | 0.02 | 0.10 | 0.10 | 0.06 |
| SEQID-02184 | 291567308 | — | — | 1 | 0.44 | 0.25 | 0.06 | 0.05 | 0.05 | 0.08 | 0.01 | 0.06 | 0.09 | 0.03 | 0.02 | 0.08 | 0.10 | 0.07 |
| SEQID-02185 | 291571141 | — | — | 1 | 0.45 | 0.23 | 0.03 | 0.08 | 0.05 | 0.07 | 0.01 | 0.06 | 0.10 | 0.04 | 0.03 | 0.08 | 0.11 | 0.06 |
| SEQID-02186 | 406714429 | — | — | 1 | 0.57 | 0.26 | 0.08 | 0.03 | 0.02 | 0.07 | 0.02 | 0.05 | 0.06 | 0.05 | 0.03 | 0.05 | 0.09 | 0.06 |
| SEQID-02187 | 291566376 | — | — | 1 | 0.46 | 0.19 | 0.04 | 0.06 | 0.04 | 0.04 | 0.01 | 0.04 | 0.04 | 0.03 | 0.05 | 0.05 | 0.14 | 0.03 |
| SEQID-02188 | 291570198 | — | — | 1 | 0.43 | 0.19 | 0.06 | 0.09 | 0.03 | 0.04 | 0.01 | 0.04 | 0.07 | 0.05 | 0.01 | 0.05 | 0.09 | 0.05 |
| SEQID-02189 | 406715783 | — | — | 1 | 0.50 | 0.17 | 0.06 | 0.06 | 0.03 | 0.03 | 0.02 | 0.03 | 0.10 | 0.04 | 0.03 | 0.03 | 0.06 | 0.02 |
| SEQID-02190 | 291568888 | — | — | 1 | 0.46 | 0.24 | 0.08 | 0.06 | 0.04 | 0.05 | 0.02 | 0.04 | 0.07 | 0.06 | 0.04 | 0.07 | 0.11 | 0.07 |
| SEQID-02191 | 291569924 | — | — | 1 | 0.47 | 0.26 | 0.03 | 0.06 | 0.03 | 0.05 | 0.02 | 0.05 | 0.06 | 0.06 | 0.01 | 0.08 | 0.09 | 0.06 |
| SEQID-02192 | 406712516 | — | — | 1 | 0.46 | 0.23 | 0.09 | 0.06 | 0.04 | 0.06 | 0.00 | 0.08 | 0.07 | 0.07 | 0.02 | 0.05 | 0.12 | 0.06 |
| SEQID-02193 | 291568241 | — | — | 0 | 0.53 | 0.24 | 0.08 | 0.05 | 0.06 | 0.05 | 0.00 | 0.04 | 0.05 | 0.04 | 0.02 | 0.07 | 0.08 | 0.05 |
| SEQID-02194 | 291571841 | — | — | 0 | 0.47 | 0.34 | 0.07 | 0.04 | 0.03 | 0.03 | 0.01 | 0.06 | 0.05 | 0.05 | 0.00 | 0.10 | 0.17 | 0.03 |
| SEQID-02195 | 406712605 | — | — | 1 | 0.43 | 0.30 | 0.06 | 0.09 | 0.04 | 0.04 | 0.01 | 0.04 | 0.08 | 0.05 | 0.00 | 0.08 | 0.14 | 0.02 |
| SEQID-02196 | 291567555 | — | — | 1 | 0.54 | 0.27 | 0.07 | 0.09 | 0.03 | 0.05 | 0.01 | 0.06 | 0.09 | 0.03 | 0.01 | 0.08 | 0.07 | 0.05 |
| SEQID-02197 | 291569604 | — | — | 1 | 0.38 | 0.15 | 0.07 | 0.04 | 0.01 | 0.03 | 0.02 | 0.03 | 0.05 | 0.07 | 0.01 | 0.10 | 0.10 | 0.02 |
| SEQID-02198 | 406713974 | — | — | 1 | 0.41 | 0.23 | 0.05 | 0.03 | 0.06 | 0.08 | 0.01 | 0.02 | 0.20 | 0.05 | 0.00 | 0.02 | 0.05 | 0.09 |
| SEQID-02199 | 291571795 | — | — | 1 | 0.44 | 0.24 | 0.06 | 0.04 | 0.04 | 0.09 | 0.00 | 0.05 | 0.05 | 0.07 | 0.00 | 0.05 | 0.09 | 0.01 |
| SEQID-02200 | 291570843 | — | — | 1 | 0.43 | 0.19 | 0.06 | 0.07 | 0.03 | 0.07 | 0.00 | 0.08 | 0.07 | 0.04 | 0.03 | 0.08 | 0.11 | 0.06 |
| SEQID-02201 | 291569589 | — | — | 1 | 0.43 | 0.22 | 0.07 | 0.08 | 0.06 | 0.07 | 0.01 | 0.04 | 0.06 | 0.05 | 0.02 | 0.08 | 0.07 | 0.05 |
| SEQID-02202 | 291569371 | — | — | 1 | 0.46 | 0.19 | 0.05 | 0.08 | 0.04 | 0.05 | 0.02 | 0.04 | 0.08 | 0.05 | 0.03 | 0.05 | 0.07 | 0.04 |
| SEQID-02203 | 291566291 | — | — | 1 | 0.42 | 0.19 | 0.04 | 0.09 | 0.03 | 0.06 | 0.01 | 0.05 | 0.09 | 0.06 | 0.03 | 0.06 | 0.09 | 0.06 |
| SEQID-02204 | 291568479 | — | — | 1 | 0.48 | 0.21 | 0.06 | 0.07 | 0.03 | 0.07 | 0.01 | 0.05 | 0.11 | 0.05 | 0.03 | 0.07 | 0.09 | 0.07 |
| SEQID-02205 | 291566322 | — | — | 1 | 0.45 | 0.22 | 0.04 | 0.09 | 0.04 | 0.06 | 0.01 | 0.07 | 0.14 | 0.02 | 0.03 | 0.06 | 0.10 | 0.05 |
| SEQID-02206 | 291567103 | — | — | 1 | 0.49 | 0.24 | 0.06 | 0.06 | 0.03 | 0.06 | 0.01 | 0.02 | 0.09 | 0.03 | 0.01 | 0.10 | 0.10 | 0.04 |
| SEQID-02207 | 13JEK7 | — | — | 1 | 0.40 | 0.18 | 0.04 | 0.10 | 0.04 | 0.06 | 0.03 | 0.10 | 0.18 | 0.04 | 0.02 | 0.06 | 0.11 | 0.09 |
| SEQID-02208 | 13KK23 | — | — | 1 | 0.46 | 0.20 | 0.05 | 0.08 | 0.05 | 0.06 | 0.00 | 0.06 | 0.11 | 0.03 | 0.02 | 0.05 | 0.06 | 0.13 |
| SEQID-02209 | 13JYT9 | — | — | 1 | 0.47 | 0.18 | 0.05 | 0.07 | 0.03 | 0.07 | 0.01 | 0.03 | 0.08 | 0.05 | 0.03 | 0.05 | 0.08 | 0.13 |
| SEQID-02210 | 13JYT8 | — | — | 1 | 0.45 | 0.19 | 0.05 | 0.05 | 0.05 | 0.07 | 0.01 | 0.05 | 0.03 | 0.04 | 0.04 | 0.04 | 0.10 | 0.12 |
| SEQID-02211 | 13KLJ9 | — | — | 1 | 0.44 | 0.18 | 0.04 | 0.07 | 0.04 | 0.04 | 0.01 | 0.03 | 0.09 | 0.04 | 0.03 | 0.04 | 0.09 | 0.11 |
| SEQID-02212 | 13IZU1 | — | — | 1 | 0.47 | 0.20 | 0.06 | 0.06 | 0.03 | 0.03 | 0.02 | 0.04 | 0.12 | 0.03 | 0.02 | 0.06 | 0.07 | 0.11 |
| SEQID-02213 | 13JK022 | — | — | 1 | 0.46 | 0.19 | 0.06 | 0.07 | 0.06 | 0.05 | 0.01 | 0.02 | 0.14 | 0.02 | 0.03 | 0.05 | 0.09 | 0.11 |
| SEQID-02214 | 13IZY3 | — | — | 1 | 0.49 | 0.24 | 0.06 | 0.07 | 0.04 | 0.06 | 0.01 | 0.07 | 0.09 | 0.07 | 0.01 | 0.07 | 0.10 | 0.07 |
| SEQID-02215 | 13JK5K1 | — | — | 1 | 0.40 | 0.18 | 0.06 | 0.06 | 0.04 | 0.05 | 0.00 | 0.10 | 0.18 | 0.03 | 0.02 | 0.03 | 0.10 | 0.12 |
| SEQID-02216 | 13IUB3 | — | — | 1 | 0.46 | 0.20 | 0.05 | 0.10 | 0.05 | 0.05 | 0.01 | 0.06 | 0.11 | 0.02 | 0.02 | 0.07 | 0.09 | 0.07 |
| SEQID-02217 | 13IZY1 | — | — | 1 | 0.47 | 0.19 | 0.05 | 0.08 | 0.05 | 0.06 | 0.02 | 0.03 | 0.08 | 0.02 | 0.04 | 0.03 | 0.09 | 0.09 |
| SEQID-02218 | 13KK81 | — | — | 1 | 0.46 | 0.20 | 0.05 | 0.06 | 0.03 | 0.05 | 0.01 | 0.05 | 0.03 | 0.03 | 0.04 | 0.04 | 0.06 | 0.06 |
| SEQID-02219 | 13IZX8 | — | — | 1 | 0.51 | 0.19 | 0.05 | 0.07 | 0.05 | 0.07 | 0.01 | 0.07 | 0.09 | 0.03 | 0.03 | 0.08 | 0.07 | 0.10 |
| SEQID-02220 | 13JT59 | — | — | 1 | 0.45 | 0.18 | 0.05 | 0.07 | 0.04 | 0.07 | 0.01 | 0.07 | 0.15 | 0.02 | 0.03 | 0.05 | 0.11 | 0.12 |
| SEQID-02221 | 13IZY5 | — | — | 1 | 0.49 | 0.20 | 0.05 | 0.05 | 0.05 | 0.05 | 0.01 | 0.04 | 0.03 | 0.03 | 0.02 | 0.07 | 0.08 | 0.03 |

TABLE 1-continued

| | | | | | | | | | | | | | | | |
|---|---|---|---|---|---|---|---|---|---|---|---|---|---|---|---|
| SEQID-02222 | I3KZ16 | — | — | 1 | 0.45 | 0.18 | 0.05 | 0.07 | 0.05 | 0.05 | 0.01 | 0.07 | 0.15 | 0.02 | 0.02 | 0.04 | 0.11 | 0.12 |
| SEQID-02223 | I3KXM4 | — | — | 1 | 0.48 | 0.23 | 0.04 | 0.06 | 0.05 | 0.05 | 0.01 | 0.03 | 0.09 | 0.04 | 0.01 | 0.06 | 0.07 | 0.09 |
| SEQID-02224 | I3JD0 | — | — | 1 | 0.47 | 0.19 | 0.05 | 0.06 | 0.03 | 0.05 | 0.02 | 0.03 | 0.03 | 0.04 | 0.03 | 0.06 | 0.06 | 0.09 |
| SEQID-02225 | I3JDJ1 | — | — | 1 | 0.47 | 0.20 | 0.05 | 0.07 | 0.04 | 0.05 | 0.01 | 0.03 | 0.08 | 0.05 | 0.03 | 0.04 | 0.09 | 0.03 |
| SEQID-02226 | I3KFP0 | — | — | 1 | 0.50 | 0.22 | 0.02 | 0.06 | 0.05 | 0.07 | 0.01 | 0.03 | 0.09 | 0.05 | 0.05 | 0.04 | 0.11 | 0.09 |
| SEQID-02227 | I3JE80 | — | — | 1 | 0.43 | 0.20 | 0.07 | 0.06 | 0.05 | 0.06 | 0.01 | 0.05 | 0.10 | 0.03 | 0.03 | 0.05 | 0.09 | 0.07 |
| SEQID-02228 | I3KW15 | — | — | 1 | 0.45 | 0.21 | 0.04 | 0.06 | 0.04 | 0.04 | 0.02 | 0.02 | 0.07 | 0.04 | 0.02 | 0.06 | 0.11 | 0.08 |
| SEQID-02229 | I3KVU7 | — | — | 1 | 0.43 | 0.20 | 0.07 | 0.09 | 0.06 | 0.06 | 0.01 | 0.04 | 0.10 | 0.04 | 0.02 | 0.06 | 0.09 | 0.11 |
| SEQID-02230 | I3JBN0 | — | — | 1 | 0.46 | 0.20 | 0.05 | 0.05 | 0.05 | 0.05 | 0.01 | 0.05 | 0.09 | 0.03 | 0.04 | 0.06 | 0.08 | 0.07 |
| SEQID-02231 | I3K556 | — | — | 1 | 0.52 | 0.22 | 0.06 | 0.05 | 0.04 | 0.06 | 0.01 | 0.02 | 0.06 | 0.03 | 0.04 | 0.07 | 0.05 | 0.10 |
| SEQID-02232 | I3J7R3 | — | — | 1 | 0.47 | 0.21 | 0.04 | 0.07 | 0.04 | 0.06 | 0.02 | 0.04 | 0.11 | 0.03 | 0.05 | 0.05 | 0.10 | 0.07 |
| SEQID-02233 | I3JSS0 | — | — | 1 | 0.47 | 0.18 | 0.04 | 0.05 | 0.04 | 0.05 | 0.01 | 0.04 | 0.07 | 0.03 | 0.03 | 0.05 | 0.09 | 0.07 |
| SEQID-02234 | I3JKR2 | — | — | 1 | 0.49 | 0.22 | 0.06 | 0.05 | 0.05 | 0.07 | 0.01 | 0.03 | 0.08 | 0.02 | 0.04 | 0.07 | 0.08 | 0.08 |
| SEQID-02235 | I3JL13 | — | — | 1 | 0.49 | 0.21 | 0.02 | 0.03 | 0.04 | 0.04 | 0.01 | 0.03 | 0.08 | 0.05 | 0.03 | 0.04 | 0.10 | 0.11 |
| SEQID-02236 | I3JRU6 | — | — | 1 | 0.48 | 0.20 | 0.04 | 0.06 | 0.04 | 0.05 | 0.01 | 0.03 | 0.10 | 0.04 | 0.04 | 0.04 | 0.06 | 0.09 |
| SEQID-02237 | I3JS33 | — | — | 1 | 0.47 | 0.18 | 0.04 | 0.12 | 0.03 | 0.04 | 0.02 | 0.05 | 0.07 | 0.03 | 0.04 | 0.06 | 0.07 | 0.08 |
| SEQID-02238 | I3JXH7 | — | — | 1 | 0.42 | 0.13 | 0.05 | 0.15 | 0.01 | 0.06 | 0.00 | 0.05 | 0.19 | 0.01 | 0.03 | 0.04 | 0.07 | 0.19 |
| SEQID-02239 | I3JU24 | — | — | 1 | 0.47 | 0.18 | 0.06 | 0.04 | 0.05 | 0.07 | 0.01 | 0.04 | 0.12 | 0.03 | 0.01 | 0.04 | 0.07 | 0.11 |
| SEQID-02240 | I3JFQ4 | — | — | 1 | 0.46 | 0.20 | 0.04 | 0.07 | 0.04 | 0.06 | 0.02 | 0.03 | 0.09 | 0.04 | 0.02 | 0.05 | 0.07 | 0.08 |
| SEQID-02241 | I3K6V3 | — | — | 0 | 0.46 | 0.20 | 0.05 | 0.04 | 0.06 | 0.06 | 0.02 | 0.03 | 0.06 | 0.04 | 0.05 | 0.04 | 0.11 | 0.07 |
| SEQID-02242 | I3IXG2 | — | — | 1 | 0.45 | 0.16 | 0.03 | 0.05 | 0.03 | 0.04 | 0.01 | 0.04 | 0.10 | 0.07 | 0.03 | 0.04 | 0.07 | 0.11 |
| SEQID-02243 | I38Q1 | — | — | 1 | 0.57 | 0.28 | 0.05 | 0.11 | 0.05 | 0.06 | 0.01 | 0.08 | 0.13 | 0.02 | 0.02 | 0.05 | 0.09 | 0.06 |
| SEQID-02244 | I3JXH4 | — | — | 1 | 0.44 | 0.18 | 0.08 | 0.09 | 0.08 | 0.04 | 0.01 | 0.03 | 0.06 | 0.16 | 0.02 | 0.02 | 0.05 | 0.05 |
| SEQID-02245 | I3JN20 | — | — | 0 | 0.48 | 0.23 | 0.07 | 0.05 | 0.07 | 0.06 | 0.02 | 0.03 | 0.11 | 0.04 | 0.03 | 0.05 | 0.05 | 0.12 |
| SEQID-02246 | I3JXF9 | — | — | 1 | 0.26 | 0.10 | 0.11 | 0.05 | 0.04 | 0.04 | 0.00 | 0.02 | 0.09 | 0.03 | 0.04 | 0.09 | 0.07 | 0.09 |
| SEQID-02247 | I3KFU1 | — | — | 1 | 0.40 | 0.18 | 0.06 | 0.06 | 0.04 | 0.07 | 0.01 | 0.03 | 0.10 | 0.04 | 0.03 | 0.05 | 0.10 | 0.19 |
| SEQID-02248 | I3KSF9 | — | — | 1 | 0.45 | 0.18 | 0.07 | 0.03 | 0.04 | 0.05 | 0.00 | 0.07 | 0.07 | 0.06 | 0.04 | 0.04 | 0.06 | 0.06 |
| SEQID-02249 | I3JGN1 | — | — | 1 | 0.50 | 0.22 | 0.06 | 0.13 | 0.04 | 0.08 | 0.02 | 0.04 | 0.06 | 0.05 | 0.03 | 0.08 | 0.09 | 0.11 |
| SEQID-02250 | I3MB4 | — | — | 0 | 0.26 | 0.09 | 0.08 | 0.08 | 0.08 | 0.25 | 0.00 | 0.04 | 0.06 | 0.15 | 0.01 | 0.07 | 0.04 | 0.11 |
| SEQID-02251 | I3KBQ8 | — | — | 0 | 0.25 | 0.09 | 0.07 | 0.09 | 0.02 | 0.09 | 0.02 | 0.04 | 0.07 | 0.16 | 0.01 | 0.02 | 0.04 | 0.14 |
| SEQID-02252 | I3KB11 | — | — | 1 | 0.45 | 0.17 | 0.07 | 0.06 | 0.03 | 0.05 | 0.01 | 0.04 | 0.11 | 0.07 | 0.02 | 0.06 | 0.05 | 0.10 |
| SEQID-02253 | I3KBN9 | — | — | 1 | 0.44 | 0.18 | 0.03 | 0.03 | 0.04 | 0.04 | 0.01 | 0.03 | 0.07 | 0.05 | 0.05 | 0.06 | 0.10 | 0.10 |
| SEQID-02254 | I3JN20 | — | — | 1 | 0.48 | 0.23 | 0.07 | 0.06 | 0.05 | 0.06 | 0.02 | 0.03 | 0.10 | 0.03 | 0.01 | 0.09 | 0.05 | 0.12 |
| SEQID-02255 | I3KMQ5 | — | — | 1 | 0.53 | 0.21 | 0.06 | 0.06 | 0.03 | 0.08 | 0.02 | 0.04 | 0.09 | 0.04 | 0.03 | 0.05 | 0.07 | 0.09 |
| SEQID-02256 | I3JQE5 | — | — | 1 | 0.41 | 0.14 | 0.04 | 0.13 | 0.04 | 0.07 | 0.02 | 0.07 | 0.10 | 0.04 | 0.03 | 0.04 | 0.10 | 0.19 |
| SEQID-02257 | I3K5C3 | — | — | 1 | 0.49 | 0.21 | 0.05 | 0.05 | 0.05 | 0.05 | 0.01 | 0.04 | 0.07 | 0.05 | 0.03 | 0.04 | 0.06 | 0.06 |
| SEQID-02258 | I3KL70 | — | — | 1 | 0.51 | 0.23 | 0.06 | 0.04 | 0.06 | 0.08 | 0.01 | 0.08 | 0.06 | 0.06 | 0.03 | 0.08 | 0.07 | 0.11 |
| SEQID-02259 | I3KER1 | — | — | 0 | 0.42 | 0.18 | 0.05 | 0.11 | 0.03 | 0.05 | 0.04 | 0.03 | 0.08 | 0.02 | 0.01 | 0.07 | 0.06 | 0.11 |
| SEQID-02260 | I3KCM4 | — | — | 1 | 0.42 | 0.20 | 0.03 | 0.02 | 0.02 | 0.05 | 0.01 | 0.02 | 0.14 | 0.06 | 0.01 | 0.03 | 0.07 | 0.06 |
| SEQID-02261 | I3820 | — | — | 0 | 0.48 | 0.25 | 0.06 | 0.07 | 0.01 | 0.09 | 0.03 | 0.03 | 0.11 | 0.05 | 0.04 | 0.05 | 0.08 | 0.14 |
| SEQID-02262 | I3KM40 | — | — | 1 | 0.50 | 0.20 | 0.04 | 0.08 | 0.04 | 0.04 | 0.01 | 0.03 | 0.09 | 0.04 | 0.01 | 0.05 | 0.10 | 0.10 |
| SEQID-02263 | I3K3X8 | — | — | 1 | 0.52 | 0.20 | 0.06 | 0.05 | 0.04 | 0.06 | 0.02 | 0.04 | 0.10 | 0.05 | 0.04 | 0.04 | 0.06 | 0.10 |
| SEQID-02264 | I3IZI3 | — | — | 1 | 0.46 | 0.19 | 0.07 | 0.07 | 0.04 | 0.04 | 0.04 | 0.03 | 0.03 | 0.03 | 0.01 | 0.04 | 0.09 | 0.09 |
| SEQID-02265 | I3IU19 | — | — | 0 | 0.42 | 0.17 | 0.03 | 0.03 | 0.03 | 0.05 | 0.03 | 0.06 | 0.09 | 0.04 | 0.06 | 0.06 | 0.09 | 0.06 |
| SEQID-02266 | I3IY11 | — | — | 1 | 0.48 | 0.20 | 0.05 | 0.06 | 0.05 | 0.05 | 0.02 | 0.03 | 0.17 | 0.03 | 0.00 | 0.07 | 0.09 | 0.10 |
| SEQID-02267 | I3KXA2 | — | — | 1 | 0.50 | 0.21 | 0.04 | 0.07 | 0.04 | 0.04 | 0.03 | 0.04 | 0.09 | 0.05 | 0.02 | 0.07 | 0.09 | 0.11 |
| SEQID-02268 | I3K8C6 | — | — | 1 | 0.45 | 0.20 | 0.05 | 0.06 | 0.05 | 0.04 | 0.01 | 0.02 | 0.09 | 0.05 | 0.03 | 0.09 | 0.06 | 0.12 |
| SEQID-02269 | I3I2N6 | — | — | 1 | 0.51 | 0.22 | 0.04 | 0.07 | 0.04 | 0.06 | 0.02 | 0.03 | 0.05 | 0.03 | 0.02 | 0.06 | 0.06 | 0.09 |
| SEQID-02270 | I3JPF4 | — | — | 1 | 0.46 | 0.20 | 0.04 | 0.09 | 0.04 | 0.04 | 0.01 | 0.03 | 0.07 | 0.04 | 0.04 | 0.04 | 0.10 | 0.05 |
| SEQID-02271 | I3JTN2 | — | — | 1 | 0.44 | 0.20 | 0.04 | 0.05 | 0.04 | 0.07 | 0.02 | 0.04 | 0.11 | 0.04 | 0.04 | 0.05 | 0.05 | 0.09 |
| SEQID-02272 | P60713 | — | — | 1 | 0.47 | 0.20 | 0.05 | 0.07 | 0.05 | 0.06 | 0.01 | 0.04 | 0.08 | 0.04 | 0.03 | 0.06 | 0.11 | 0.10 |
| SEQID-02273 | O13751 | — | — | 1 | 0.46 | 0.21 | 0.05 | 0.10 | 0.05 | 0.06 | 0.01 | 0.04 | 0.09 | 0.03 | 0.03 | 0.06 | 0.07 | 0.06 |
| SEQID-02274 | P14639 | — | — | 1 | 0.46 | 0.18 | 0.05 | 0.06 | 0.02 | 0.07 | 0.05 | 0.04 | 0.10 | 0.01 | 0.04 | 0.02 | 0.11 | 0.11 |

TABLE 1-continued

| SEQID | ID | | | | | | | | | | | | | |
|---|---|---|---|---|---|---|---|---|---|---|---|---|---|---|
| SEQID-02275 | B2MVW8 | — | 1 | 0.50 | 0.21 | 0.07 | 0.08 | 0.03 | 0.05 | 0.01 | 0.05 | 0.02 | 0.05 | 0.01 | 0.07 | 0.08 | 0.09 |
| SEQID-02276 | D7R7V6 | — | 1 | 0.53 | 0.22 | 0.06 | 0.04 | 0.06 | 0.06 | 0.01 | 0.03 | 0.05 | 0.05 | 0.04 | 0.07 | 0.06 | 0.09 |
| SEQID-02277 | C8BKC8 | — | 1 | 0.47 | 0.17 | 0.04 | 0.04 | 0.05 | 0.05 | 0.10 | 0.05 | 0.04 | 0.03 | 0.06 | 0.02 | 0.03 | 0.14 |
| SEQID-02278 | B7U168 | — | 1 | 0.47 | 0.20 | 0.07 | 0.07 | 0.02 | 0.03 | 0.02 | 0.04 | 0.06 | 0.04 | 0.02 | 0.03 | 0.09 | 0.03 |
| SEQID-02279 | B9VGZ8 | — | 1 | 0.47 | 0.16 | 0.06 | 0.06 | 0.05 | 0.09 | 0.01 | 0.05 | 0.10 | 0.05 | 0.01 | 0.06 | 0.05 | 0.10 |
| SEQID-02280 | Q9N116 | — | 1 | 0.43 | 0.23 | 0.05 | 0.08 | 0.02 | 0.06 | 0.03 | 0.06 | 0.09 | 0.02 | 0.02 | 0.07 | 0.08 | 0.08 |
| SEQID-02281 | Q9BF42 | — | 0 | 0.50 | 0.16 | 0.06 | 0.05 | 0.01 | 0.08 | 0.00 | 0.04 | 0.15 | 0.00 | 0.01 | 0.04 | 0.08 | 0.09 |
| SEQID-02282 | B2LU28 | — | 0 | 0.40 | 0.18 | 0.08 | 0.07 | 0.02 | 0.03 | 0.00 | 0.05 | 0.22 | 0.00 | 0.02 | 0.09 | 0.11 | 0.12 |
| SEQID-02283 | Q5N109 | — | 0 | 0.53 | 0.30 | 0.05 | 0.06 | 0.06 | 0.08 | 0.01 | 0.07 | 0.07 | 0.03 | 0.01 | 0.03 | 0.12 | 0.15 |
| SEQID-02284 | Q9BF43 | — | 0 | 0.49 | 0.14 | 0.07 | 0.04 | 0.02 | 0.06 | 0.00 | 0.04 | 0.12 | 0.03 | 0.02 | 0.03 | 0.03 | 0.09 |
| SEQID-02285 | Q9BF44 | — | 0 | 0.50 | 0.15 | 0.06 | 0.04 | 0.02 | 0.05 | 0.00 | 0.04 | 0.14 | 0.04 | 0.02 | 0.03 | 0.04 | 0.12 |
| SEQID-02286 | Q9N113 | — | 0 | 0.44 | 0.19 | 0.09 | 0.04 | 0.06 | 0.05 | 0.00 | 0.04 | 0.09 | 0.05 | 0.03 | 0.06 | 0.09 | 0.12 |
| SEQID-02287 | P68240 | — | 0 | 0.56 | 0.23 | 0.09 | 0.03 | 0.04 | 0.07 | 0.01 | 0.01 | 0.03 | 0.04 | 0.09 | 0.00 | 0.15 | 0.10 |
| SEQID-02288 | Q1A2D1 | — | 0 | 0.55 | 0.23 | 0.07 | 0.06 | 0.06 | 0.04 | 0.01 | 0.03 | 0.06 | 0.04 | 0.09 | 0.00 | 0.12 | 0.09 |
| SEQID-02289 | Q9N104 | — | 0 | 0.52 | 0.27 | 0.09 | 0.03 | 0.03 | 0.08 | 0.03 | 0.05 | 0.05 | 0.03 | 0.02 | 0.10 | 0.07 | 0.07 |
| SEQID-02290 | B6VCA9 | — | 0 | 0.50 | 0.16 | 0.05 | 0.04 | 0.06 | 0.04 | 0.00 | 0.05 | 0.12 | 0.03 | 0.01 | 0.05 | 0.06 | 0.12 |
| SEQID-02291 | B9VG25 | — | 1 | 0.57 | 0.32 | 0.05 | 0.05 | 0.03 | 0.08 | 0.01 | 0.04 | 0.05 | 0.05 | 0.02 | 0.09 | 0.15 | 0.10 |
| SEQID-02292 | Q7YS10 | — | 0 | 0.57 | 0.28 | 0.03 | 0.00 | 0.03 | 0.05 | 0.02 | 0.02 | 0.12 | 0.04 | 0.03 | 0.09 | 0.13 | 0.12 |
| SEQID-02293 | P79395 | — | 0 | 0.45 | 0.19 | 0.02 | 0.06 | 0.02 | 0.06 | 0.00 | 0.04 | 0.09 | 0.02 | 0.03 | 0.04 | 0.06 | 0.10 |
| SEQID-02294 | B0FZM4 | — | 0 | 0.47 | 0.21 | 0.03 | 0.05 | 0.06 | 0.07 | 0.00 | 0.02 | 0.09 | 0.05 | 0.03 | 0.04 | 0.10 | 0.10 |
| SEQID-02295 | C5IJA8 | — | 0 | 0.48 | 0.22 | 0.03 | 0.09 | 0.02 | 0.06 | 0.01 | 0.01 | 0.14 | 0.05 | 0.01 | 0.02 | 0.09 | 0.07 |
| SEQID-02296 | B2MVX2 | — | 0 | 0.51 | 0.22 | 0.06 | 0.09 | 0.03 | 0.05 | 0.01 | 0.04 | 0.11 | 0.06 | 0.01 | 0.05 | 0.09 | 0.11 |
| SEQID-02297 | H2DGR2 | — | 1 | 0.45 | 0.21 | 0.09 | 0.08 | 0.05 | 0.06 | 0.03 | 0.04 | 0.04 | 0.04 | 0.01 | 0.04 | 0.11 | 0.06 |
| SEQID-02298 | B0LRN3 | — | 0 | 0.41 | 0.19 | 0.05 | 0.18 | 0.01 | 0.07 | 0.00 | 0.05 | 0.09 | 0.03 | 0.02 | 0.07 | 0.03 | 0.09 |
| SEQID-02299 | Q35331 | — | 1 | 0.44 | 0.25 | 0.09 | 0.11 | 0.02 | 0.03 | 0.01 | 0.06 | 0.06 | 0.05 | 0.03 | 0.06 | 0.09 | 0.10 |
| SEQID-02300 | B2LSM3 | — | 1 | 0.38 | 0.16 | 0.03 | 0.12 | 0.04 | 0.05 | 0.01 | 0.05 | 0.09 | 0.03 | 0.02 | 0.07 | 0.09 | 0.06 |
| SEQID-02301 | B6E3I6 | — | 0 | 0.54 | 0.19 | 0.06 | 0.05 | 0.06 | 0.05 | 0.00 | 0.07 | 0.14 | 0.04 | 0.04 | 0.05 | 0.07 | 0.04 |
| SEQID-02302 | Q9N102 | — | 0 | 0.47 | 0.16 | 0.03 | 0.05 | 0.03 | 0.06 | 0.01 | 0.03 | 0.07 | 0.03 | 0.05 | 0.05 | 0.11 | 0.08 |
| SEQID-02303 | Q5ENY9 | — | 0 | 0.48 | 0.19 | 0.06 | 0.06 | 0.05 | 0.06 | 0.03 | 0.05 | 0.04 | 0.04 | 0.05 | 0.05 | 0.05 | 0.08 |
| SEQID-02304 | O78750 | — | 1 | 0.56 | 0.27 | 0.07 | 0.11 | 0.01 | 0.02 | 0.00 | 0.04 | 0.09 | 0.05 | 0.06 | 0.06 | 0.08 | 0.06 |
| SEQID-02305 | P29361 | — | 1 | 0.39 | 0.18 | 0.06 | 0.04 | 0.02 | 0.04 | 0.01 | 0.04 | 0.07 | 0.02 | 0.03 | 0.08 | 0.14 | 0.03 |
| SEQID-02306 | Q00555 | — | 1 | 0.53 | 0.26 | 0.03 | 0.07 | 0.04 | 0.06 | 0.01 | 0.05 | 0.14 | 0.02 | 0.00 | 0.04 | 0.10 | 0.09 |
| SEQID-02307 | B7U9A4 | — | 1 | 0.45 | 0.25 | 0.06 | 0.03 | 0.03 | 0.04 | 0.02 | 0.06 | 0.06 | 0.03 | 0.03 | 0.09 | 0.13 | 0.07 |
| SEQID-02308 | Q9M4M9 | — | 1 | 0.44 | 0.22 | 0.07 | 0.06 | 0.02 | 0.05 | 0.03 | 0.05 | 0.07 | 0.05 | 0.02 | 0.04 | 0.14 | 0.04 |
| SEQID-02309 | Q02096 | — | 1 | 0.47 | 0.21 | 0.03 | 0.05 | 0.05 | 0.04 | 0.01 | 0.04 | 0.09 | 0.05 | 0.01 | 0.05 | 0.11 | 0.09 |
| SEQID-02310 | P19464 | — | 1 | 0.50 | 0.21 | 0.05 | 0.05 | 0.05 | 0.04 | 0.03 | 0.03 | 0.12 | 0.03 | 0.03 | 0.08 | 0.07 | 0.07 |
| SEQID-02311 | P24465 | — | 1 | 0.52 | 0.26 | 0.04 | 0.08 | 0.04 | 0.06 | 0.01 | 0.02 | 0.09 | 0.03 | 0.03 | 0.06 | 0.10 | 0.09 |
| SEQID-02312 | Q7M224 | — | 1 | 0.47 | 0.20 | 0.06 | 0.06 | 0.04 | 0.04 | 0.01 | 0.05 | 0.14 | 0.03 | 0.04 | 0.07 | 0.14 | 0.06 |
| SEQID-02313 | Q9SEK6 | — | 1 | 0.47 | 0.19 | 0.04 | 0.08 | 0.04 | 0.04 | 0.00 | 0.04 | 0.10 | 0.04 | 0.02 | 0.05 | 0.07 | 0.11 |
| SEQID-02314 | Q9M4M7 | — | 1 | 0.48 | 0.22 | 0.04 | 0.05 | 0.04 | 0.05 | 0.01 | 0.05 | 0.06 | 0.05 | 0.03 | 0.05 | 0.09 | 0.08 |
| SEQID-02315 | P93680 | — | 1 | 0.37 | 0.16 | 0.07 | 0.06 | 0.05 | 0.06 | 0.03 | 0.06 | 0.10 | 0.05 | 0.04 | 0.05 | 0.08 | 0.06 |
| SEQID-02316 | Q9M7I8 | — | 1 | 0.54 | 0.21 | 0.06 | 0.02 | 0.02 | 0.07 | 0.00 | 0.03 | 0.02 | 0.07 | 0.06 | 0.04 | 0.07 | 0.04 |
| SEQID-02317 | B0FGG5 | — | 1 | 0.47 | 0.22 | 0.06 | 0.05 | 0.03 | 0.05 | 0.01 | 0.04 | 0.09 | 0.03 | 0.03 | 0.07 | 0.11 | 0.10 |
| SEQID-02318 | Q68YT2 | — | 0 | 0.44 | 0.06 | 0.02 | 0.00 | 0.04 | 0.10 | 0.02 | 0.13 | 0.09 | 0.10 | 0.10 | 0.03 | 0.07 | 0.09 |
| SEQID-02319 | P48686 | — | 1 | 0.46 | 0.19 | 0.06 | 0.03 | 0.03 | 0.06 | 0.00 | 0.03 | 0.09 | 0.05 | 0.04 | 0.03 | 0.01 | 0.21 |
| SEQID-02320 | A7XB47 | — | 1 | 0.52 | 0.22 | 0.06 | 0.05 | 0.05 | 0.06 | 0.02 | 0.04 | 0.03 | 0.05 | 0.03 | 0.04 | 0.09 | 0.06 |
| SEQID-02321 | Q6DV58 | — | 1 | 0.45 | 0.17 | 0.06 | 0.05 | 0.02 | 0.05 | 0.01 | 0.05 | 0.08 | 0.05 | 0.01 | 0.07 | 0.09 | 0.09 |
| SEQID-02322 | Q8GTA0 | — | 1 | 0.48 | 0.17 | 0.05 | 0.07 | 0.03 | 0.04 | 0.00 | 0.02 | 0.08 | 0.05 | 0.10 | 0.03 | 0.07 | 0.10 |
| SEQID-02323 | H6TDM4 | — | 1 | 0.45 | 0.18 | 0.06 | 0.05 | 0.02 | 0.05 | 0.06 | 0.03 | 0.03 | 0.04 | 0.10 | 0.02 | 0.10 | 0.03 |
| SEQID-02324 | Q9SE87 | — | 1 | 0.48 | 0.25 | 0.03 | 0.11 | 0.03 | 0.07 | 0.01 | 0.04 | 0.09 | 0.05 | 0.05 | 0.04 | 0.11 | 0.07 |
| SEQID-02325 | F8U7Z9 | — | 1 | 0.42 | 0.17 | 0.04 | 0.07 | 0.04 | 0.05 | 0.02 | 0.09 | 0.06 | 0.04 | 0.02 | 0.04 | 0.10 | 0.06 |
| SEQID-02326 | A7YX35 | — | 1 | 0.47 | 0.21 | 0.04 | 0.03 | 0.03 | 0.07 | 0.01 | 0.06 | 0.10 | 0.03 | 0.02 | 0.05 | 0.07 | 0.04 |
| SEQID-02327 | O82795 | — | 1 | 0.52 | 0.23 | 0.06 | 0.04 | 0.04 | 0.04 | 0.01 | 0.03 | 0.05 | 0.04 | 0.01 | 0.07 | 0.09 | 0.08 |

TABLE 1-continued

| | | | | | | | | | | | | | | | |
|---|---|---|---|---|---|---|---|---|---|---|---|---|---|---|---|
| SEQID-02328 | Q5DIU7 | — | — | 1 | 0.49 | 0.23 | 0.04 | 0.02 | 0.07 | 0.02 | 0.05 | 0.08 | 0.03 | 0.03 | 0.07 | 0.11 | 0.06 |
| SEQID-02329 | Q3HYA1 | — | — | 1 | 0.50 | 0.21 | 0.04 | 0.04 | 0.04 | 0.01 | 0.03 | 0.09 | 0.04 | 0.02 | 0.05 | 0.10 | 0.07 |
| SEQID-02330 | Q39366 | — | — | 1 | 0.46 | 0.21 | 0.03 | 0.04 | 0.03 | 0.00 | 0.03 | 0.10 | 0.05 | 0.01 | 0.05 | 0.08 | 0.02 |
| SEQID-02331 | Q6PY61 | — | — | 0 | 0.55 | 0.10 | 0.02 | 0.02 | 0.00 | 0.01 | 0.01 | 0.12 | 0.07 | 0.18 | 0.09 | 0.01 | 0.26 |
| SEQID-02332 | P09678 | — | — | 0 | 0.49 | 0.21 | 0.06 | 0.07 | 0.04 | 0.01 | 0.02 | 0.03 | 0.11 | 0.08 | 0.07 | 0.07 | 0.03 |
| SEQID-02333 | Q944W6 | — | — | 1 | 0.52 | 0.21 | 0.03 | 0.04 | 0.06 | 0.00 | 0.03 | 0.13 | 0.06 | 0.01 | 0.05 | 0.09 | 0.12 |
| SEQID-02334 | Q62292 | — | — | 1 | 0.47 | 0.20 | 0.06 | 0.04 | 0.07 | 0.01 | 0.03 | 0.03 | 0.04 | 0.00 | 0.05 | 0.11 | 0.10 |
| SEQID-02335 | D91762 | — | — | 1 | 0.44 | 0.22 | 0.06 | 0.04 | 0.06 | 0.02 | 0.02 | 0.09 | 0.02 | 0.03 | 0.07 | 0.09 | 0.10 |
| SEQID-02336 | I3Y171 | — | — | 1 | 0.47 | 0.21 | 0.06 | 0.04 | 0.05 | 0.01 | 0.04 | 0.10 | 0.07 | 0.03 | 0.03 | 0.12 | 0.06 |
| SEQID-02337 | Q4TU02 | — | — | 1 | 0.46 | 0.16 | 0.04 | 0.04 | 0.07 | 0.00 | 0.02 | 0.07 | 0.06 | 0.03 | 0.03 | 0.05 | 0.09 |
| SEQID-02338 | Q75UU6 | — | — | 1 | 0.47 | 0.21 | 0.07 | 0.02 | 0.06 | 0.01 | 0.04 | 0.08 | 0.06 | 0.06 | 0.06 | 0.08 | 0.09 |
| SEQID-02339 | O82549 | — | — | 1 | 0.46 | 0.20 | 0.04 | 0.03 | 0.04 | 0.00 | 0.02 | 0.07 | 0.06 | 0.01 | 0.06 | 0.08 | 0.10 |
| SEQID-02340 | P56294 | — | — | 0 | 0.42 | 0.25 | 0.07 | 0.03 | 0.08 | 0.01 | 0.05 | 0.08 | 0.04 | 0.05 | 0.09 | 0.07 | 0.06 |
| SEQID-02341 | P56307 | — | — | 1 | 0.51 | 0.21 | 0.06 | 0.03 | 0.08 | 0.01 | 0.03 | 0.07 | 0.06 | 0.01 | 0.08 | 0.10 | 0.06 |
| SEQID-02342 | P56308 | — | — | 1 | 0.52 | 0.22 | 0.06 | 0.03 | 0.08 | 0.01 | 0.02 | 0.05 | 0.07 | 0.03 | 0.05 | 0.09 | 0.03 |
| SEQID-02343 | P56319 | — | — | 1 | 0.55 | 0.21 | 0.05 | 0.04 | 0.06 | 0.01 | 0.02 | 0.05 | 0.06 | 0.04 | 0.06 | 0.10 | 0.03 |
| SEQID-02344 | P56341 | — | — | 1 | 0.56 | 0.23 | 0.06 | 0.04 | 0.04 | 0.00 | 0.05 | 0.03 | 0.05 | 0.03 | 0.05 | 0.11 | 0.02 |
| SEQID-02345 | P56342 | — | — | 1 | 0.55 | 0.22 | 0.06 | 0.03 | 0.04 | 0.01 | 0.04 | 0.05 | 0.05 | 0.07 | 0.07 | 0.11 | 0.03 |
| SEQID-02346 | Q8IIV4 | — | — | 0 | 0.39 | 0.17 | 0.06 | 0.03 | 0.06 | 0.00 | 0.08 | 0.18 | 0.05 | 0.07 | 0.06 | 0.12 | 0.02 |
| SEQID-02347 | Q8IJ07 | — | — | 1 | 0.43 | 0.13 | 0.03 | 0.03 | 0.11 | 0.00 | 0.05 | 0.10 | 0.02 | 0.02 | 0.02 | 0.10 | 0.13 |
| SEQID-02348 | Q98557 | — | — | 1 | 0.51 | 0.21 | 0.03 | 0.04 | 0.13 | 0.00 | 0.05 | 0.09 | 0.05 | 0.03 | 0.04 | 0.07 | 0.19 |
| SEQID-02349 | Q8AWX8 | — | — | 1 | 0.51 | 0.23 | 0.06 | 0.05 | 0.09 | 0.01 | 0.04 | 0.06 | 0.05 | 0.04 | 0.04 | 0.10 | 0.09 |
| SEQID-02350 | A7XA06 | — | — | 1 | 0.50 | 0.19 | 0.05 | 0.05 | 0.05 | 0.01 | 0.02 | 0.09 | 0.04 | 0.04 | 0.09 | 0.05 | 0.09 |
| SEQID-02351 | Q92079 | — | — | 1 | 0.53 | 0.21 | 0.02 | 0.06 | 0.08 | 0.02 | 0.02 | 0.09 | 0.06 | 0.06 | 0.04 | 0.11 | 0.03 |
| SEQID-02352 | O98734 | — | — | 0 | 0.39 | 0.16 | 0.04 | 0.05 | 0.02 | 0.01 | 0.07 | 0.08 | 0.03 | 0.04 | 0.09 | 0.08 | 0.08 |
| SEQID-02353 | A7XA16 | — | — | 1 | 0.48 | 0.24 | 0.06 | 0.04 | 0.09 | 0.00 | 0.05 | 0.15 | 0.01 | 0.03 | 0.03 | 0.10 | 0.13 |
| SEQID-02354 | Q8QG69 | — | — | 1 | 0.49 | 0.17 | 0.04 | 0.03 | 0.09 | 0.01 | 0.03 | 0.07 | 0.04 | 0.01 | 0.06 | 0.07 | 0.08 |
| SEQID-02355 | A5I873 | — | — | 0 | 0.49 | 0.18 | 0.10 | 0.00 | 0.07 | 0.02 | 0.02 | 0.10 | 0.04 | 0.00 | 0.04 | 0.10 | 0.16 |
| SEQID-02356 | A7XA17 | — | — | 1 | 0.43 | 0.17 | 0.14 | 0.04 | 0.01 | 0.03 | 0.03 | 0.09 | 0.02 | 0.09 | 0.05 | 0.08 | 0.13 |
| SEQID-02357 | A8CZC9 | — | — | 1 | 0.51 | 0.22 | 0.04 | 0.06 | 0.09 | 0.02 | 0.04 | 0.07 | 0.04 | 0.08 | 0.08 | 0.03 | 0.06 |
| SEQID-02358 | Q5XQ56 | — | — | 0 | 0.44 | 0.21 | 0.05 | 0.04 | 0.05 | 0.01 | 0.01 | 0.07 | 0.05 | 0.03 | 0.03 | 0.06 | 0.12 |
| SEQID-02359 | Q92079 | — | — | 1 | 0.44 | 0.19 | 0.12 | 0.01 | 0.06 | 0.02 | 0.02 | 0.06 | 0.03 | 0.05 | 0.04 | 0.11 | 0.06 |
| SEQID-02360 | O98734 | — | — | 1 | 0.41 | 0.17 | 0.07 | 0.03 | 0.04 | 0.00 | 0.04 | 0.05 | 0.06 | 0.04 | 0.05 | 0.07 | 0.03 |
| SEQID-02361 | F22AL7 | — | — | 0 | 0.38 | 0.23 | 0.04 | 0.04 | 0.08 | 0.04 | 0.01 | 0.07 | 0.07 | 0.02 | 0.07 | 0.09 | 0.05 |
| SEQID-02362 | F22AL8 | — | — | 0 | 0.36 | 0.18 | 0.10 | 0.05 | 0.09 | 0.04 | 0.03 | 0.04 | 0.06 | 0.03 | 0.06 | 0.08 | 0.05 |
| SEQID-02363 | I2FJT9 | — | — | 0 | 0.40 | 0.23 | 0.10 | 0.05 | 0.09 | 0.01 | 0.07 | 0.07 | 0.04 | 0.05 | 0.03 | 0.11 | 0.04 |
| SEQID-02364 | Q9HF8 | — | — | 1 | 0.46 | 0.21 | 0.06 | 0.06 | 0.07 | 0.02 | 0.05 | 0.05 | 0.05 | 0.04 | 0.03 | 0.08 | 0.03 |
| SEQID-02365 | I2FJU0 | — | — | 0 | 0.38 | 0.18 | 0.09 | 0.03 | 0.03 | 0.01 | 0.02 | 0.07 | 0.06 | 0.03 | 0.06 | 0.10 | 0.05 |
| SEQID-02366 | O98733 | — | — | 1 | 0.49 | 0.24 | 0.06 | 0.06 | 0.06 | 0.02 | 0.03 | 0.07 | 0.06 | 0.01 | 0.06 | 0.03 | 0.04 |
| SEQID-02367 | Q6TNX3 | — | — | 1 | 0.56 | 0.23 | 0.06 | 0.04 | 0.03 | 0.00 | 0.04 | 0.06 | 0.04 | 0.03 | 0.06 | 0.13 | 0.00 |
| SEQID-02368 | B3RG69 | — | — | 1 | 0.58 | 0.24 | 0.05 | 0.06 | 0.03 | 0.00 | 0.04 | 0.03 | 0.06 | 0.09 | 0.08 | 0.11 | 0.04 |
| SEQID-02369 | P84527 | — | — | 0 | 0.36 | 0.15 | 0.03 | 0.05 | 0.06 | 0.07 | 0.03 | 0.04 | 0.07 | 0.08 | 0.08 | 0.11 | 0.03 |
| SEQID-02370 | P81370 | — | — | 1 | 0.41 | 0.14 | 0.05 | 0.08 | 0.06 | 0.07 | 0.05 | 0.02 | 0.06 | 0.04 | 0.05 | 0.04 | 0.06 |
| SEQID-02371 | A5HI11 | — | — | 1 | 0.42 | 0.18 | 0.04 | 0.04 | 0.05 | 0.02 | 0.04 | 0.07 | 0.04 | 0.00 | 0.04 | 0.07 | 0.05 |
| SEQID-02372 | Q6TPK4 | — | — | 1 | 0.48 | 0.27 | 0.08 | 0.01 | 0.07 | 0.00 | 0.06 | 0.05 | 0.04 | 0.01 | 0.06 | 0.12 | 0.06 |
| SEQID-02373 | P85524 | — | — | 1 | 0.58 | 0.26 | 0.01 | 0.06 | 0.02 | 0.01 | 0.02 | 0.13 | 0.03 | 0.02 | 0.02 | 0.07 | 0.10 |
| SEQID-02374 | P85076 | — | — | 1 | 0.47 | 0.20 | 0.06 | 0.06 | 0.05 | 0.01 | 0.04 | 0.04 | 0.04 | 0.01 | 0.06 | 0.06 | 0.06 |
| SEQID-02375 | A5HI14 | — | — | 1 | 0.44 | 0.25 | 0.03 | 0.03 | 0.05 | 0.02 | 0.03 | 0.06 | 0.05 | 0.03 | 0.06 | 0.07 | 0.08 |
| SEQID-02376 | P43394 | — | — | 1 | 0.44 | 0.23 | 0.04 | 0.04 | 0.10 | 0.00 | 0.04 | 0.03 | 0.06 | 0.04 | 0.07 | 0.10 | 0.03 |
| SEQID-02377 | Q06AW1 | — | — | 1 | 0.39 | 0.19 | 0.04 | 0.04 | 0.11 | 0.01 | 0.08 | 0.09 | 0.05 | 0.04 | 0.06 | 0.11 | 0.03 |
| SEQID-02378 | Q06AW2 | — | — | 1 | 0.38 | 0.19 | 0.04 | 0.04 | 0.12 | 0.01 | 0.03 | 0.09 | 0.04 | 0.03 | 0.06 | 0.08 | 0.03 |
| SEQID-02379 | Q91B39 | — | — | 0 | 0.41 | 0.17 | 0.10 | 0.05 | 0.04 | 0.00 | 0.04 | 0.12 | 0.05 | 0.01 | 0.04 | 0.09 | 0.10 |
| SEQID-02380 | Q91B37 | — | — | 1 | 0.47 | 0.18 | 0.06 | 0.05 | 0.04 | 0.01 | 0.04 | 0.13 | 0.03 | 0.01 | 0.07 | 0.07 | 0.10 |

TABLE 1-continued

| | | | | | | | | | | | | | | | |
|---|---|---|---|---|---|---|---|---|---|---|---|---|---|---|---|
| SEQID-02381 | Q76CT4 | — | 0 | 0.41 | 0.18 | 0.07 | 0.05 | 0.02 | 0.08 | 0.00 | 0.05 | 0.23 | 0.01 | 0.01 | 0.04 | 0.12 | 0.15 |
| SEQID-02382 | B9WPP3 | — | 1 | 0.50 | 0.21 | 0.05 | 0.06 | 0.05 | 0.05 | 0.00 | 0.03 | 0.08 | 0.05 | 0.03 | 0.06 | 0.07 | 0.09 |
| SEQID-02383 | P02074 | — | 0 | 0.54 | 0.25 | 0.03 | 0.08 | 0.05 | 0.05 | 0.01 | 0.02 | 0.07 | 0.02 | 0.03 | 0.00 | 0.13 | 0.07 |
| SEQID-02384 | G3URG5 | — | 1 | 0.45 | 0.19 | 0.05 | 0.08 | 0.04 | 0.04 | 0.01 | 0.07 | 0.14 | 0.03 | 0.03 | 0.06 | 0.10 | 0.11 |
| SEQID-02385 | G3UV20 | — | 1 | 0.47 | 0.19 | 0.05 | 0.06 | 0.04 | 0.05 | 0.01 | 0.08 | 0.13 | 0.03 | 0.02 | 0.05 | 0.08 | 0.12 |
| SEQID-02386 | G1MUC5 | — | 1 | 0.48 | 0.19 | 0.06 | 0.10 | 0.05 | 0.04 | 0.00 | 0.05 | 0.09 | 0.03 | 0.03 | 0.06 | 0.11 | 0.10 |
| SEQID-02387 | G3US01 | — | 0 | 0.40 | 0.20 | 0.06 | 0.06 | 0.05 | 0.05 | 0.01 | 0.08 | 0.19 | 0.09 | 0.03 | 0.04 | 0.08 | 0.12 |
| SEQID-02388 | G1MSQ0 | — | 1 | 0.44 | 0.19 | 0.05 | 0.07 | 0.03 | 0.06 | 0.01 | 0.08 | 0.14 | 0.03 | 0.03 | 0.09 | 0.11 | 0.12 |
| SEQID-02389 | G1NIB8 | — | 1 | 0.46 | 0.20 | 0.05 | 0.07 | 0.04 | 0.06 | 0.01 | 0.03 | 0.09 | 0.02 | 0.02 | 0.04 | 0.07 | 0.06 |
| SEQID-02390 | G1NNJ7 | — | 1 | 0.45 | 0.19 | 0.05 | 0.03 | 0.05 | 0.06 | 0.01 | 0.07 | 0.15 | 0.04 | 0.02 | 0.04 | 0.11 | 0.12 |
| SEQID-02391 | G1MS62 | — | 1 | 0.44 | 0.19 | 0.06 | 0.08 | 0.05 | 0.05 | 0.01 | 0.07 | 0.15 | 0.05 | 0.02 | 0.04 | 0.11 | 0.12 |
| SEQID-02392 | G1MUV8 | — | 1 | 0.45 | 0.19 | 0.05 | 0.03 | 0.04 | 0.06 | 0.01 | 0.07 | 0.14 | 0.07 | 0.02 | 0.05 | 0.11 | 0.12 |
| SEQID-02393 | G1MT49 | — | 1 | 0.52 | 0.21 | 0.04 | 0.06 | 0.06 | 0.03 | 0.01 | 0.05 | 0.07 | 0.05 | 0.03 | 0.06 | 0.10 | 0.10 |
| SEQID-02394 | G1NMR6 | — | 1 | 0.52 | 0.22 | 0.07 | 0.05 | 0.05 | 0.06 | 0.01 | 0.02 | 0.04 | 0.02 | 0.04 | 0.06 | 0.06 | 0.09 |
| SEQID-02395 | G3URH1 | — | 0 | 0.39 | 0.20 | 0.06 | 0.12 | 0.04 | 0.06 | 0.01 | 0.09 | 0.17 | 0.09 | 0.01 | 0.05 | 0.11 | 0.11 |
| SEQID-02396 | G1MSA4 | — | 1 | 0.49 | 0.22 | 0.07 | 0.09 | 0.03 | 0.07 | 0.01 | 0.03 | 0.08 | 0.03 | 0.04 | 0.07 | 0.07 | 0.08 |
| SEQID-02397 | G1NGT5 | — | 1 | 0.44 | 0.19 | 0.05 | 0.06 | 0.05 | 0.06 | 0.00 | 0.07 | 0.11 | 0.02 | 0.03 | 0.07 | 0.09 | 0.07 |
| SEQID-02398 | G1NAX6 | — | 1 | 0.48 | 0.21 | 0.04 | 0.06 | 0.03 | 0.06 | 0.01 | 0.03 | 0.13 | 0.03 | 0.03 | 0.07 | 0.07 | 0.12 |
| SEQID-02399 | G1N679 | — | 1 | 0.57 | 0.28 | 0.04 | 0.04 | 0.04 | 0.06 | 0.01 | 0.02 | 0.06 | 0.04 | 0.07 | 0.09 | 0.10 | 0.10 |
| SEQID-02400 | G1NAN1 | — | 1 | 0.47 | 0.21 | 0.04 | 0.06 | 0.04 | 0.06 | 0.02 | 0.04 | 0.11 | 0.04 | 0.03 | 0.06 | 0.10 | 0.10 |
| SEQID-02401 | G1NS52 | — | 1 | 0.47 | 0.20 | 0.05 | 0.07 | 0.02 | 0.06 | 0.01 | 0.04 | 0.09 | 0.03 | 0.03 | 0.09 | 0.07 | 0.06 |
| SEQID-02402 | G1NAX9 | — | 1 | 0.47 | 0.20 | 0.04 | 0.04 | 0.03 | 0.04 | 0.02 | 0.04 | 0.12 | 0.02 | 0.02 | 0.05 | 0.06 | 0.11 |
| SEQID-02403 | G1NJG2 | — | 0 | 0.40 | 0.18 | 0.03 | 0.06 | 0.02 | 0.06 | 0.00 | 0.05 | 0.07 | 0.05 | 0.01 | 0.05 | 0.09 | 0.09 |
| SEQID-02404 | G1NCR2 | — | 1 | 0.43 | 0.18 | 0.04 | 0.06 | 0.03 | 0.07 | 0.05 | 0.05 | 0.23 | 0.05 | 0.01 | 0.04 | 0.11 | 0.15 |
| SEQID-02405 | G1NBA6 | — | 1 | 0.48 | 0.20 | 0.04 | 0.07 | 0.04 | 0.06 | 0.01 | 0.03 | 0.09 | 0.03 | 0.02 | 0.06 | 0.07 | 0.10 |
| SEQID-02406 | G3UPH8 | — | 1 | 0.49 | 0.18 | 0.04 | 0.05 | 0.05 | 0.05 | 0.01 | 0.04 | 0.06 | 0.04 | 0.04 | 0.05 | 0.07 | 0.08 |
| SEQID-02407 | G3UV10 | — | 1 | 0.54 | 0.23 | 0.05 | 0.09 | 0.03 | 0.09 | 0.01 | 0.06 | 0.09 | 0.05 | 0.02 | 0.06 | 0.09 | 0.03 |
| SEQID-02408 | G1N3D3 | — | 1 | 0.49 | 0.21 | 0.06 | 0.04 | 0.05 | 0.06 | 0.00 | 0.02 | 0.09 | 0.03 | 0.03 | 0.06 | 0.08 | 0.12 |
| SEQID-02409 | G1NJH3 | — | 1 | 0.42 | 0.14 | 0.06 | 0.06 | 0.02 | 0.07 | 0.02 | 0.05 | 0.06 | 0.01 | 0.05 | 0.12 | 0.09 | 0.20 |
| SEQID-02410 | G1NJH4 | — | 1 | 0.47 | 0.15 | 0.06 | 0.14 | 0.01 | 0.06 | 0.01 | 0.05 | 0.14 | 0.04 | 0.05 | 0.06 | 0.07 | 0.10 |
| SEQID-02411 | H9H166 | — | 1 | 0.47 | 0.21 | 0.03 | 0.14 | 0.03 | 0.07 | 0.01 | 0.02 | 0.15 | 0.04 | 0.04 | 0.05 | 0.08 | 0.10 |
| SEQID-02412 | G1NGV6 | — | 1 | 0.49 | 0.14 | 0.09 | 0.07 | 0.05 | 0.07 | 0.02 | 0.05 | 0.09 | 0.07 | 0.04 | 0.05 | 0.07 | 0.14 |
| SEQID-02413 | G1MYI4 | — | 1 | 0.46 | 0.16 | 0.05 | 0.04 | 0.04 | 0.08 | 0.00 | 0.06 | 0.06 | 0.01 | 0.04 | 0.07 | 0.10 | 0.07 |
| SEQID-02414 | G1NCR2 | — | 1 | 0.50 | 0.22 | 0.05 | 0.06 | 0.05 | 0.05 | 0.02 | 0.02 | 0.08 | 0.03 | 0.03 | 0.08 | 0.07 | 0.09 |
| SEQID-02415 | G1NBA6 | — | 1 | 0.48 | 0.21 | 0.06 | 0.09 | 0.05 | 0.07 | 0.01 | 0.03 | 0.06 | 0.05 | 0.01 | 0.04 | 0.11 | 0.09 |
| SEQID-02416 | G1N314 | — | 0 | 0.40 | 0.18 | 0.03 | 0.07 | 0.04 | 0.06 | 0.00 | 0.05 | 0.23 | 0.05 | 0.01 | 0.04 | 0.11 | 0.15 |
| SEQID-02417 | G1NBW3 | — | 1 | 0.43 | 0.18 | 0.05 | 0.06 | 0.02 | 0.05 | 0.00 | 0.05 | 0.09 | 0.05 | 0.02 | 0.06 | 0.07 | 0.10 |
| SEQID-02418 | G1N823 | — | 1 | 0.48 | 0.20 | 0.04 | 0.08 | 0.04 | 0.05 | 0.01 | 0.04 | 0.07 | 0.04 | 0.04 | 0.06 | 0.08 | 0.09 |
| SEQID-02419 | G3URJ0 | — | 1 | 0.54 | 0.31 | 0.04 | 0.04 | 0.03 | 0.05 | 0.03 | 0.04 | 0.06 | 0.04 | 0.06 | 0.12 | 0.04 | 0.03 |
| SEQID-02420 | G1NAZ1 | — | 1 | 0.49 | 0.21 | 0.05 | 0.09 | 0.05 | 0.07 | 0.01 | 0.02 | 0.09 | 0.05 | 0.03 | 0.06 | 0.09 | 0.09 |
| SEQID-02421 | G1NMV8 | — | 1 | 0.42 | 0.14 | 0.06 | 0.14 | 0.01 | 0.06 | 0.01 | 0.05 | 0.14 | 0.04 | 0.05 | 0.06 | 0.08 | 0.20 |
| SEQID-02422 | G1NNB7 | — | 1 | 0.47 | 0.15 | 0.06 | 0.07 | 0.03 | 0.07 | 0.01 | 0.02 | 0.15 | 0.04 | 0.05 | 0.05 | 0.09 | 0.10 |
| SEQID-02423 | G1MX98 | — | 1 | 0.49 | 0.21 | 0.05 | 0.04 | 0.02 | 0.06 | 0.02 | 0.05 | 0.09 | 0.02 | 0.04 | 0.06 | 0.06 | 0.10 |
| SEQID-02424 | G1MWY3 | — | 1 | 0.46 | 0.20 | 0.04 | 0.09 | 0.06 | 0.06 | 0.01 | 0.04 | 0.09 | 0.04 | 0.04 | 0.06 | 0.06 | 0.10 |
| SEQID-02425 | G1MXU8 | — | 1 | 0.45 | 0.22 | 0.05 | 0.06 | 0.05 | 0.05 | 0.03 | 0.04 | 0.07 | 0.03 | 0.04 | 0.07 | 0.10 | 0.09 |
| SEQID-02426 | G1N5J6 | — | 1 | 0.51 | 0.26 | 0.03 | 0.05 | 0.04 | 0.05 | 0.03 | 0.05 | 0.07 | 0.05 | 0.04 | 0.08 | 0.09 | 0.10 |
| SEQID-02427 | G1NGS2 | — | 1 | 0.46 | 0.20 | 0.05 | 0.06 | 0.03 | 0.04 | 0.01 | 0.04 | 0.03 | 0.02 | 0.02 | 0.06 | 0.09 | 0.06 |
| SEQID-02428 | G1NK94 | — | 1 | 0.46 | 0.17 | 0.04 | 0.08 | 0.04 | 0.06 | 0.03 | 0.04 | 0.07 | 0.04 | 0.04 | 0.06 | 0.09 | 0.07 |
| SEQID-02429 | G1MVKB | — | 1 | 0.45 | 0.19 | 0.05 | 0.07 | 0.05 | 0.04 | 0.01 | 0.02 | 0.10 | 0.06 | 0.03 | 0.05 | 0.07 | 0.03 |
| SEQID-02430 | G1NLT9 | — | 1 | 0.44 | 0.23 | 0.06 | 0.09 | 0.03 | 0.06 | 0.01 | 0.05 | 0.07 | 0.02 | 0.05 | 0.06 | 0.06 | 0.10 |
| SEQID-02431 | G1N2A4 | — | 1 | 0.43 | 0.18 | 0.04 | 0.04 | 0.04 | 0.04 | 0.02 | 0.06 | 0.09 | 0.04 | 0.04 | 0.04 | 0.08 | 0.06 |
| SEQID-02432 | G1MXB6 | — | 1 | 0.45 | 0.21 | 0.05 | 0.07 | 0.02 | 0.06 | 0.01 | 0.05 | 0.12 | 0.05 | 0.02 | 0.06 | 0.10 | 0.08 |
| SEQID-02433 | G1NAR9 | — | 0 | 0.49 | 0.24 | 0.04 | 0.06 | 0.06 | 0.04 | 0.01 | 0.02 | 0.09 | 0.05 | 0.02 | 0.04 | 0.10 | 0.10 |
| SEQID-02434 | G1MVB6 | — | 1 | 0.39 | 0.17 | 0.09 | 0.07 | 0.03 | 0.04 | 0.02 | 0.05 | 0.03 | 0.04 | 0.02 | 0.05 | 0.09 | 0.06 |
| SEQID-02435 | G1MT65 | — | 1 | 0.49 | 0.24 | 0.05 | 0.05 | 0.04 | 0.05 | 0.01 | 0.04 | 0.07 | 0.03 | 0.02 | 0.07 | 0.10 | 0.07 |
| | | | 1 | 0.48 | 0.21 | 0.04 | 0.07 | 0.03 | 0.07 | 0.02 | 0.04 | 0.15 | 0.07 | 0.02 | 0.07 | 0.09 | 0.09 |
| | | | 1 | | | | | | | | 0.04 | 0.07 | 0.02 | 0.02 | 0.07 | 0.07 | 0.06 |
| | | | | | | | | | | | | | | | | | 0.11 |

TABLE 1-continued

| SEQID | Name | | | | | | | | | | | | | | | |
|---|---|---|---|---|---|---|---|---|---|---|---|---|---|---|---|---|
| SEQID-02434 | G1N3V6 | — | 1 | 0.49 | 0.21 | 0.05 | 0.06 | 0.04 | 0.05 | 0.01 | 0.03 | 0.09 | 0.05 | 0.02 | 0.09 | 0.06 | 0.11 |
| SEQID-02435 | G1NMW0 | — | 1 | 0.43 | 0.22 | 0.06 | 0.06 | 0.05 | 0.09 | 0.01 | 0.03 | 0.09 | 0.04 | 0.02 | 0.06 | 0.09 | 0.07 |
| SEQID-02436 | G1NLY5 | — | 1 | 0.48 | 0.23 | 0.05 | 0.08 | 0.04 | 0.07 | 0.01 | 0.03 | 0.09 | 0.03 | 0.04 | 0.07 | 0.09 | 0.09 |
| SEQID-02437 | G1N9H8 | — | 0 | 0.58 | 0.25 | 0.08 | 0.03 | 0.03 | 0.05 | 0.01 | 0.02 | 0.05 | 0.03 | 0.09 | 0.06 | 0.11 | 0.10 |
| SEQID-02438 | G1N8B8 | — | 1 | 0.45 | 0.17 | 0.06 | 0.11 | 0.03 | 0.06 | 0.01 | 0.05 | 0.13 | 0.02 | 0.03 | 0.02 | 0.12 | 0.16 |
| SEQID-02439 | G1MWQ3 | — | 1 | 0.42 | 0.11 | 0.03 | 0.06 | 0.05 | 0.06 | 0.01 | 0.03 | 0.07 | 0.04 | 0.04 | 0.03 | 0.03 | 0.12 |
| SEQID-02440 | G1NR17 | — | 1 | 0.46 | 0.20 | 0.05 | 0.07 | 0.02 | 0.03 | 0.11 | 0.05 | 0.11 | 0.03 | 0.01 | 0.07 | 0.07 | 0.10 |
| SEQID-02441 | G1NB19 | — | 1 | 0.44 | 0.17 | 0.03 | 0.09 | 0.05 | 0.04 | 0.01 | 0.04 | 0.05 | 0.02 | 0.03 | 0.05 | 0.06 | 0.09 |
| SEQID-02442 | P82013 | — | 1 | 0.50 | 0.19 | 0.05 | 0.03 | 0.02 | 0.06 | 0.01 | 0.02 | 0.08 | 0.06 | 0.01 | 0.05 | 0.09 | 0.11 |
| SEQID-02443 | G1N478 | — | 1 | 0.44 | 0.15 | 0.03 | 0.07 | 0.06 | 0.04 | 0.00 | 0.04 | 0.06 | 0.06 | 0.05 | 0.04 | 0.07 | 0.10 |
| SEQID-02444 | G1MSQ3 | — | 1 | 0.46 | 0.19 | 0.06 | 0.09 | 0.04 | 0.04 | 0.01 | 0.05 | 0.08 | 0.04 | 0.03 | 0.06 | 0.08 | 0.09 |
| SEQID-02445 | G1N0V4 | — | 1 | 0.43 | 0.17 | 0.07 | 0.06 | 0.03 | 0.05 | 0.01 | 0.04 | 0.11 | 0.04 | 0.03 | 0.05 | 0.06 | 0.10 |
| SEQID-02446 | G1MSW3 | — | 1 | 0.46 | 0.21 | 0.05 | 0.06 | 0.05 | 0.07 | 0.01 | 0.05 | 0.09 | 0.03 | 0.01 | 0.07 | 0.07 | 0.10 |
| SEQID-02447 | H9H1S2 | — | 0 | 0.51 | 0.22 | 0.05 | 0.03 | 0.05 | 0.03 | 0.04 | 0.06 | 0.08 | 0.04 | 0.02 | 0.06 | 0.09 | 0.10 |
| SEQID-02448 | Q6W5H1 | — | 0 | 0.46 | 0.17 | 0.09 | 0.02 | 0.05 | 0.06 | 0.00 | 0.04 | 0.13 | 0.05 | 0.01 | 0.05 | 0.07 | 0.07 |
| SEQID-02449 | G1MRV9 | — | 1 | 0.45 | 0.23 | 0.07 | 0.08 | 0.02 | 0.05 | 0.01 | 0.07 | 0.06 | 0.03 | 0.03 | 0.07 | 0.10 | 0.13 |
| SEQID-02450 | G1N0M3 | — | 1 | 0.42 | 0.21 | 0.03 | 0.12 | 0.05 | 0.05 | 0.01 | 0.04 | 0.09 | 0.03 | 0.03 | 0.05 | 0.07 | 0.07 |
| SEQID-02451 | H9H062 | — | 0 | 0.47 | 0.25 | 0.07 | 0.07 | 0.02 | 0.03 | 0.00 | 0.05 | 0.10 | 0.03 | 0.03 | 0.05 | 0.09 | 0.06 |
| SEQID-02452 | G3URQ7 | — | 1 | 0.45 | 0.19 | 0.07 | 0.03 | 0.01 | 0.07 | 0.00 | 0.06 | 0.12 | 0.02 | 0.02 | 0.06 | 0.04 | 0.06 |
| SEQID-02453 | G1NPZ8 | — | 1 | 0.56 | 0.25 | 0.07 | 0.05 | 0.01 | 0.03 | 0.00 | 0.03 | 0.04 | 0.03 | 0.07 | 0.05 | 0.12 | 0.09 |
| SEQID-02454 | G1N3B7 | — | 1 | 0.50 | 0.22 | 0.06 | 0.03 | 0.03 | 0.05 | 0.01 | 0.05 | 0.03 | 0.05 | 0.01 | 0.08 | 0.07 | 0.10 |
| SEQID-02455 | G1N8F8 | — | 1 | 0.44 | 0.17 | 0.05 | 0.06 | 0.05 | 0.05 | 0.02 | 0.04 | 0.10 | 0.04 | 0.03 | 0.03 | 0.08 | 0.04 |
| SEQID-02456 | G1MV26 | — | 1 | 0.47 | 0.23 | 0.05 | 0.09 | 0.04 | 0.03 | 0.01 | 0.04 | 0.07 | 0.03 | 0.03 | 0.06 | 0.09 | 0.06 |
| SEQID-02457 | G1NFA2 | — | 1 | 0.49 | 0.22 | 0.05 | 0.10 | 0.04 | 0.09 | 0.02 | 0.04 | 0.09 | 0.04 | 0.02 | 0.07 | 0.11 | 0.09 |
| SEQID-02458 | G1N0S1 | — | 1 | 0.47 | 0.23 | 0.03 | 0.07 | 0.04 | 0.07 | 0.02 | 0.06 | 0.07 | 0.03 | 0.02 | 0.05 | 0.10 | 0.07 |
| SEQID-02459 | G1NHY3 | — | 1 | 0.48 | 0.22 | 0.03 | 0.06 | 0.04 | 0.05 | 0.02 | 0.04 | 0.10 | 0.03 | 0.03 | 0.06 | 0.11 | 0.08 |
| SEQID-02460 | G1MUC1 | — | 1 | 0.47 | 0.20 | 0.03 | 0.08 | 0.04 | 0.04 | 0.02 | 0.04 | 0.11 | 0.03 | 0.03 | 0.05 | 0.11 | 0.11 |
| SEQID-02461 | G1NC68 | — | 0 | 0.43 | 0.26 | 0.04 | 0.09 | 0.03 | 0.05 | 0.01 | 0.06 | 0.07 | 0.05 | 0.01 | 0.05 | 0.09 | 0.06 |
| SEQID-02462 | G1NL16 | — | 1 | 0.49 | 0.21 | 0.05 | 0.10 | 0.03 | 0.07 | 0.01 | 0.04 | 0.07 | 0.04 | 0.04 | 0.08 | 0.11 | 0.09 |
| SEQID-02463 | G1NFQ5 | — | 1 | 0.44 | 0.20 | 0.05 | 0.08 | 0.04 | 0.06 | 0.02 | 0.04 | 0.09 | 0.04 | 0.04 | 0.06 | 0.07 | 0.05 |
| SEQID-02464 | G1N3X9 | — | 1 | 0.45 | 0.21 | 0.06 | 0.06 | 0.04 | 0.09 | 0.01 | 0.04 | 0.08 | 0.03 | 0.02 | 0.06 | 0.11 | 0.09 |
| SEQID-02465 | G1MUF1 | — | 1 | 0.43 | 0.21 | 0.06 | 0.10 | 0.04 | 0.07 | 0.02 | 0.05 | 0.09 | 0.04 | 0.02 | 0.07 | 0.09 | 0.06 |
| SEQID-02466 | G1MVN4 | — | 1 | 0.46 | 0.20 | 0.05 | 0.06 | 0.03 | 0.06 | 0.04 | 0.05 | 0.07 | 0.04 | 0.02 | 0.07 | 0.10 | 0.09 |
| SEQID-02467 | G1NBN7 | — | 1 | 0.47 | 0.23 | 0.04 | 0.07 | 0.03 | 0.05 | 0.01 | 0.06 | 0.03 | 0.04 | 0.04 | 0.05 | 0.10 | 0.06 |
| SEQID-02468 | G1N481 | — | 0 | 0.46 | 0.19 | 0.06 | 0.03 | 0.01 | 0.09 | 0.01 | 0.02 | 0.09 | 0.04 | 0.00 | 0.04 | 0.12 | 0.15 |
| SEQID-02469 | G1MX59 | — | 1 | 0.45 | 0.17 | 0.04 | 0.08 | 0.01 | 0.04 | 0.01 | 0.03 | 0.10 | 0.05 | 0.03 | 0.05 | 0.10 | 0.07 |
| SEQID-02470 | G1NLB3 | — | 1 | 0.46 | 0.22 | 0.03 | 0.07 | 0.05 | 0.05 | 0.01 | 0.09 | 0.10 | 0.03 | 0.03 | 0.04 | 0.07 | 0.08 |
| SEQID-02471 | G1NIG2 | — | 1 | 0.44 | 0.21 | 0.03 | 0.06 | 0.04 | 0.10 | 0.01 | 0.06 | 0.06 | 0.03 | 0.02 | 0.04 | 0.13 | 0.10 |
| SEQID-02472 | G1N071 | — | 1 | 0.51 | 0.26 | 0.06 | 0.05 | 0.04 | 0.07 | 0.02 | 0.03 | 0.10 | 0.03 | 0.02 | 0.07 | 0.11 | 0.11 |
| SEQID-02473 | G1NB81 | — | 1 | 0.48 | 0.19 | 0.03 | 0.09 | 0.05 | 0.05 | 0.01 | 0.05 | 0.15 | 0.03 | 0.02 | 0.07 | 0.09 | 0.10 |
| SEQID-02474 | G1MZD9 | — | 1 | 0.45 | 0.21 | 0.04 | 0.06 | 0.05 | 0.09 | 0.02 | 0.04 | 0.05 | 0.03 | 0.04 | 0.04 | 0.09 | 0.06 |
| SEQID-02475 | G1NL53 | — | 1 | 0.50 | 0.23 | 0.05 | 0.06 | 0.04 | 0.06 | 0.01 | 0.05 | 0.09 | 0.06 | 0.03 | 0.07 | 0.10 | 0.11 |
| SEQID-02476 | G1NAW6 | — | 1 | 0.50 | 0.25 | 0.03 | 0.09 | 0.04 | 0.09 | 0.02 | 0.04 | 0.08 | 0.03 | 0.01 | 0.07 | 0.08 | 0.09 |
| SEQID-02477 | G1NB27 | — | 1 | 0.40 | 0.16 | 0.05 | 0.07 | 0.04 | 0.05 | 0.01 | 0.03 | 0.09 | 0.03 | 0.03 | 0.09 | 0.10 | 0.06 |
| SEQID-02478 | G1NCE0 | — | 1 | 0.48 | 0.23 | 0.06 | 0.08 | 0.04 | 0.06 | 0.01 | 0.09 | 0.07 | 0.03 | 0.03 | 0.04 | 0.09 | 0.03 |
| SEQID-02479 | G1NGS1 | — | 1 | 0.45 | 0.18 | 0.05 | 0.07 | 0.04 | 0.05 | 0.01 | 0.05 | 0.10 | 0.04 | 0.02 | 0.06 | 0.13 | 0.08 |
| SEQID-02480 | G1NKX1 | — | 1 | 0.47 | 0.20 | 0.03 | 0.04 | 0.04 | 0.03 | 0.01 | 0.06 | 0.15 | 0.03 | 0.02 | 0.04 | 0.11 | 0.10 |
| SEQID-02481 | G1NRH0 | — | 0 | 0.51 | 0.16 | 0.06 | 0.06 | 0.04 | 0.06 | 0.01 | 0.03 | 0.06 | 0.02 | 0.02 | 0.04 | 0.09 | 0.11 |
| SEQID-02482 | G1NQ36 | — | 0 | 0.43 | 0.20 | 0.06 | 0.03 | 0.04 | 0.02 | 0.01 | 0.05 | 0.13 | 0.04 | 0.04 | 0.06 | 0.05 | 0.18 |
| SEQID-02483 | G1MK52 | — | 1 | 0.40 | 0.20 | 0.04 | 0.06 | 0.04 | 0.06 | 0.02 | 0.05 | 0.13 | 0.03 | 0.03 | 0.06 | 0.06 | 0.09 |
| SEQID-02484 | G1NCP5 | — | 0 | 0.43 | 0.15 | 0.05 | 0.07 | 0.05 | 0.05 | 0.01 | 0.03 | 0.16 | 0.02 | 0.01 | 0.04 | 0.10 | 0.06 |
| SEQID-02485 | G1MZ49 | — | 1 | 0.48 | 0.25 | 0.04 | 0.06 | 0.04 | 0.06 | 0.02 | 0.05 | 0.07 | 0.02 | 0.02 | 0.05 | 0.06 | 0.10 |
| SEQID-02486 | G1NGA7 | — | 1 | 0.50 | 0.21 | 0.06 | 0.06 | 0.02 | 0.02 | 0.02 | 0.04 | 0.06 | 0.04 | 0.01 | 0.05 | 0.09 | 0.08 |

TABLE 1-continued

| | | | | | | | | | | | | | | | |
|---|---|---|---|---|---|---|---|---|---|---|---|---|---|---|---|
| SEQID-02487 | G1NLA9 | — | 1 | 0.48 | 0.21 | 0.06 | 0.04 | 0.05 | 0.05 | 0.02 | 0.05 | 0.08 | 0.03 | 0.03 | 0.06 | 0.09 | 0.10 |
| SEQID-02488 | G1NAL4 | — | 1 | 0.44 | 0.18 | 0.06 | 0.06 | 0.02 | 0.04 | 0.04 | 0.05 | 0.11 | 0.04 | 0.02 | 0.05 | 0.07 | 0.08 |
| SEQID-02489 | G1NCM2 | — | 1 | 0.50 | 0.21 | 0.04 | 0.06 | 0.04 | 0.05 | 0.01 | 0.05 | 0.11 | 0.02 | 0.02 | 0.04 | 0.12 | 0.11 |
| SEQID-02490 | G1NP43 | — | 1 | 0.39 | 0.16 | 0.07 | 0.12 | 0.03 | 0.07 | 0.01 | 0.04 | 0.07 | 0.06 | 0.02 | 0.05 | 0.09 | 0.05 |
| SEQID-02491 | G1NMS8 | — | 1 | 0.48 | 0.23 | 0.04 | 0.06 | 0.04 | 0.05 | 0.02 | 0.06 | 0.06 | 0.05 | 0.01 | 0.06 | 0.09 | 0.10 |
| SEQID-02492 | G1MSI1 | — | 1 | 0.38 | 0.18 | 0.04 | 0.09 | 0.03 | 0.07 | 0.02 | 0.05 | 0.08 | 0.08 | 0.03 | 0.06 | 0.09 | 0.07 |
| SEQID-02493 | G1NP96 | — | 1 | 0.46 | 0.22 | 0.04 | 0.07 | 0.03 | 0.07 | 0.02 | 0.06 | 0.09 | 0.02 | 0.01 | 0.05 | 0.11 | 0.07 |
| SEQID-02494 | P07728 | — | 1 | 0.35 | 0.19 | 0.04 | 0.11 | 0.07 | 0.03 | 0.02 | 0.06 | 0.06 | 0.02 | 0.03 | 0.06 | 0.08 | 0.03 |
| SEQID-02495 | P07730 | — | 1 | 0.37 | 0.19 | 0.04 | 0.11 | 0.07 | 0.03 | 0.02 | 0.06 | 0.06 | 0.03 | 0.02 | 0.05 | 0.09 | 0.03 |
| SEQID-02496 | P14323 | — | 1 | 0.38 | 0.19 | 0.04 | 0.09 | 0.07 | 0.02 | 0.02 | 0.12 | 0.06 | 0.03 | 0.03 | 0.05 | 0.07 | 0.04 |
| SEQID-02497 | Q02897 | — | 1 | 0.38 | 0.18 | 0.04 | 0.09 | 0.07 | 0.02 | 0.02 | 0.12 | 0.06 | 0.03 | 0.02 | 0.05 | 0.07 | 0.04 |
| SEQID-02498 | P14614 | — | 1 | 0.38 | 0.19 | 0.05 | 0.10 | 0.08 | 0.02 | 0.02 | 0.12 | 0.07 | 0.03 | 0.03 | 0.05 | 0.09 | 0.04 |
| SEQID-02499 | Q09151 | — | 1 | 0.39 | 0.20 | 0.04 | 0.10 | 0.06 | 0.05 | 0.02 | 0.12 | 0.05 | 0.04 | 0.03 | 0.05 | 0.08 | 0.03 |
| SEQID-02500 | Q01401 | — | 1 | 0.46 | 0.17 | 0.04 | 0.09 | 0.05 | 0.07 | 0.01 | 0.02 | 0.06 | 0.04 | 0.05 | 0.04 | 0.07 | 0.07 |
| SEQID-02501 | Q6K508 | — | 1 | 0.40 | 0.21 | 0.05 | 0.11 | 0.06 | 0.02 | 0.01 | 0.11 | 0.06 | 0.03 | 0.04 | 0.06 | 0.03 | 0.04 |
| SEQID-02502 | Q6K7K6 | — | 1 | 0.42 | 0.20 | 0.05 | 0.10 | 0.05 | 0.02 | 0.01 | 0.10 | 0.06 | 0.03 | 0.04 | 0.05 | 0.09 | 0.03 |
| SEQID-02503 | Q0E2G5 | — | 1 | 0.41 | 0.20 | 0.04 | 0.10 | 0.04 | 0.04 | 0.01 | 0.11 | 0.06 | 0.04 | 0.03 | 0.05 | 0.08 | 0.05 |
| SEQID-02504 | Q6H6P8 | — | 1 | 0.43 | 0.17 | 0.05 | 0.09 | 0.04 | 0.02 | 0.01 | 0.02 | 0.07 | 0.04 | 0.04 | 0.07 | 0.07 | 0.05 |
| SEQID-02505 | Q7X834 | — | 1 | 0.44 | 0.21 | 0.05 | 0.08 | 0.05 | 0.07 | 0.01 | 0.04 | 0.05 | 0.04 | 0.05 | 0.04 | 0.08 | 0.04 |
| SEQID-02506 | Q0DEV5 | — | 1 | 0.45 | 0.21 | 0.07 | 0.07 | 0.03 | 0.09 | 0.01 | 0.04 | 0.07 | 0.05 | 0.02 | 0.05 | 0.08 | 0.03 |
| SEQID-02507 | Q6AVA8 | — | 1 | 0.45 | 0.21 | 0.07 | 0.09 | 0.04 | 0.06 | 0.01 | 0.03 | 0.07 | 0.05 | 0.03 | 0.04 | 0.09 | 0.06 |
| SEQID-02508 | Q43009 | — | 1 | 0.49 | 0.22 | 0.04 | 0.08 | 0.04 | 0.05 | 0.01 | 0.04 | 0.09 | 0.05 | 0.05 | 0.06 | 0.11 | 0.06 |
| SEQID-02509 | Q5VNT5 | — | 1 | 0.46 | 0.21 | 0.04 | 0.07 | 0.04 | 0.04 | 0.01 | 0.04 | 0.09 | 0.04 | 0.03 | 0.09 | 0.07 | 0.06 |
| SEQID-02510 | P15280 | — | 1 | 0.43 | 0.22 | 0.06 | 0.08 | 0.05 | 0.07 | 0.02 | 0.03 | 0.06 | 0.04 | 0.02 | 0.08 | 0.08 | 0.06 |
| SEQID-02511 | P30298 | — | 1 | 0.48 | 0.22 | 0.04 | 0.07 | 0.04 | 0.06 | 0.01 | 0.03 | 0.08 | 0.03 | 0.04 | 0.06 | 0.11 | 0.06 |
| SEQID-02512 | Q10LP5 | — | 1 | 0.47 | 0.23 | 0.04 | 0.09 | 0.04 | 0.05 | 0.01 | 0.04 | 0.08 | 0.03 | 0.04 | 0.07 | 0.10 | 0.06 |
| SEQID-02513 | Q0DI45 | — | 1 | 0.38 | 0.25 | 0.08 | 0.06 | 0.03 | 0.06 | 0.01 | 0.20 | 0.01 | 0.04 | 0.04 | 0.06 | 0.13 | 0.06 |
| SEQID-02514 | Q9AUV8 | — | 1 | 0.47 | 0.21 | 0.05 | 0.06 | 0.05 | 0.06 | 0.01 | 0.03 | 0.10 | 0.02 | 0.01 | 0.06 | 0.08 | 0.01 |
| SEQID-02515 | Q627B0 | — | 1 | 0.46 | 0.22 | 0.05 | 0.07 | 0.05 | 0.07 | 0.01 | 0.04 | 0.12 | 0.04 | 0.01 | 0.07 | 0.08 | 0.03 |
| SEQID-02516 | P37833 | — | 1 | 0.46 | 0.22 | 0.06 | 0.08 | 0.03 | 0.03 | 0.04 | 0.05 | 0.05 | 0.05 | 0.03 | 0.06 | 0.10 | 0.11 |
| SEQID-02517 | Q6KSG8 | — | 1 | 0.52 | 0.22 | 0.06 | 0.05 | 0.04 | 0.04 | 0.01 | 0.02 | 0.07 | 0.04 | 0.03 | 0.06 | 0.06 | 0.05 |
| SEQID-02518 | Q627B2 | — | 1 | 0.44 | 0.22 | 0.09 | 0.11 | 0.02 | 0.05 | 0.02 | 0.01 | 0.09 | 0.05 | 0.02 | 0.04 | 0.09 | 0.10 |
| SEQID-02519 | Q75GX9 | — | 1 | 0.33 | 0.16 | 0.06 | 0.18 | 0.03 | 0.09 | 0.01 | 0.06 | 0.13 | 0.05 | 0.02 | 0.04 | 0.09 | 0.06 |
| SEQID-02520 | Q20V45 | — | 1 | 0.46 | 0.22 | 0.07 | 0.06 | 0.04 | 0.08 | 0.01 | 0.05 | 0.08 | 0.05 | 0.01 | 0.04 | 0.08 | 0.09 |
| SEQID-02521 | Q84Q83 | — | 1 | 0.44 | 0.19 | 0.04 | 0.08 | 0.05 | 0.07 | 0.01 | 0.05 | 0.07 | 0.05 | 0.03 | 0.05 | 0.08 | 0.06 |
| SEQID-02522 | O64937 | — | 1 | 0.52 | 0.21 | 0.08 | 0.10 | 0.02 | 0.02 | 0.03 | 0.01 | 0.10 | 0.06 | 0.04 | 0.06 | 0.06 | 0.13 |
| SEQID-02523 | Q6T725 | — | 1 | 0.40 | 0.20 | 0.07 | 0.06 | 0.04 | 0.05 | 0.02 | 0.02 | 0.10 | 0.04 | 0.03 | 0.07 | 0.03 | 0.03 |
| SEQID-02524 | P29835 | — | 0 | 0.26 | 0.12 | 0.03 | 0.09 | 0.07 | 0.03 | 0.01 | 0.11 | 0.07 | 0.03 | 0.00 | 0.02 | 0.06 | 0.07 |
| SEQID-02525 | Q5N725 | — | 1 | 0.46 | 0.22 | 0.06 | 0.16 | 0.00 | 0.03 | 0.04 | 0.13 | 0.10 | 0.04 | 0.04 | 0.05 | 0.06 | 0.01 |
| SEQID-02526 | Q6ZBH2 | — | 1 | 0.47 | 0.24 | 0.07 | 0.05 | 0.04 | 0.04 | 0.01 | 0.04 | 0.04 | 0.05 | 0.05 | 0.05 | 0.09 | 0.10 |
| SEQID-02527 | Q338N3 | — | 1 | 0.42 | 0.23 | 0.08 | 0.10 | 0.02 | 0.05 | 0.02 | 0.01 | 0.10 | 0.06 | 0.02 | 0.04 | 0.06 | 0.04 |
| SEQID-02528 | Q53LQ0 | — | 1 | 0.48 | 0.20 | 0.07 | 0.06 | 0.05 | 0.08 | 0.01 | 0.10 | 0.10 | 0.04 | 0.04 | 0.05 | 0.07 | 0.05 |
| SEQID-02529 | Q01B82 | — | 1 | 0.39 | 0.20 | 0.07 | 0.03 | 0.03 | 0.07 | 0.02 | 0.03 | 0.07 | 0.04 | 0.03 | 0.06 | 0.10 | 0.07 |
| SEQID-02530 | Q7FAH2 | — | 1 | 0.51 | 0.22 | 0.06 | 0.11 | 0.03 | 0.06 | 0.01 | 0.04 | 0.11 | 0.04 | 0.02 | 0.05 | 0.09 | 0.12 |
| SEQID-02531 | Q852L2 | — | 1 | 0.38 | 0.17 | 0.06 | 0.05 | 0.04 | 0.08 | 0.01 | 0.02 | 0.04 | 0.04 | 0.05 | 0.06 | 0.08 | 0.02 |
| SEQID-02532 | Q6H4L2 | — | 1 | 0.48 | 0.21 | 0.05 | 0.14 | 0.02 | 0.03 | 0.02 | 0.02 | 0.07 | 0.04 | 0.04 | 0.06 | 0.06 | 0.10 |
| SEQID-02533 | P35683 | — | 1 | 0.46 | 0.23 | 0.03 | 0.07 | 0.03 | 0.06 | 0.01 | 0.03 | 0.13 | 0.04 | 0.02 | 0.07 | 0.07 | 0.04 |
| SEQID-02534 | Q62ZZ4 | — | 1 | 0.46 | 0.23 | 0.03 | 0.10 | 0.02 | 0.08 | 0.02 | 0.04 | 0.09 | 0.04 | 0.02 | 0.06 | 0.09 | 0.09 |
| SEQID-02535 | Q6H6C7 | — | 1 | 0.53 | 0.26 | 0.09 | 0.03 | 0.03 | 0.07 | 0.01 | 0.07 | 0.07 | 0.05 | 0.02 | 0.05 | 0.10 | 0.05 |
| SEQID-02536 | Q7XTK1 | — | 1 | 0.48 | 0.22 | 0.05 | 0.07 | 0.02 | 0.06 | 0.01 | 0.01 | 0.03 | 0.04 | 0.01 | 0.05 | 0.12 | 0.12 |
| SEQID-02537 | P20693 | — | 1 | 0.40 | 0.20 | 0.07 | 0.04 | 0.03 | 0.01 | 0.00 | 0.04 | 0.08 | 0.05 | 0.02 | 0.06 | 0.08 | 0.08 |
| SEQID-02538 | Q2QXY9 | — | 1 | 0.43 | 0.21 | 0.08 | 0.09 | 0.03 | 0.06 | 0.01 | 0.03 | 0.09 | 0.04 | 0.04 | 0.07 | 0.07 | 0.05 |
| SEQID-02539 | Q93X08 | — | 1 | 0.51 | 0.26 | 0.04 | 0.04 | 0.02 | 0.06 | 0.01 | 0.03 | 0.08 | 0.04 | 0.02 | 0.07 | 0.11 | 0.10 |

TABLE 1-continued

| | | | | | | | | | | | | | | |
|---|---|---|---|---|---|---|---|---|---|---|---|---|---|---|
| SEQID-02540 | Q8H4L8 | — | 1 | 0.38 | 0.21 | 0.09 | 0.12 | 0.03 | 0.05 | 0.06 | 0.05 | 0.04 | 0.05 | 0.03 | 0.05 | 0.07 | 0.02 |
| SEQID-02541 | Q655T1 | — | 1 | 0.53 | 0.26 | 0.07 | 0.12 | 0.02 | 0.07 | 0.00 | 0.01 | 0.07 | 0.04 | 0.01 | 0.06 | 0.12 | 0.12 |
| SEQID-02542 | Q013A4 | — | 1 | 0.52 | 0.23 | 0.06 | 0.05 | 0.04 | 0.08 | 0.01 | 0.01 | 0.05 | 0.04 | 0.02 | 0.08 | 0.06 | 0.10 |
| SEQID-02543 | Q69T99 | — | 1 | 0.43 | 0.22 | 0.07 | 0.09 | 0.05 | 0.06 | 0.00 | 0.03 | 0.07 | 0.06 | 0.02 | 0.09 | 0.07 | 0.06 |
| SEQID-02544 | Q653V7 | — | 1 | 0.45 | 0.21 | 0.06 | 0.10 | 0.04 | 0.06 | 0.06 | 0.02 | 0.03 | 0.03 | 0.03 | 0.03 | 0.10 | 0.03 |
| SEQID-02545 | Q01881 | — | 1 | 0.36 | 0.20 | 0.09 | 0.13 | 0.02 | 0.05 | 0.00 | 0.05 | 0.02 | 0.05 | 0.03 | 0.03 | 0.09 | 0.01 |
| SEQID-02546 | Q8H4M4 | — | 1 | 0.42 | 0.20 | 0.07 | 0.10 | 0.01 | 0.01 | 0.06 | 0.05 | 0.05 | 0.01 | 0.02 | 0.03 | 0.09 | 0.04 |
| SEQID-02547 | Q62IX4 | — | 1 | 0.41 | 0.26 | 0.06 | 0.04 | 0.03 | 0.03 | 0.03 | 0.22 | 0.02 | 0.05 | 0.02 | 0.07 | 0.11 | 0.01 |
| SEQID-02548 | Q10P83 | — | 1 | 0.48 | 0.25 | 0.04 | 0.09 | 0.05 | 0.05 | 0.01 | 0.04 | 0.08 | 0.01 | 0.03 | 0.07 | 0.07 | 0.01 |
| SEQID-02549 | Q10DV7 | — | 1 | 0.47 | 0.21 | 0.05 | 0.07 | 0.02 | 0.06 | 0.06 | 0.03 | 0.04 | 0.04 | 0.03 | 0.08 | 0.07 | 0.07 |
| SEQID-02550 | Q7K8H9 | — | 1 | 0.37 | 0.20 | 0.10 | 0.10 | 0.05 | 0.06 | 0.01 | 0.04 | 0.04 | 0.07 | 0.08 | 0.03 | 0.08 | 0.06 |
| SEQID-02551 | Q014C6 | — | 1 | 0.45 | 0.17 | 0.04 | 0.06 | 0.02 | 0.02 | 0.06 | 0.04 | 0.07 | 0.04 | 0.03 | 0.04 | 0.08 | 0.02 |
| SEQID-02552 | A1YQF0 | — | 1 | 0.37 | 0.25 | 0.09 | 0.06 | 0.05 | 0.03 | 0.02 | 0.19 | 0.01 | 0.06 | 0.02 | 0.06 | 0.15 | 0.04 |
| SEQID-02553 | Q529M9 | — | 1 | 0.37 | 0.16 | 0.06 | 0.06 | 0.02 | 0.08 | 0.00 | 0.20 | 0.01 | 0.02 | 0.02 | 0.03 | 0.07 | 0.01 |
| SEQID-02554 | P17048 | — | 1 | 0.41 | 0.24 | 0.06 | 0.04 | 0.03 | 0.03 | 0.03 | 0.22 | 0.02 | 0.01 | 0.01 | 0.02 | 0.10 | 0.02 |
| SEQID-02555 | Q52627 | — | 1 | 0.50 | 0.19 | 0.04 | 0.04 | 0.03 | 0.05 | 0.02 | 0.00 | 0.07 | 0.01 | 0.02 | 0.07 | 0.10 | 0.01 |
| SEQID-02556 | Q65XV6 | — | 1 | 0.50 | 0.21 | 0.07 | 0.07 | 0.04 | 0.07 | 0.06 | 0.03 | 0.10 | 0.03 | 0.04 | 0.09 | 0.06 | 0.11 |
| SEQID-02557 | Q7X7E6 | — | 1 | 0.35 | 0.19 | 0.11 | 0.11 | 0.02 | 0.06 | 0.06 | 0.06 | 0.05 | 0.07 | 0.02 | 0.03 | 0.06 | 0.09 |
| SEQID-02558 | Q8GVK7 | — | 0 | 0.40 | 0.28 | 0.07 | 0.06 | 0.05 | 0.05 | 0.01 | 0.19 | 0.05 | 0.02 | 0.01 | 0.06 | 0.08 | 0.02 |
| SEQID-02559 | Q0DJ38 | — | 1 | 0.39 | 0.25 | 0.06 | 0.05 | 0.04 | 0.03 | 0.06 | 0.00 | 0.01 | 0.01 | 0.01 | 0.03 | 0.15 | 0.07 |
| SEQID-02560 | Q7SHX0 | — | 1 | 0.46 | 0.21 | 0.04 | 0.05 | 0.02 | 0.06 | 0.03 | 0.18 | 0.03 | 0.04 | 0.03 | 0.06 | 0.16 | 0.01 |
| SEQID-02561 | Q0IKM8 | — | 1 | 0.46 | 0.32 | 0.07 | 0.06 | 0.04 | 0.05 | 0.01 | 0.03 | 0.08 | 0.06 | 0.03 | 0.07 | 0.07 | 0.06 |
| SEQID-02562 | Q7XDC8 | — | 1 | 0.47 | 0.24 | 0.07 | 0.03 | 0.05 | 0.05 | 0.02 | 0.06 | 0.05 | 0.04 | 0.03 | 0.06 | 0.09 | 0.06 |
| SEQID-02563 | Q5W6C5 | — | 1 | 0.42 | 0.19 | 0.06 | 0.05 | 0.04 | 0.05 | 0.02 | 0.04 | 0.07 | 0.07 | 0.03 | 0.06 | 0.09 | 0.07 |
| SEQID-02564 | Q10M12 | — | 1 | 0.45 | 0.15 | 0.04 | 0.03 | 0.06 | 0.06 | 0.01 | 0.04 | 0.04 | 0.04 | 0.03 | 0.03 | 0.10 | 0.04 |
| SEQID-02565 | Q6YW46 | — | 1 | 0.49 | 0.18 | 0.05 | 0.04 | 0.05 | 0.07 | 0.02 | 0.04 | 0.07 | 0.06 | 0.04 | 0.04 | 0.05 | 0.06 |
| SEQID-02566 | Q9AUQ4 | — | 1 | 0.48 | 0.21 | 0.06 | 0.04 | 0.05 | 0.05 | 0.01 | 0.03 | 0.10 | 0.03 | 0.07 | 0.06 | 0.08 | 0.12 |
| SEQID-02567 | Q01833 | — | 1 | 0.36 | 0.19 | 0.09 | 0.12 | 0.02 | 0.08 | 0.01 | 0.18 | 0.06 | 0.01 | 0.01 | 0.05 | 0.07 | 0.01 |
| SEQID-02568 | Q00G9 | — | 1 | 0.11 | 0.24 | 0.07 | 0.08 | 0.04 | 0.05 | 0.06 | 0.03 | 0.04 | 0.05 | 0.04 | 0.02 | 0.09 | 0.03 |
| SEQID-02569 | P49027 | — | 1 | 0.47 | 0.23 | 0.04 | 0.06 | 0.05 | 0.07 | 0.01 | 0.03 | 0.07 | 0.06 | 0.05 | 0.05 | 0.12 | 0.05 |
| SEQID-02570 | Q0ISV7 | — | 1 | 0.46 | 0.22 | 0.05 | 0.06 | 0.03 | 0.09 | 0.02 | 0.03 | 0.04 | 0.04 | 0.05 | 0.05 | 0.10 | 0.09 |
| SEQID-02571 | Q0OUA3 | — | 1 | 0.38 | 0.15 | 0.04 | 0.07 | 0.03 | 0.05 | 0.02 | 0.03 | 0.09 | 0.06 | 0.06 | 0.04 | 0.09 | 0.09 |
| SEQID-02572 | Q53NM9 | — | 1 | 0.45 | 0.21 | 0.06 | 0.13 | 0.05 | 0.06 | 0.01 | 0.04 | 0.16 | 0.05 | 0.04 | 0.05 | 0.05 | 0.07 |
| SEQID-02573 | Q07073 | — | 1 | 0.19 | 0.20 | 0.03 | 0.07 | 0.04 | 0.09 | 0.00 | 0.05 | 0.09 | 0.04 | 0.08 | 0.07 | 0.09 | 0.09 |
| SEQID-02574 | Q42465 | — | 1 | 0.41 | 0.26 | 0.08 | 0.05 | 0.05 | 0.07 | 0.01 | 0.03 | 0.14 | 0.02 | 0.06 | 0.06 | 0.14 | 0.13 |
| SEQID-02575 | P48494 | — | 1 | 0.49 | 0.25 | 0.07 | 0.15 | 0.04 | 0.05 | 0.01 | 0.18 | 0.01 | 0.06 | 0.01 | 0.07 | 0.07 | 0.01 |
| SEQID-02576 | Q2QNF3 | — | 1 | 0.43 | 0.17 | 0.05 | 0.05 | 0.04 | 0.05 | 0.01 | 0.05 | 0.09 | 0.06 | 0.01 | 0.06 | 0.04 | 0.08 |
| SEQID-02577 | Q948T6 | — | 1 | 0.47 | 0.21 | 0.06 | 0.05 | 0.02 | 0.07 | 0.01 | 0.03 | 0.03 | 0.05 | 0.06 | 0.05 | 0.10 | 0.11 |
| SEQID-02578 | Q92RJ7 | — | 1 | 0.49 | 0.17 | 0.06 | 0.04 | 0.04 | 0.05 | 0.01 | 0.02 | 0.09 | 0.01 | 0.05 | 0.06 | 0.08 | 0.09 |
| SEQID-02579 | Q42971 | — | 1 | 0.45 | 0.22 | 0.07 | 0.04 | 0.06 | 0.05 | 0.00 | 0.05 | 0.10 | 0.04 | 0.06 | 0.05 | 0.10 | 0.13 |
| SEQID-02580 | Q0DEC8 | — | 1 | 0.44 | 0.20 | 0.05 | 0.08 | 0.03 | 0.09 | 0.02 | 0.04 | 0.07 | 0.04 | 0.06 | 0.04 | 0.08 | 0.10 |
| SEQID-02581 | Q0DDE3 | — | 1 | 0.39 | 0.19 | 0.07 | 0.06 | 0.03 | 0.09 | 0.01 | 0.03 | 0.07 | 0.07 | 0.03 | 0.03 | 0.09 | 0.05 |
| SEQID-02582 | Q07661 | — | 1 | 0.47 | 0.20 | 0.05 | 0.10 | 0.03 | 0.07 | 0.02 | 0.03 | 0.09 | 0.05 | 0.05 | 0.09 | 0.07 | 0.05 |
| SEQID-02583 | Q0D868 | — | 1 | 0.46 | 0.19 | 0.05 | 0.13 | 0.04 | 0.05 | 0.00 | 0.03 | 0.06 | 0.04 | 0.04 | 0.04 | 0.05 | 0.06 |
| SEQID-02584 | Q7XC37 | — | 1 | 0.51 | 0.23 | 0.09 | 0.07 | 0.03 | 0.06 | 0.02 | 0.03 | 0.10 | 0.05 | 0.05 | 0.03 | 0.09 | 0.11 |
| SEQID-02585 | Q62KC0 | — | 1 | 0.43 | 0.20 | 0.05 | 0.15 | 0.03 | 0.06 | 0.00 | 0.02 | 0.15 | 0.03 | 0.04 | 0.03 | 0.06 | 0.03 |
| SEQID-02586 | Q7XTE8 | — | 1 | 0.41 | 0.20 | 0.07 | 0.05 | 0.04 | 0.06 | 0.01 | 0.03 | 0.15 | 0.02 | 0.02 | 0.05 | 0.11 | 0.09 |
| SEQID-02587 | Q6SXA1 | — | 1 | 0.49 | 0.23 | 0.06 | 0.07 | 0.05 | 0.05 | 0.01 | 0.03 | 0.06 | 0.06 | 0.01 | 0.06 | 0.10 | 0.09 |
| SEQID-02588 | Q0OJB9 | — | 1 | 0.47 | 0.23 | 0.06 | 0.08 | 0.04 | 0.06 | 0.01 | 0.05 | 0.10 | 0.05 | 0.01 | 0.05 | 0.10 | 0.11 |
| SEQID-02589 | Q0DBN4 | — | 1 | 0.45 | 0.18 | 0.06 | 0.05 | 0.04 | 0.10 | 0.00 | 0.05 | 0.07 | 0.04 | 0.01 | 0.06 | 0.10 | 0.10 |
| SEQID-02590 | Q2QVC1 | — | 1 | 0.44 | 0.22 | 0.07 | 0.04 | 0.03 | 0.05 | 0.02 | 0.04 | 0.09 | 0.05 | 0.04 | 0.05 | 0.08 | 0.05 |
| SEQID-02591 | P0C522 | — | 0 | 0.42 | 0.25 | 0.07 | 0.09 | 0.04 | 0.05 | 0.01 | 0.06 | 0.03 | 0.04 | 0.01 | 0.06 | 0.09 | 0.03 |
| SEQID-02592 | Q01859 | — | 0 | 0.44 | 0.24 | 0.07 | 0.09 | 0.03 | 0.05 | 0.00 | 0.05 | 0.08 | 0.05 | 0.03 | 0.06 | 0.10 | 0.05 |

TABLE 1-continued

| SEQID | | | | | | | | | | | | | | | | |
|---|---|---|---|---|---|---|---|---|---|---|---|---|---|---|---|---|
| SEQID-02593 | Q0I1E1 | — | — | 1 | 0.47 | 0.23 | 0.07 | 0.03 | 0.06 | 0.02 | 0.03 | 0.05 | 0.05 | 0.04 | 0.07 | 0.09 | 0.07 |
| SEQID-02594 | Q2QLY4 | — | — | 1 | 0.42 | 0.22 | 0.07 | 0.04 | 0.06 | 0.01 | 0.03 | 0.08 | 0.03 | 0.02 | 0.06 | 0.09 | 0.09 |
| SEQID-02595 | Q6YZX6 | — | — | 1 | 0.43 | 0.20 | 0.05 | 0.05 | 0.06 | 0.00 | 0.03 | 0.07 | 0.05 | 0.03 | 0.05 | 0.09 | 0.07 |
| SEQID-02596 | Q0DKN6 | — | — | 1 | 0.37 | 0.26 | 0.07 | 0.04 | 0.09 | 0.00 | 0.04 | 0.14 | 0.04 | 0.01 | 0.04 | 0.09 | 0.07 |
| SEQID-02597 | P0C030 | — | — | 0 | 0.50 | 0.21 | 0.03 | 0.02 | 0.09 | 0.01 | 0.07 | 0.10 | 0.04 | 0.02 | 0.11 | 0.11 | 0.11 |
| SEQID-02598 | P35681 | — | — | 1 | 0.49 | 0.21 | 0.03 | 0.02 | 0.12 | 0.01 | 0.05 | 0.09 | 0.07 | 0.04 | 0.04 | 0.10 | 0.11 |
| SEQID-02599 | Q8H920 | — | — | 1 | 0.44 | 0.21 | 0.17 | 0.02 | 0.02 | 0.02 | 0.09 | 0.03 | 0.05 | 0.04 | 0.01 | 0.16 | 0.01 |
| SEQID-02600 | P29421 | — | — | 1 | 0.39 | 0.21 | 0.06 | 0.01 | 0.07 | 0.01 | 0.02 | 0.06 | 0.07 | 0.03 | 0.03 | 0.10 | 0.03 |
| SEQID-02601 | Q6YTY2 | — | — | 1 | 0.47 | 0.23 | 0.05 | 0.03 | 0.05 | 0.01 | 0.03 | 0.08 | 0.02 | 0.02 | 0.06 | 0.09 | 0.09 |
| SEQID-02602 | Q10QU9 | — | — | 1 | 0.41 | 0.18 | 0.11 | 0.03 | 0.04 | 0.01 | 0.03 | 0.06 | 0.06 | 0.02 | 0.03 | 0.06 | 0.03 |
| SEQID-02603 | Q0DS36 | — | — | 1 | 0.45 | 0.18 | 0.06 | 0.03 | 0.07 | 0.01 | 0.03 | 0.10 | 0.03 | 0.02 | 0.03 | 0.07 | 0.09 |
| SEQID-02604 | Q9SXP2 | — | — | 1 | 0.47 | 0.22 | 0.07 | 0.04 | 0.04 | 0.01 | 0.03 | 0.06 | 0.06 | 0.04 | 0.06 | 0.09 | 0.09 |
| SEQID-02605 | Q5W6H1 | — | — | 1 | 0.50 | 0.23 | 0.06 | 0.04 | 0.06 | 0.02 | 0.03 | 0.10 | 0.03 | 0.03 | 0.06 | 0.09 | 0.13 |
| SEQID-02606 | P35684 | — | — | 1 | 0.54 | 0.18 | 0.03 | 0.01 | 0.07 | 0.01 | 0.03 | 0.06 | 0.05 | 0.05 | 0.06 | 0.06 | 0.15 |
| SEQID-02607 | Q6ZK46 | — | — | 1 | 0.33 | 0.18 | 0.07 | 0.04 | 0.18 | 0.01 | 0.05 | 0.09 | 0.04 | 0.02 | 0.04 | 0.07 | 0.02 |
| SEQID-02608 | Q6ZHC3 | — | — | 1 | 0.42 | 0.20 | 0.03 | 0.03 | 0.03 | 0.01 | 0.05 | 0.10 | 0.06 | 0.02 | 0.07 | 0.08 | 0.10 |
| SEQID-02609 | Q6SXK0 | — | — | 1 | 0.45 | 0.21 | 0.07 | 0.04 | 0.04 | 0.02 | 0.03 | 0.08 | 0.03 | 0.04 | 0.07 | 0.09 | 0.07 |
| SEQID-02610 | Q6TX6 | — | — | 1 | 0.47 | 0.21 | 0.04 | 0.04 | 0.05 | 0.01 | 0.03 | 0.05 | 0.04 | 0.06 | 0.06 | 0.09 | 0.06 |
| SEQID-02611 | Q6H47 | — | — | 1 | 0.41 | 0.20 | 0.11 | 0.03 | 0.10 | 0.01 | 0.05 | 0.09 | 0.02 | 0.02 | 0.05 | 0.09 | 0.09 |
| SEQID-02612 | P0C5C9 | — | — | 1 | 0.48 | 0.70 | 0.06 | 0.06 | 0.06 | 0.01 | 0.05 | 0.09 | 0.04 | 0.03 | 0.05 | 0.08 | 0.07 |
| SEQID-02613 | Q0DKF0 | — | — | 1 | 0.44 | 0.17 | 0.05 | 0.05 | 0.10 | 0.01 | 0.02 | 0.05 | 0.04 | 0.04 | 0.05 | 0.07 | 0.10 |
| SEQID-02614 | P35685 | — | — | 1 | 0.54 | 0.22 | 0.06 | 0.03 | 0.04 | 0.03 | 0.03 | 0.05 | 0.03 | 0.04 | 0.04 | 0.06 | 0.11 |
| SEQID-02615 | Q8L4L4 | — | — | 0 | 0.42 | 0.16 | 0.06 | 0.06 | 0.03 | 0.01 | 0.04 | 0.07 | 0.04 | 0.02 | 0.04 | 0.10 | 0.18 |
| SEQID-02616 | Q6Z4N6 | — | — | 1 | 0.49 | 0.19 | 0.11 | 0.03 | 0.08 | 0.00 | 0.02 | 0.08 | 0.04 | 0.03 | 0.04 | 0.08 | 0.10 |
| SEQID-02617 | Q7XHN4 | — | — | 1 | 0.43 | 0.18 | 0.06 | 0.05 | 0.07 | 0.00 | 0.03 | 0.06 | 0.04 | 0.06 | 0.04 | 0.06 | 0.10 |
| SEQID-02618 | Q6F2Y7 | — | — | 1 | 0.43 | 0.23 | 0.04 | 0.03 | 0.06 | 0.02 | 0.04 | 0.03 | 0.05 | 0.02 | 0.04 | 0.07 | 0.08 |
| SEQID-02619 | Q8GV13 | — | — | 1 | 0.43 | 0.17 | 0.04 | 0.05 | 0.07 | 0.01 | 0.05 | 0.09 | 0.05 | 0.03 | 0.04 | 0.12 | 0.05 |
| SEQID-02620 | P27777 | — | — | 1 | 0.35 | 0.21 | 0.07 | 0.02 | 0.12 | 0.01 | 0.02 | 0.09 | 0.04 | 0.03 | 0.05 | 0.15 | 0.07 |
| SEQID-02621 | Q5S3NL5 | — | — | 1 | 0.47 | 0.25 | 0.11 | 0.05 | 0.12 | 0.01 | 0.07 | 0.07 | 0.04 | 0.02 | 0.05 | 0.10 | 0.11 |
| SEQID-02622 | P41095 | — | — | 1 | 0.41 | 0.20 | 0.11 | 0.05 | 0.07 | 0.02 | 0.00 | 0.11 | 0.05 | 0.01 | 0.02 | 0.05 | 0.04 |
| SEQID-02623 | Q8H916 | — | — | 0 | 0.49 | 0.18 | 0.09 | 0.03 | 0.09 | 0.00 | 0.02 | 0.04 | 0.04 | 0.04 | 0.06 | 0.10 | 0.11 |
| SEQID-02624 | Q4W8D0 | — | — | 1 | 0.44 | 0.25 | 0.06 | 0.04 | 0.04 | 0.00 | 0.03 | 0.09 | 0.03 | 0.02 | 0.04 | 0.09 | 0.10 |
| SEQID-02625 | Q9LD54 | — | — | 1 | 0.42 | 0.19 | 0.05 | 0.04 | 0.09 | 0.00 | 0.03 | 0.08 | 0.06 | 0.03 | 0.07 | 0.09 | 0.06 |
| SEQID-02626 | P46265 | — | — | 1 | 0.47 | 0.23 | 0.07 | 0.04 | 0.08 | 0.01 | 0.04 | 0.06 | 0.06 | 0.04 | 0.07 | 0.05 | 0.08 |
| SEQID-02627 | Q53M52 | — | — | 1 | 0.43 | 0.17 | 0.04 | 0.04 | 0.07 | 0.00 | 0.05 | 0.09 | 0.03 | 0.04 | 0.04 | 0.12 | 0.05 |
| SEQID-02628 | Q10R45 | — | — | 1 | 0.43 | 0.21 | 0.04 | 0.03 | 0.07 | 0.01 | 0.02 | 0.09 | 0.06 | 0.03 | 0.04 | 0.08 | 0.04 |
| SEQID-02629 | Q69P84 | — | — | 1 | 0.45 | 0.22 | 0.06 | 0.06 | 0.04 | 0.01 | 0.04 | 0.07 | 0.06 | 0.03 | 0.05 | 0.09 | 0.05 |
| SEQID-02630 | Q33AE4 | — | — | 1 | 0.46 | 0.24 | 0.06 | 0.04 | 0.03 | 0.01 | 0.05 | 0.11 | 0.06 | 0.02 | 0.09 | 0.10 | 0.04 |
| SEQID-02631 | Q0ICZ5 | — | — | 1 | 0.45 | 0.21 | 0.06 | 0.04 | 0.09 | 0.01 | 0.03 | 0.10 | 0.05 | 0.03 | 0.06 | 0.09 | 0.07 |
| SEQID-02632 | Q9FWV2 | — | — | 1 | 0.47 | 0.19 | 0.04 | 0.03 | 0.04 | 0.00 | 0.05 | 0.11 | 0.03 | 0.01 | 0.05 | 0.08 | 0.10 |
| SEQID-02633 | P31674 | — | — | 0 | 0.44 | 0.24 | 0.05 | 0.05 | 0.07 | 0.01 | 0.02 | 0.10 | 0.03 | 0.06 | 0.06 | 0.12 | 0.09 |
| SEQID-02634 | Q84Q77 | — | — | 1 | 0.48 | 0.20 | 0.04 | 0.03 | 0.13 | 0.00 | 0.04 | 0.07 | 0.04 | 0.03 | 0.05 | 0.07 | 0.12 |
| SEQID-02635 | Q0IBY8 | — | — | 1 | 0.44 | 0.16 | 0.04 | 0.04 | 0.09 | 0.03 | 0.03 | 0.11 | 0.04 | 0.02 | 0.06 | 0.05 | 0.10 |
| SEQID-02636 | Q8H590 | — | — | 1 | 0.53 | 0.17 | 0.04 | 0.04 | 0.11 | 0.01 | 0.04 | 0.04 | 0.04 | 0.04 | 0.08 | 0.04 | 0.16 |
| SEQID-02637 | Q6K1W6 | — | — | 1 | 0.51 | 0.20 | 0.03 | 0.03 | 0.16 | 0.01 | 0.04 | 0.04 | 0.04 | 0.03 | 0.05 | 0.10 | 0.12 |
| SEQID-02638 | P49199 | — | — | 1 | 0.41 | 0.16 | 0.07 | 0.03 | 0.16 | 0.01 | 0.04 | 0.07 | 0.03 | 0.04 | 0.05 | 0.06 | 0.11 |
| SEQID-02639 | Q40680 | — | — | 1 | 0.43 | 0.16 | 0.06 | 0.04 | 0.14 | 0.01 | 0.04 | 0.07 | 0.05 | 0.02 | 0.03 | 0.07 | 0.14 |
| SEQID-02640 | Q7GD79 | — | — | 1 | 0.44 | 0.21 | 0.07 | 0.03 | 0.03 | 0.00 | 0.05 | 0.09 | 0.05 | 0.01 | 0.04 | 0.09 | 0.09 |
| SEQID-02641 | Q0IDZ7 | — | — | 1 | 0.48 | 0.20 | 0.05 | 0.05 | 0.06 | 0.02 | 0.02 | 0.07 | 0.03 | 0.04 | 0.05 | 0.12 | 0.09 |
| SEQID-02642 | Q8LH97 | — | — | 1 | 0.43 | 0.16 | 0.06 | 0.06 | 0.14 | 0.01 | 0.03 | 0.07 | 0.05 | 0.04 | 0.06 | 0.08 | 0.12 |
| SEQID-02643 | Q6K8B8 | — | — | 1 | 0.45 | 0.17 | 0.05 | 0.05 | 0.16 | 0.00 | 0.03 | 0.05 | 0.04 | 0.00 | 0.05 | 0.07 | 0.16 |
| SEQID-02644 | Q84M35 | — | — | 1 | 0.49 | 0.20 | 0.04 | 0.04 | 0.13 | 0.01 | 0.03 | 0.07 | 0.03 | 0.01 | 0.04 | 0.06 | 0.14 |
| SEQID-02645 | Q75KH3 | — | — | 1 | 0.40 | 0.19 | 0.09 | 0.04 | 0.09 | 0.01 | 0.05 | 0.07 | 0.05 | 0.01 | 0.07 | 0.06 | 0.10 |

TABLE 1-continued

| | | | | | | | | | | | | | | |
|---|---|---|---|---|---|---|---|---|---|---|---|---|---|---|
| SEQID-02646 | Q6F361 | — | — | 0 | 0.47 | 0.25 | 0.09 | 0.05 | 0.04 | 0.01 | 0.03 | 0.09 | 0.05 | 0.02 | 0.05 | 0.11 | 0.09 |
| SEQID-02647 | Q629P5 | — | — | 1 | 0.53 | 0.14 | 0.05 | 0.05 | 0.07 | 0.01 | 0.02 | 0.07 | 0.04 | 0.03 | 0.09 | 0.09 | 0.06 |
| SEQID-02648 | Q75H31 | — | — | 1 | 0.51 | 0.13 | 0.09 | 0.03 | 0.05 | 0.00 | 0.05 | 0.07 | 0.03 | 0.04 | 0.03 | 0.13 | 0.08 |
| SEQID-02649 | Q62IJ6 | — | — | 1 | 0.50 | 0.21 | 0.05 | 0.06 | 0.07 | 0.03 | 0.03 | 0.09 | 0.08 | 0.03 | 0.08 | 0.07 | 0.11 |
| SEQID-02650 | Q62744 | — | — | 1 | 0.45 | 0.20 | 0.06 | 0.09 | 0.05 | 0.02 | 0.03 | 0.09 | 0.05 | 0.02 | 0.06 | 0.07 | 0.07 |
| SEQID-02651 | Q3S0E1 | — | — | 1 | 0.53 | 0.23 | 0.05 | 0.06 | 0.03 | 0.01 | 0.04 | 0.05 | 0.04 | 0.02 | 0.08 | 0.11 | 0.09 |
| SEQID-02652 | Q10Q18 | — | — | 1 | 0.53 | 0.29 | 0.05 | 0.06 | 0.06 | 0.02 | 0.01 | 0.05 | 0.04 | 0.04 | 0.09 | 0.13 | 0.04 |
| SEQID-02653 | Q62702 | — | — | 1 | 0.43 | 0.18 | 0.07 | 0.09 | 0.04 | 0.01 | 0.04 | 0.07 | 0.04 | 0.02 | 0.05 | 0.06 | 0.07 |
| SEQID-02654 | Q2QSI1 | — | — | 1 | 0.49 | 0.18 | 0.04 | 0.06 | 0.04 | 0.03 | 0.03 | 0.10 | 0.05 | 0.01 | 0.05 | 0.07 | 0.11 |
| SEQID-02655 | Q9SLX0 | — | — | 1 | 0.42 | 0.18 | 0.07 | 0.07 | 0.06 | 0.02 | 0.03 | 0.09 | 0.06 | 0.02 | 0.05 | 0.11 | 0.06 |
| SEQID-02656 | Q0IMT5 | — | — | 1 | 0.37 | 0.16 | 0.09 | 0.14 | 0.02 | 0.02 | 0.03 | 0.07 | 0.04 | 0.01 | 0.04 | 0.06 | 0.04 |
| SEQID-02657 | Q5QMK7 | — | — | 1 | 0.47 | 0.22 | 0.06 | 0.07 | 0.05 | 0.01 | 0.03 | 0.03 | 0.06 | 0.03 | 0.05 | 0.09 | 0.07 |
| SEQID-02658 | Q9LGA3 | — | — | 1 | 0.46 | 0.23 | 0.09 | 0.07 | 0.08 | 0.03 | 0.05 | 0.06 | 0.05 | 0.02 | 0.04 | 0.10 | 0.09 |
| SEQID-02659 | Q10MW3 | — | — | 1 | 0.44 | 0.22 | 0.07 | 0.05 | 0.06 | 0.03 | 0.05 | 0.07 | 0.04 | 0.03 | 0.05 | 0.09 | 0.06 |
| SEQID-02660 | Q6K4K9 | — | — | 1 | 0.46 | 0.28 | 0.06 | 0.07 | 0.03 | 0.02 | 0.06 | 0.09 | 0.02 | 0.02 | 0.07 | 0.13 | 0.05 |
| SEQID-02661 | Q75GT3 | — | — | 1 | 0.42 | 0.23 | 0.06 | 0.11 | 0.05 | 0.01 | 0.06 | 0.10 | 0.04 | 0.01 | 0.06 | 0.09 | 0.07 |
| SEQID-02662 | Q6ZHP6 | — | — | 0 | 0.35 | 0.14 | 0.12 | 0.10 | 0.03 | 0.00 | 0.01 | 0.17 | 0.09 | 0.00 | 0.05 | 0.08 | 0.05 |
| SEQID-02663 | Q0IQK9 | — | — | 1 | 0.36 | 0.24 | 0.16 | 0.10 | 0.05 | 0.07 | 0.02 | 0.00 | 0.05 | 0.01 | 0.07 | 0.10 | 0.05 |
| SEQID-02664 | Q6ZGV5 | — | — | 1 | 0.48 | 0.20 | 0.05 | 0.14 | 0.14 | 0.01 | 0.01 | 0.12 | 0.03 | 0.02 | 0.07 | 0.06 | 0.15 |
| SEQID-02665 | Q762A6 | — | — | 1 | 0.47 | 0.19 | 0.06 | 0.09 | 0.04 | 0.01 | 0.03 | 0.09 | 0.05 | 0.03 | 0.07 | 0.06 | 0.16 |
| SEQID-02666 | Q42990 | — | — | 1 | 0.50 | 0.24 | 0.12 | 0.06 | 0.05 | 0.00 | 0.03 | 0.03 | 0.07 | 0.04 | 0.05 | 0.11 | 0.06 |
| SEQID-02667 | C7TYQ9 | — | — | 1 | 0.46 | 0.22 | 0.06 | 0.11 | 0.04 | 0.00 | 0.09 | 0.05 | 0.03 | 0.04 | 0.05 | 0.09 | 0.05 |
| SEQID-02668 | Q6H7T1 | — | — | 0 | 0.44 | 0.18 | 0.06 | 0.16 | 0.02 | 0.03 | 0.02 | 0.07 | 0.06 | 0.03 | 0.05 | 0.07 | 0.09 |
| SEQID-02669 | Q67VZ0 | — | — | 1 | 0.40 | 0.16 | 0.09 | 0.10 | 0.05 | 0.01 | 0.03 | 0.07 | 0.09 | 0.04 | 0.06 | 0.06 | 0.01 |
| SEQID-02670 | Q6ZH98 | — | — | 1 | 0.49 | 0.17 | 0.04 | 0.07 | 0.03 | 0.03 | 0.06 | 0.05 | 0.09 | 0.03 | 0.02 | 0.04 | 0.08 |
| SEQID-02671 | P49210 | — | — | 1 | 0.53 | 0.25 | 0.04 | 0.10 | 0.05 | 0.00 | 0.02 | 0.06 | 0.03 | 0.03 | 0.04 | 0.03 | 0.10 |
| SEQID-02672 | Q2R4A1 | — | — | 1 | 0.44 | 0.23 | 0.08 | 0.12 | 0.06 | 0.01 | 0.03 | 0.07 | 0.02 | 0.03 | 0.08 | 0.07 | 0.08 |
| SEQID-02673 | Q6L502 | — | — | 1 | 0.46 | 0.20 | 0.06 | 0.03 | 0.05 | 0.00 | 0.05 | 0.05 | 0.04 | 0.01 | 0.09 | 0.11 | 0.13 |
| SEQID-02674 | Q10P60 | — | — | 1 | 0.39 | 0.19 | 0.06 | 0.16 | 0.03 | 0.01 | 0.04 | 0.09 | 0.04 | 0.01 | 0.09 | 0.10 | 0.09 |
| SEQID-02675 | Q9FWV6 | — | — | 1 | 0.50 | 0.26 | 0.11 | 0.07 | 0.02 | 0.07 | 0.01 | 0.03 | 0.04 | 0.04 | 0.02 | 0.14 | 0.05 |
| SEQID-02676 | Q10MT8 | — | — | 1 | 0.41 | 0.22 | 0.07 | 0.06 | 0.03 | 0.01 | 0.03 | 0.09 | 0.03 | 0.04 | 0.04 | 0.09 | 0.01 |
| SEQID-02677 | P49398 | — | — | 1 | 0.51 | 0.33 | 0.04 | 0.10 | 0.05 | 0.01 | 0.03 | 0.04 | 0.05 | 0.08 | 0.08 | 0.08 | 0.13 |
| SEQID-02678 | C7J0T2 | — | — | 1 | 0.42 | 0.17 | 0.05 | 0.14 | 0.03 | 0.10 | 0.01 | 0.09 | 0.07 | 0.05 | 0.04 | 0.09 | 0.03 |
| SEQID-02679 | Q69020 | — | — | 1 | 0.42 | 0.21 | 0.05 | 0.11 | 0.04 | 0.01 | 0.02 | 0.11 | 0.04 | 0.03 | 0.05 | 0.10 | 0.04 |
| SEQID-02680 | Q10R17 | — | — | 1 | 0.43 | 0.23 | 0.05 | 0.09 | 0.03 | 0.02 | 0.01 | 0.07 | 0.06 | 0.03 | 0.05 | 0.10 | 0.05 |
| SEQID-02681 | Q624E4 | — | — | 1 | 0.46 | 0.31 | 0.06 | 0.07 | 0.05 | 0.01 | 0.04 | 0.06 | 0.04 | 0.04 | 0.06 | 0.10 | 0.06 |
| SEQID-02682 | Q10RW9 | — | — | 0 | 0.43 | 0.25 | 0.08 | 0.06 | 0.04 | 0.01 | 0.04 | 0.10 | 0.04 | 0.01 | 0.07 | 0.09 | 0.10 |
| SEQID-02683 | Q7K9A7 | — | — | 1 | 0.45 | 0.26 | 0.09 | 0.03 | 0.03 | 0.00 | 0.04 | 0.11 | 0.05 | 0.01 | 0.08 | 0.09 | 0.08 |
| SEQID-02684 | Q7XV86 | — | — | 0 | 0.45 | 0.18 | 0.05 | 0.04 | 0.05 | 0.01 | 0.02 | 0.13 | 0.08 | 0.02 | 0.07 | 0.09 | 0.13 |
| SEQID-02685 | Q7XMP6 | — | — | 1 | 0.48 | 0.27 | 0.10 | 0.08 | 0.04 | 0.00 | 0.02 | 0.03 | 0.03 | 0.01 | 0.06 | 0.07 | 0.06 |
| SEQID-02686 | Q0DC11 | — | — | 1 | 0.47 | 0.23 | 0.07 | 0.07 | 0.04 | 0.01 | 0.04 | 0.06 | 0.05 | 0.04 | 0.10 | 0.10 | 0.07 |
| SEQID-02687 | Q0D9G9 | — | — | 1 | 0.47 | 0.20 | 0.03 | 0.05 | 0.09 | 0.02 | 0.04 | 0.14 | 0.04 | 0.01 | 0.05 | 0.10 | 0.13 |
| SEQID-02688 | Q0J716 | — | — | 1 | 0.46 | 0.18 | 0.04 | 0.06 | 0.04 | 0.00 | 0.05 | 0.09 | 0.02 | 0.02 | 0.05 | 0.08 | 0.09 |
| SEQID-02689 | Q6ZID6 | — | — | 1 | 0.44 | 0.20 | 0.04 | 0.07 | 0.04 | 0.01 | 0.04 | 0.05 | 0.03 | 0.04 | 0.07 | 0.07 | 0.06 |
| SEQID-02690 | Q10ST8 | — | — | 0 | 0.37 | 0.18 | 0.13 | 0.10 | 0.07 | 0.10 | 0.04 | 0.00 | 0.08 | 0.01 | 0.02 | 0.04 | 0.04 |
| SEQID-02691 | Q0DT04 | — | — | 1 | 0.40 | 0.18 | 0.09 | 0.09 | 0.01 | 0.01 | 0.05 | 0.06 | 0.04 | 0.03 | 0.04 | 0.04 | 0.04 |
| SEQID-02692 | Q34ZP1 | — | — | 1 | 0.52 | 0.25 | 0.02 | 0.12 | 0.09 | 0.01 | 0.04 | 0.07 | 0.05 | 0.03 | 0.08 | 0.08 | 0.10 |
| SEQID-02693 | Q10EK7 | — | — | 0 | 0.43 | 0.24 | 0.14 | 0.08 | 0.03 | 0.00 | 0.02 | 0.03 | 0.08 | 0.02 | 0.03 | 0.09 | 0.13 |
| SEQID-02694 | Q2QXN5 | — | — | 1 | 0.45 | 0.20 | 0.06 | 0.18 | 0.01 | 0.00 | 0.09 | 0.05 | 0.03 | 0.03 | 0.06 | 0.10 | 0.03 |
| SEQID-02695 | Q0IAI2 | — | — | 1 | 0.50 | 0.26 | 0.06 | 0.07 | 0.03 | 0.01 | 0.01 | 0.08 | 0.03 | 0.03 | 0.06 | 0.10 | 0.13 |
| SEQID-02696 | Q2QQ48 | — | — | 0 | 0.49 | 0.30 | 0.04 | 0.04 | 0.05 | 0.02 | 0.02 | 0.08 | 0.03 | 0.01 | 0.05 | 0.10 | 0.14 |
| SEQID-02697 | Q7KXS5 | — | — | 1 | 0.46 | 0.35 | 0.07 | 0.10 | 0.02 | 0.02 | 0.04 | 0.06 | 0.05 | 0.05 | 0.07 | 0.13 | 0.11 |
| SEQID-02698 | Q0DK10 | — | — | 1 | 0.44 | 0.20 | 0.03 | 0.13 | 0.03 | 0.01 | 0.06 | 0.09 | 0.04 | 0.01 | 0.05 | 0.07 | 0.10 |

TABLE 1-continued

| | | | | | | | | | | | | | |
|---|---|---|---|---|---|---|---|---|---|---|---|---|---|
| SEQID-02699 | Q943F3 | — | — | 1 | 0.53 | 0.15 | 0.03 | 0.05 | 0.02 | 0.01 | 0.04 | 0.04 | 0.02 | 0.05 | 0.06 | 0.13 |
| SEQID-02700 | Q1DMS5 | — | — | 0 | 0.47 | 0.22 | 0.05 | 0.04 | 0.05 | 0.00 | 0.03 | 0.09 | 0.02 | 0.06 | 0.07 | 0.12 |
| SEQID-02701 | Q2R1JE | — | — | 1 | 0.43 | 0.20 | 0.03 | 0.05 | 0.04 | 0.00 | 0.03 | 0.03 | 0.04 | 0.04 | 0.10 | 0.09 |
| SEQID-02702 | Q6Y64 | — | — | 1 | 0.51 | 0.18 | 0.07 | 0.02 | 0.07 | 0.03 | 0.02 | 0.05 | 0.02 | 0.05 | 0.08 | 0.16 |
| SEQID-02703 | Q6H6I1 | — | — | 1 | 0.42 | 0.19 | 0.13 | 0.02 | 0.04 | 0.03 | 0.01 | 0.06 | 0.03 | 0.05 | 0.06 | 0.05 |
| SEQID-02704 | Q6YTK5 | — | — | 1 | 0.42 | 0.25 | 0.16 | 0.02 | 0.08 | 0.00 | 0.05 | 0.06 | 0.04 | 0.05 | 0.12 | 0.05 |
| SEQID-02705 | Q6ER94 | — | — | 1 | 0.44 | 0.22 | 0.07 | 0.02 | 0.06 | 0.01 | 0.02 | 0.02 | 0.01 | 0.07 | 0.09 | 0.07 |
| SEQID-02706 | P52428 | — | — | 1 | 0.39 | 0.18 | 0.06 | 0.03 | 0.04 | 0.01 | 0.03 | 0.05 | 0.02 | 0.04 | 0.08 | 0.05 |
| SEQID-02707 | Q8HSN9 | — | — | 1 | 0.51 | 0.25 | 0.09 | 0.03 | 0.02 | 0.01 | 0.03 | 0.09 | 0.03 | 0.09 | 0.08 | 0.05 |
| SEQID-02708 | Q0E3B7 | — | — | 1 | 0.53 | 0.27 | 0.11 | 0.02 | 0.04 | 0.01 | 0.02 | 0.03 | 0.01 | 0.10 | 0.08 | 0.04 |
| SEQID-02709 | Q2R8Z5 | — | — | 1 | 0.51 | 0.22 | 0.10 | 0.05 | 0.05 | 0.03 | 0.05 | 0.04 | 0.04 | 0.07 | 0.06 | 0.05 |
| SEQID-02710 | Q8H8T0 | — | — | 1 | 0.48 | 0.19 | 0.06 | 0.05 | 0.05 | 0.01 | 0.02 | 0.09 | 0.05 | 0.05 | 0.06 | 0.08 |
| SEQID-02711 | Q85059 | — | — | 1 | 0.46 | 0.19 | 0.04 | 0.04 | 0.06 | 0.01 | 0.03 | 0.05 | 0.03 | 0.04 | 0.08 | 0.08 |
| SEQID-02712 | Q5JK10 | — | — | 1 | 0.45 | 0.24 | 0.06 | 0.03 | 0.08 | 0.01 | 0.04 | 0.07 | 0.03 | 0.05 | 0.09 | 0.07 |
| SEQID-02713 | Q6TUF5 | — | — | 1 | 0.46 | 0.21 | 0.08 | 0.04 | 0.03 | 0.02 | 0.02 | 0.06 | 0.01 | 0.06 | 0.10 | 0.09 |
| SEQID-02714 | Q0DJ87 | — | — | 1 | 0.47 | 0.21 | 0.08 | 0.04 | 0.05 | 0.01 | 0.04 | 0.10 | 0.03 | 0.03 | 0.10 | 0.11 |
| SEQID-02715 | Q8RZW7 | — | — | 1 | 0.06 | 0.21 | 0.04 | 0.03 | 0.07 | 0.01 | 0.04 | 0.06 | 0.05 | 0.04 | 0.10 | 0.08 |
| SEQID-02716 | Q6AVT2 | — | — | 1 | 0.04 | 0.22 | 0.07 | 0.05 | 0.07 | 0.02 | 0.04 | 0.05 | 0.01 | 0.04 | 0.08 | 0.06 |
| SEQID-02717 | Q0IK67 | — | — | 1 | 0.42 | 0.21 | 0.07 | 0.03 | 0.10 | 0.02 | 0.03 | 0.05 | 0.05 | 0.05 | 0.10 | 0.06 |
| SEQID-02718 | Q0IP92 | — | — | 1 | 0.48 | 0.28 | 0.06 | 0.04 | 0.06 | 0.01 | 0.03 | 0.05 | 0.04 | 0.07 | 0.12 | 0.03 |
| SEQID-02719 | Q6S4U8 | — | — | 1 | 0.45 | 0.21 | 0.06 | 0.05 | 0.05 | 0.01 | 0.04 | 0.04 | 0.03 | 0.05 | 0.10 | 0.09 |
| SEQID-02720 | Q93VT8 | — | — | 1 | 0.47 | 0.23 | 0.05 | 0.02 | 0.07 | 0.01 | 0.05 | 0.09 | 0.02 | 0.09 | 0.09 | 0.09 |
| SEQID-02721 | Q6K2E8 | — | — | 1 | 0.51 | 0.21 | 0.09 | 0.05 | 0.06 | 0.01 | 0.03 | 0.06 | 0.03 | 0.06 | 0.09 | 0.05 |
| SEQID-02722 | Q8W1L6 | — | — | 1 | 0.49 | 0.26 | 0.06 | 0.06 | 0.06 | 0.01 | 0.04 | 0.06 | 0.03 | 0.07 | 0.11 | 0.13 |
| SEQID-02723 | Q9AQZ5 | — | — | 1 | 0.52 | 0.18 | 0.06 | 0.06 | 0.05 | 0.02 | 0.05 | 0.07 | 0.02 | 0.06 | 0.07 | 0.10 |
| SEQID-02724 | Q9ZWR4 | — | — | 1 | 0.50 | 0.24 | 0.06 | 0.03 | 0.06 | 0.04 | 0.05 | 0.08 | 0.01 | 0.04 | 0.09 | 0.09 |
| SEQID-02725 | P05117 | — | — | 1 | 0.48 | 0.20 | 0.07 | 0.05 | 0.06 | 0.07 | 0.07 | 0.05 | 0.03 | 0.06 | 0.07 | 0.11 |
| SEQID-02726 | Q01K67 | — | — | 1 | 0.52 | 0.22 | 0.06 | 0.05 | 0.09 | 0.02 | 0.03 | 0.05 | 0.05 | 0.07 | 0.06 | 0.18 |
| SEQID-02727 | K48249 | — | — | 0 | 0.58 | 0.10 | 0.00 | 0.00 | 0.04 | 0.00 | 0.01 | 0.20 | 0.23 | 0.04 | 0.05 | 0.23 |
| SEQID-02728 | P14280 | — | — | 0 | 0.53 | 0.17 | 0.09 | 0.02 | 0.03 | 0.02 | 0.03 | 0.09 | 0.02 | 0.07 | 0.05 | 0.08 |
| SEQID-02729 | K4BHR9 | — | — | 1 | 0.48 | 0.23 | 0.06 | 0.04 | 0.04 | 0.02 | 0.06 | 0.04 | 0.03 | 0.06 | 0.09 | 0.06 |
| SEQID-02730 | P17786 | — | — | 1 | 0.47 | 0.21 | 0.06 | 0.04 | 0.04 | 0.01 | 0.03 | 0.04 | 0.05 | 0.05 | 0.09 | 0.06 |
| SEQID-02731 | P09607 | — | — | 1 | 0.33 | 0.17 | 0.02 | 0.05 | 0.08 | 0.09 | 0.06 | 0.10 | 0.06 | 0.04 | 0.08 | 0.13 |
| SEQID-02732 | K4BJW4 | — | — | 1 | 0.44 | 0.22 | 0.07 | 0.03 | 0.02 | 0.02 | 0.05 | 0.06 | 0.02 | 0.04 | 0.07 | 0.10 |
| SEQID-02733 | K4CWR4 | — | — | 1 | 0.48 | 0.21 | 0.02 | 0.05 | 0.03 | 0.02 | 0.05 | 0.10 | 0.01 | 0.04 | 0.11 | 0.09 |
| SEQID-02734 | K4BN62 | — | — | 1 | 0.43 | 0.23 | 0.07 | 0.05 | 0.03 | 0.02 | 0.03 | 0.06 | 0.03 | 0.05 | 0.10 | 0.09 |
| SEQID-02735 | K4BWA9 | — | — | 1 | 0.51 | 0.23 | 0.05 | 0.05 | 0.06 | 0.01 | 0.04 | 0.06 | 0.02 | 0.09 | 0.09 | 0.11 |
| SEQID-02736 | O82575 | — | — | 1 | 0.38 | 0.14 | 0.02 | 0.00 | 0.00 | 0.00 | 0.02 | 0.07 | 0.23 | 0.06 | 0.10 | 0.18 |
| SEQID-02737 | O65819 | — | — | 1 | 0.48 | 0.20 | 0.05 | 0.02 | 0.06 | 0.02 | 0.04 | 0.04 | 0.02 | 0.07 | 0.07 | 0.07 |
| SEQID-02738 | K4CX83 | — | — | 1 | 0.42 | 0.22 | 0.09 | 0.05 | 0.06 | 0.02 | 0.03 | 0.09 | 0.03 | 0.06 | 0.05 | 0.09 |
| SEQID-02739 | P29000 | — | — | 1 | 0.44 | 0.14 | 0.03 | 0.04 | 0.16 | 0.01 | 0.01 | 0.04 | 0.04 | 0.06 | 0.09 | 0.06 |
| SEQID-02740 | K4DBN5 | — | — | 0 | 0.55 | 0.25 | 0.05 | 0.03 | 0.03 | 0.09 | 0.05 | 0.07 | 0.03 | 0.05 | 0.07 | 0.06 |
| SEQID-02741 | K4CQV5 | — | — | 0 | 0.53 | 0.18 | 0.03 | 0.04 | 0.06 | 0.06 | 0.06 | 0.05 | 0.00 | 0.04 | 0.08 | 0.03 |
| SEQID-02742 | P10967 | — | — | 1 | 0.48 | 0.23 | 0.04 | 0.06 | 0.07 | 0.02 | 0.02 | 0.05 | 0.03 | 0.04 | 0.11 | 0.09 |
| SEQID-02743 | Q42382 | — | — | 1 | 0.46 | 0.25 | 0.03 | 0.05 | 0.06 | 0.04 | 0.03 | 0.08 | 0.01 | 0.05 | 0.10 | 0.08 |
| SEQID-02744 | K4CPX6 | — | — | 1 | 0.44 | 0.22 | 0.06 | 0.04 | 0.06 | 0.02 | 0.04 | 0.06 | 0.02 | 0.04 | 0.09 | 0.07 |
| SEQID-02745 | K4D4C8 | — | — | 1 | 0.42 | 0.20 | 0.06 | 0.05 | 0.03 | 0.02 | 0.04 | 0.04 | 0.03 | 0.05 | 0.09 | 0.07 |
| SEQID-02746 | K4CL75 | — | — | 1 | 0.44 | 0.22 | 0.05 | 0.07 | 0.06 | 0.02 | 0.04 | 0.07 | 0.04 | 0.06 | 0.10 | 0.09 |
| SEQID-02747 | K4ASM0 | — | — | 1 | 0.42 | 0.14 | 0.03 | 0.06 | 0.06 | 0.02 | 0.03 | 0.05 | 0.04 | 0.06 | 0.10 | 0.04 |
| SEQID-02748 | K4CBP6 | — | — | 0 | 0.55 | 0.25 | 0.05 | 0.05 | 0.16 | 0.09 | 0.05 | 0.07 | 0.03 | 0.05 | 0.06 | 0.08 |
| SEQID-02749 | P14903 | — | — | 0 | 0.53 | 0.18 | 0.04 | 0.03 | 0.03 | 0.06 | 0.01 | 0.05 | 0.02 | 0.04 | 0.15 | 0.08 |
| SEQID-02750 | P62980 | — | — | 1 | 0.48 | 0.23 | 0.06 | 0.04 | 0.07 | 0.02 | 0.06 | 0.08 | 0.03 | 0.05 | 0.03 | 0.19 |
| SEQID-02751 | K4CUC1 | — | — | 1 | 0.46 | 0.25 | 0.03 | 0.05 | 0.06 | 0.02 | 0.03 | 0.07 | 0.02 | 0.06 | 0.10 | 0.07 |

TABLE 1-continued

| | | | | | | | | | | | | | |
|---|---|---|---|---|---|---|---|---|---|---|---|---|---|
| SEQID-02752 | K4B6D8 | — | — | 1 | 0.49 | 0.21 | 0.02 | 0.03 | 0.07 | 0.04 | 0.01 | 0.04 | 0.03 | 0.03 | 0.07 | 0.10 | 0.07 |
| SEQID-02753 | K4D422 | — | — | 1 | 0.49 | 0.20 | 0.03 | 0.07 | 0.04 | 0.04 | 0.02 | 0.05 | 0.15 | 0.04 | 0.05 | 0.10 | 0.09 |
| SEQID-02754 | K4BX34 | — | — | 1 | 0.42 | 0.21 | 0.07 | 0.08 | 0.05 | 0.03 | 0.01 | 0.04 | 0.08 | 0.03 | 0.05 | 0.10 | 0.07 |
| SEQID-02755 | P24629 | — | — | 1 | 0.46 | 0.24 | 0.05 | 0.06 | 0.05 | 0.07 | 0.00 | 0.04 | 0.10 | 0.04 | 0.07 | 0.07 | 0.10 |
| SEQID-02756 | K4AQY8 | — | — | 0 | 0.42 | 0.22 | 0.09 | 0.10 | 0.03 | 0.08 | 0.01 | 0.05 | 0.06 | 0.04 | 0.01 | 0.06 | 0.05 |
| SEQID-02757 | K4D338 | — | — | 1 | 0.49 | 0.22 | 0.06 | 0.06 | 0.05 | 0.08 | 0.01 | 0.04 | 0.08 | 0.04 | 0.06 | 0.09 | 0.09 |
| SEQID-02758 | K4DBC4 | — | — | 0 | 0.47 | 0.22 | 0.05 | 0.06 | 0.05 | 0.06 | 0.01 | 0.05 | 0.06 | 0.03 | 0.05 | 0.09 | 0.07 |
| SEQID-02759 | Q6LB28 | — | — | 1 | 0.46 | 0.19 | 0.08 | 0.17 | 0.01 | 0.03 | 0.04 | 0.04 | 0.06 | 0.06 | 0.09 | 0.12 | 0.12 |
| SEQID-02760 | K4B1G1 | — | — | 1 | 0.50 | 0.26 | 0.05 | 0.07 | 0.05 | 0.04 | 0.01 | 0.04 | 0.05 | 0.03 | 0.05 | 0.07 | 0.06 |
| SEQID-02761 | K4CI69 | — | — | 1 | 0.44 | 0.17 | 0.06 | 0.07 | 0.06 | 0.05 | 0.04 | 0.06 | 0.03 | 0.02 | 0.05 | 0.12 | 0.09 |
| SEQID-02762 | K4D1H0 | — | — | 1 | 0.34 | 0.13 | 0.05 | 0.09 | 0.07 | 0.05 | 0.05 | 0.07 | 0.02 | 0.07 | 0.05 | 0.06 | 0.03 |
| SEQID-02763 | P15003 | — | — | 0 | 0.43 | 0.22 | 0.08 | 0.06 | 0.09 | 0.05 | 0.03 | 0.05 | 0.03 | 0.05 | 0.05 | 0.10 | 0.04 |
| SEQID-02764 | K4BAW0 | — | — | 1 | 0.43 | 0.22 | 0.07 | 0.07 | 0.05 | 0.04 | 0.00 | 0.04 | 0.08 | 0.04 | 0.04 | 0.10 | 0.07 |
| SEQID-02765 | K4CHY3 | — | — | 1 | 0.52 | 0.27 | 0.07 | 0.03 | 0.03 | 0.04 | 0.01 | 0.06 | 0.08 | 0.06 | 0.05 | 0.12 | 0.12 |
| SEQID-02766 | Q6SKP4 | — | — | 1 | 0.54 | 0.19 | 0.04 | 0.09 | 0.02 | 0.03 | 0.00 | 0.04 | 0.06 | 0.04 | 0.05 | 0.07 | 0.16 |
| SEQID-02767 | K4C711 | — | — | 1 | 0.46 | 0.23 | 0.04 | 0.10 | 0.03 | 0.08 | 0.02 | 0.05 | 0.06 | 0.03 | 0.05 | 0.10 | 0.05 |
| SEQID-02768 | P26300 | — | — | 1 | 0.46 | 0.22 | 0.07 | 0.04 | 0.05 | 0.06 | 0.01 | 0.04 | 0.09 | 0.05 | 0.06 | 0.09 | 0.10 |
| SEQID-02769 | P49118 | — | — | 1 | 0.46 | 0.22 | 0.05 | 0.06 | 0.05 | 0.03 | 0.03 | 0.04 | 0.05 | 0.04 | 0.07 | 0.08 | 0.11 |
| SEQID-02770 | K4BEL1 | — | — | 1 | 0.48 | 0.20 | 0.03 | 0.05 | 0.04 | 0.08 | 0.00 | 0.05 | 0.11 | 0.04 | 0.03 | 0.09 | 0.13 |
| SEQID-02771 | K4BVW7 | — | — | 1 | 0.44 | 0.17 | 0.04 | 0.09 | 0.06 | 0.04 | 0.01 | 0.03 | 0.14 | 0.02 | 0.06 | 0.06 | 0.13 |
| SEQID-02772 | B1N678 | — | — | 0 | 0.41 | 0.13 | 0.05 | 0.17 | 0.03 | 0.07 | 0.10 | 0.02 | 0.08 | 0.04 | 0.05 | 0.07 | 0.06 |
| SEQID-02773 | K4B3H9 | — | — | 1 | 0.22 | 0.09 | 0.03 | 0.16 | 0.05 | 0.01 | 0.01 | 0.04 | 0.08 | 0.22 | 0.01 | 0.02 | 0.03 |
| SEQID-02774 | K4BNT4 | — | — | 1 | 0.59 | 0.27 | 0.02 | 0.01 | 0.02 | 0.07 | 0.02 | 0.02 | 0.11 | 0.00 | 0.12 | 0.10 | 0.01 |
| SEQID-02775 | K4CWC4 | — | — | 0 | 0.55 | 0.25 | 0.04 | 0.01 | 0.03 | 0.08 | 0.01 | 0.03 | 0.03 | 0.07 | 0.07 | 0.07 | 0.16 |
| SEQID-02776 | K4BIL3 | — | — | 1 | 0.46 | 0.23 | 0.04 | 0.10 | 0.05 | 0.06 | 0.03 | 0.05 | 0.09 | 0.05 | 0.06 | 0.10 | 0.05 |
| SEQID-02777 | K4ATQ2 | — | — | 1 | 0.49 | 0.19 | 0.04 | 0.06 | 0.02 | 0.06 | 0.01 | 0.02 | 0.05 | 0.06 | 0.06 | 0.09 | 0.10 |
| SEQID-02778 | K4BP02 | — | — | 1 | 0.43 | 0.20 | 0.04 | 0.18 | 0.03 | 0.05 | 0.03 | 0.04 | 0.08 | 0.04 | 0.03 | 0.08 | 0.09 |
| SEQID-02779 | K4C3V1 | — | — | 1 | 0.41 | 0.17 | 0.03 | 0.22 | 0.03 | 0.02 | 0.00 | 0.05 | 0.04 | 0.04 | 0.03 | 0.07 | 0.10 |
| SEQID-02780 | P12670 | — | — | 1 | 0.45 | 0.14 | 0.06 | 0.19 | 0.04 | 0.08 | 0.00 | 0.04 | 0.07 | 0.03 | 0.03 | 0.07 | 0.18 |
| SEQID-02781 | P93210 | — | — | 1 | 0.41 | 0.13 | 0.05 | 0.06 | 0.07 | 0.06 | 0.07 | 0.03 | 0.03 | 0.06 | 0.03 | 0.06 | 0.04 |
| SEQID-02782 | O65820 | — | — | 0 | 0.40 | 0.20 | 0.06 | 0.07 | 0.06 | 0.02 | 0.01 | 0.03 | 0.14 | 0.02 | 0.01 | 0.10 | 0.08 |
| SEQID-02783 | P37213 | — | — | 0 | 0.52 | 0.14 | 0.13 | 0.04 | 0.02 | 0.04 | 0.01 | 0.02 | 0.07 | 0.00 | 0.00 | 0.04 | 0.29 |
| SEQID-02784 | Q08451 | — | — | 0 | 0.52 | 0.11 | 0.17 | 0.04 | 0.03 | 0.01 | 0.00 | 0.02 | 0.06 | 0.01 | 0.01 | 0.03 | 0.30 |
| SEQID-02785 | K4DA99 | — | — | 1 | 0.52 | 0.24 | 0.08 | 0.06 | 0.03 | 0.03 | 0.01 | 0.03 | 0.04 | 0.01 | 0.03 | 0.09 | 0.04 |
| SEQID-02786 | Q3C2L6 | — | — | 1 | 0.54 | 0.26 | 0.09 | 0.05 | 0.02 | 0.03 | 0.04 | 0.03 | 0.04 | 0.06 | 0.04 | 0.08 | 0.05 |
| SEQID-02787 | P28032 | — | — | 1 | 0.49 | 0.25 | 0.06 | 0.07 | 0.04 | 0.04 | 0.01 | 0.04 | 0.07 | 0.06 | 0.10 | 0.09 | 0.06 |
| SEQID-02788 | K4CL59 | — | — | 1 | 0.51 | 0.23 | 0.06 | 0.06 | 0.04 | 0.05 | 0.04 | 0.02 | 0.08 | 0.05 | 0.06 | 0.09 | 0.08 |
| SEQID-02789 | K4ASC2 | — | — | 1 | 0.47 | 0.24 | 0.05 | 0.05 | 0.04 | 0.06 | 0.01 | 0.05 | 0.08 | 0.04 | 0.06 | 0.10 | 0.06 |
| SEQID-02790 | K4C285 | — | — | 1 | 0.50 | 0.20 | 0.06 | 0.06 | 0.04 | 0.04 | 0.01 | 0.02 | 0.09 | 0.04 | 0.07 | 0.09 | 0.10 |
| SEQID-02791 | K4B8V1 | — | — | 1 | 0.50 | 0.26 | 0.04 | 0.04 | 0.07 | 0.05 | 0.03 | 0.03 | 0.06 | 0.03 | 0.03 | 0.12 | 0.10 |
| SEQID-02792 | K4D8S6 | — | — | 1 | 0.47 | 0.23 | 0.06 | 0.04 | 0.06 | 0.04 | 0.02 | 0.03 | 0.07 | 0.05 | 0.02 | 0.06 | 0.06 |
| SEQID-02793 | K4C764 | — | — | 1 | 0.45 | 0.18 | 0.06 | 0.08 | 0.04 | 0.06 | 0.00 | 0.03 | 0.17 | 0.02 | 0.01 | 0.10 | 0.11 |
| SEQID-02794 | K4BL25 | — | — | 1 | 0.46 | 0.21 | 0.06 | 0.06 | 0.03 | 0.05 | 0.01 | 0.05 | 0.08 | 0.04 | 0.03 | 0.10 | 0.07 |
| SEQID-02795 | F6I015 | — | — | 1 | 0.43 | 0.24 | 0.06 | 0.11 | 0.03 | 0.07 | 0.00 | 0.02 | 0.11 | 0.04 | 0.02 | 0.04 | 0.09 |
| SEQID-03796 | A5B0L2 | — | — | 1 | 0.50 | 0.23 | 0.04 | 0.07 | 0.02 | 0.05 | 0.01 | 0.05 | 0.08 | 0.04 | 0.02 | 0.03 | 0.04 |
| SEQID-02797 | A5BXV1 | — | — | 1 | 0.47 | 0.21 | 0.05 | 0.05 | 0.05 | 0.06 | 0.01 | 0.03 | 0.09 | 0.04 | 0.08 | 0.09 | 0.06 |
| SEQID-02798 | D7T227 | — | — | 1 | 0.47 | 0.21 | 0.05 | 0.05 | 0.07 | 0.06 | 0.04 | 0.03 | 0.09 | 0.04 | 0.10 | 0.07 | 0.06 |
| SEQID-02799 | C5DBS0 | — | — | 1 | 0.48 | 0.22 | 0.07 | 0.04 | 0.02 | 0.06 | 0.01 | 0.04 | 0.08 | 0.05 | 0.07 | 0.07 | 0.11 |
| SEQID-02800 | F6H4T7 | — | — | 1 | 0.47 | 0.22 | 0.05 | 0.05 | 0.06 | 0.04 | 0.01 | 0.03 | 0.08 | 0.06 | 0.04 | 0.08 | 0.06 |
| SEQID-02801 | F6HKH3 | — | — | 1 | 0.47 | 0.23 | 0.05 | 0.06 | 0.04 | 0.06 | 0.02 | 0.02 | 0.07 | 0.04 | 0.05 | 0.08 | 0.08 |
| SEQID-02802 | F6HXK4 | — | — | 1 | 0.51 | 0.27 | 0.06 | 0.03 | 0.03 | 0.05 | 0.01 | 0.05 | 0.09 | 0.05 | 0.02 | 0.03 | 0.10 |
| SEQID-02803 | A5CSK3 | — | — | 1 | 0.50 | 0.22 | 0.05 | 0.07 | 0.04 | 0.06 | 0.02 | 0.04 | 0.08 | 0.04 | 0.03 | 0.10 | 0.06 |
| SEQID-02804 | F6HNX5 | — | — | 1 | 0.45 | 0.20 | 0.06 | 0.06 | 0.05 | 0.08 | 0.01 | 0.04 | 0.09 | 0.04 | 0.01 | 0.07 | 0.09 |

TABLE 1-continued

| SEQID | Name | | | | | | | | | | | | | | | |
|---|---|---|---|---|---|---|---|---|---|---|---|---|---|---|---|---|
| SEQID-02805 | A5B118 | — | 1 | 0.46 | 0.22 | 0.07 | 0.06 | 0.04 | 0.03 | 0.02 | 0.03 | 0.10 | 0.05 | 0.02 | 0.04 | 0.11 | 0.10 |
| SEQID-02806 | A5CAF6 | — | 1 | 0.53 | 0.28 | 0.07 | 0.06 | 0.04 | 0.07 | 0.00 | 0.01 | 0.09 | 0.06 | 0.02 | 0.05 | 0.13 | 0.12 |
| SEQID-02807 | A5AFS1 | — | 1 | 0.52 | 0.21 | 0.04 | 0.06 | 0.04 | 0.06 | 0.01 | 0.02 | 0.09 | 0.04 | 0.03 | 0.07 | 0.06 | 0.12 |
| SEQID-02808 | A5C0I8 | — | 1 | 0.49 | 0.23 | 0.05 | 0.06 | 0.05 | 0.05 | 0.03 | 0.02 | 0.09 | 0.05 | 0.03 | 0.06 | 0.07 | 0.08 |
| SEQID-02809 | F6HLD8 | — | 1 | 0.45 | 0.20 | 0.06 | 0.06 | 0.05 | 0.08 | 0.01 | 0.04 | 0.09 | 0.04 | 0.01 | 0.07 | 0.07 | 0.10 |
| SEQID-02810 | F6HG44 | — | 1 | 0.52 | 0.23 | 0.06 | 0.05 | 0.04 | 0.07 | 0.01 | 0.03 | 0.06 | 0.04 | 0.03 | 0.06 | 0.06 | 0.10 |
| SEQID-02811 | F6HCG2 | — | 1 | 0.45 | 0.22 | 0.04 | 0.10 | 0.04 | 0.06 | 0.03 | 0.03 | 0.08 | 0.02 | 0.04 | 0.06 | 0.09 | 0.06 |
| SEQID-02812 | A5C6H7 | — | 0 | 0.47 | 0.22 | 0.04 | 0.01 | 0.00 | 0.07 | 0.04 | 0.02 | 0.08 | 0.03 | 0.05 | 0.03 | 0.10 | 0.05 |
| SEQID-02813 | F6H0C4 | — | 1 | 0.46 | 0.12 | 0.02 | 0.05 | 0.04 | 0.04 | 0.02 | 0.02 | 0.27 | 0.05 | 0.03 | 0.03 | 0.04 | 0.22 |
| SEQID-02814 | F6GSG7 | — | 1 | 0.53 | 0.23 | 0.06 | 0.05 | 0.04 | 0.06 | 0.01 | 0.03 | 0.07 | 0.05 | 0.02 | 0.07 | 0.06 | 0.10 |
| SEQID-02815 | F6HFF7 | — | 1 | 0.46 | 0.20 | 0.06 | 0.06 | 0.04 | 0.06 | 0.03 | 0.03 | 0.07 | 0.05 | 0.02 | 0.06 | 0.07 | 0.08 |
| SEQID-02816 | F6HXC8 | — | 1 | 0.46 | 0.20 | 0.03 | 0.08 | 0.03 | 0.06 | 0.04 | 0.03 | 0.09 | 0.04 | 0.05 | 0.06 | 0.07 | 0.06 |
| SEQID-02817 | D7TCM7 | — | 1 | 0.46 | 0.23 | 0.03 | 0.10 | 0.04 | 0.07 | 0.07 | 0.04 | 0.07 | 0.04 | 0.01 | 0.08 | 0.10 | 0.05 |
| SEQID-02818 | D7TBH4 | — | 1 | 0.47 | 0.24 | 0.05 | 0.06 | 0.04 | 0.09 | 0.05 | 0.03 | 0.09 | 0.04 | 0.02 | 0.06 | 0.12 | 0.09 |
| SEQID-02819 | F6I407 | — | 1 | 0.45 | 0.20 | 0.05 | 0.04 | 0.03 | 0.05 | 0.03 | 0.03 | 0.18 | 0.02 | 0.02 | 0.04 | 0.06 | 0.05 |
| SEQID-02820 | D7TQP5 | — | 1 | 0.42 | 0.21 | 0.06 | 0.10 | 0.05 | 0.04 | 0.03 | 0.03 | 0.11 | 0.04 | 0.04 | 0.08 | 0.08 | 0.11 |
| SEQID-02821 | A5BT28 | — | 1 | 0.48 | 0.22 | 0.07 | 0.09 | 0.03 | 0.08 | 0.05 | 0.01 | 0.10 | 0.04 | 0.01 | 0.07 | 0.11 | 0.07 |
| SEQID-02822 | F6I2F8 | — | 0 | 0.42 | 0.25 | 0.04 | 0.06 | 0.02 | 0.06 | 0.03 | 0.01 | 0.07 | 0.02 | 0.02 | 0.07 | 0.11 | 0.09 |
| SEQID-02823 | F6HHU9 | — | 1 | 0.48 | 0.20 | 0.04 | 0.04 | 0.03 | 0.05 | 0.03 | 0.03 | 0.12 | 0.03 | 0.03 | 0.05 | 0.09 | 0.06 |
| SEQID-02824 | D7T7Y3 | — | 1 | 0.46 | 0.21 | 0.05 | 0.03 | 0.04 | 0.04 | 0.03 | 0.02 | 0.23 | 0.04 | 0.03 | 0.06 | 0.08 | 0.10 |
| SEQID-02825 | D7SJV3 | — | 1 | 0.47 | 0.23 | 0.05 | 0.07 | 0.05 | 0.06 | 0.03 | 0.03 | 0.06 | 0.04 | 0.03 | 0.06 | 0.11 | 0.06 |
| SEQID-02826 | F6HMP1 | — | 0 | 0.40 | 0.08 | 0.01 | 0.06 | 0.00 | 0.00 | 0.06 | 0.02 | 0.09 | 0.02 | 0.02 | 0.06 | 0.02 | 0.07 |
| SEQID-02827 | A5AML5 | — | 1 | 0.56 | 0.23 | 0.05 | 0.06 | 0.03 | 0.04 | 0.07 | 0.00 | 0.22 | 0.18 | 0.10 | 0.06 | 0.07 | 0.14 |
| SEQID-02828 | D75KR5 | — | 1 | 0.46 | 0.19 | 0.06 | 0.02 | 0.02 | 0.04 | 0.02 | 0.00 | 0.15 | 0.03 | 0.03 | 0.03 | 0.12 | 0.12 |
| SEQID-02829 | F6H3T7 | — | 1 | 0.46 | 0.22 | 0.06 | 0.06 | 0.02 | 0.06 | 0.03 | 0.01 | 0.11 | 0.05 | 0.03 | 0.04 | 0.10 | 0.10 |
| SEQID-02830 | D7TJ46 | — | 1 | 0.49 | 0.23 | 0.07 | 0.07 | 0.03 | 0.05 | 0.03 | 0.01 | 0.07 | 0.04 | 0.02 | 0.06 | 0.09 | 0.06 |
| SEQID-02831 | F6I0H8 | — | 1 | 0.52 | 0.27 | 0.03 | 0.05 | 0.03 | 0.05 | 0.04 | 0.01 | 0.10 | 0.05 | 0.01 | 0.07 | 0.08 | 0.11 |
| SEQID-02832 | F6HAM6 | — | 1 | 0.46 | 0.20 | 0.07 | 0.03 | 0.04 | 0.05 | 0.02 | 0.01 | 0.09 | 0.04 | 0.04 | 0.07 | 0.11 | 0.11 |
| SEQID-02833 | F6HMN8 | — | 1 | 0.49 | 0.22 | 0.06 | 0.07 | 0.03 | 0.05 | 0.03 | 0.01 | 0.08 | 0.05 | 0.04 | 0.06 | 0.09 | 0.07 |
| SEQID-02834 | D7T1R6 | — | 1 | 0.47 | 0.22 | 0.05 | 0.06 | 0.05 | 0.06 | 0.03 | 0.01 | 0.07 | 0.05 | 0.02 | 0.06 | 0.08 | 0.09 |
| SEQID-02835 | D7TLU7 | — | 1 | 0.50 | 0.25 | 0.07 | 0.04 | 0.05 | 0.03 | 0.03 | 0.01 | 0.10 | 0.05 | 0.03 | 0.06 | 0.07 | 0.07 |
| SEQID-02836 | F6H5V8 | — | 0 | 0.14 | 0.03 | 0.01 | 0.10 | 0.01 | 0.03 | 0.04 | 0.02 | 0.17 | 0.09 | 0.03 | 0.01 | 0.01 | 0.06 |
| SEQID-02837 | D7T0U8 | — | 1 | 0.48 | 0.21 | 0.07 | 0.05 | 0.04 | 0.06 | 0.02 | 0.01 | 0.05 | 0.04 | 0.02 | 0.06 | 0.06 | 0.09 |
| SEQID-02838 | A5AEI5 | — | 0 | 0.52 | 0.26 | 0.02 | 0.07 | 0.03 | 0.09 | 0.09 | 0.00 | 0.08 | 0.04 | 0.02 | 0.09 | 0.12 | 0.11 |
| SEQID-02839 | F6HGH4 | — | 1 | 0.47 | 0.22 | 0.05 | 0.04 | 0.03 | 0.06 | 0.03 | 0.03 | 0.03 | 0.05 | 0.01 | 0.07 | 0.09 | 0.09 |
| SEQID-02840 | F6GV71 | — | 1 | 0.45 | 0.23 | 0.06 | 0.05 | 0.06 | 0.06 | 0.04 | 0.04 | 0.07 | 0.05 | 0.01 | 0.07 | 0.09 | 0.06 |
| SEQID-02841 | F6HL03 | — | 1 | 0.48 | 0.20 | 0.06 | 0.06 | 0.04 | 0.04 | 0.04 | 0.02 | 0.09 | 0.04 | 0.01 | 0.08 | 0.09 | 0.06 |
| SEQID-02842 | D75QC6 | — | 1 | 0.45 | 0.17 | 0.04 | 0.07 | 0.03 | 0.05 | 0.05 | 0.01 | 0.10 | 0.05 | 0.04 | 0.05 | 0.08 | 0.09 |
| SEQID-02843 | A5B878 | — | 1 | 0.51 | 0.23 | 0.03 | 0.06 | 0.03 | 0.05 | 0.02 | 0.00 | 0.09 | 0.02 | 0.02 | 0.05 | 0.07 | 0.06 |
| SEQID-02844 | A5AKD3 | — | 1 | 0.52 | 0.17 | 0.05 | 0.09 | 0.08 | 0.07 | 0.02 | 0.01 | 0.06 | 0.06 | 0.03 | 0.10 | 0.06 | 0.09 |
| SEQID-02845 | A5BQN6 | — | 1 | 0.50 | 0.17 | 0.04 | 0.04 | 0.04 | 0.05 | 0.02 | 0.02 | 0.05 | 0.09 | 0.03 | 0.05 | 0.04 | 0.08 |
| SEQID-02846 | Q9M4H7 | — | 0 | 0.31 | 0.12 | 0.12 | 0.00 | 0.01 | 0.04 | 0.04 | 0.02 | 0.07 | 0.08 | 0.03 | 0.00 | 0.01 | 0.09 |
| SEQID-02847 | F6HUD1 | — | 1 | 0.47 | 0.20 | 0.04 | 0.02 | 0.05 | 0.04 | 0.04 | 0.00 | 0.36 | 0.00 | 0.00 | 0.06 | 0.04 | 0.03 |
| SEQID-02848 | C5DB51 | — | 1 | 0.51 | 0.26 | 0.06 | 0.07 | 0.04 | 0.06 | 0.05 | 0.02 | 0.06 | 0.04 | 0.01 | 0.06 | 0.12 | 0.10 |
| SEQID-02849 | D7TA34 | — | 1 | 0.49 | 0.22 | 0.05 | 0.06 | 0.04 | 0.04 | 0.02 | 0.02 | 0.09 | 0.04 | 0.01 | 0.08 | 0.09 | 0.12 |
| SEQID-02850 | F6HDX3 | — | 1 | 0.38 | 0.19 | 0.08 | 0.06 | 0.06 | 0.05 | 0.05 | 0.01 | 0.10 | 0.03 | 0.04 | 0.05 | 0.08 | 0.09 |
| SEQID-02851 | D75UQ2 | — | 1 | 0.49 | 0.20 | 0.04 | 0.09 | 0.03 | 0.07 | 0.02 | 0.00 | 0.14 | 0.02 | 0.02 | 0.05 | 0.07 | 0.06 |
| SEQID-02852 | D7FBC0 | — | 1 | 0.52 | 0.25 | 0.04 | 0.07 | 0.05 | 0.05 | 0.03 | 0.02 | 0.06 | 0.06 | 0.03 | 0.10 | 0.06 | 0.08 |
| SEQID-02853 | F6HFL6 | — | 1 | 0.47 | 0.17 | 0.05 | 0.04 | 0.05 | 0.06 | 0.04 | 0.02 | 0.07 | 0.04 | 0.04 | 0.05 | 0.04 | 0.09 |
| SEQID-02854 | D7TBL7 | — | 1 | 0.42 | 0.25 | 0.04 | 0.04 | 0.03 | 0.05 | 0.03 | 0.01 | 0.09 | 0.04 | 0.03 | 0.05 | 0.04 | 0.03 |
| SEQID-02855 | F6HL2 | — | 1 | 0.46 | 0.23 | 0.07 | 0.07 | 0.04 | 0.06 | 0.04 | 0.01 | 0.05 | 0.04 | 0.01 | 0.06 | 0.09 | 0.10 |
| SEQID-02856 | F6HLZ6 | — | 1 | 0.42 | 0.17 | 0.06 | 0.03 | 0.04 | 0.04 | 0.04 | 0.02 | 0.09 | 0.04 | 0.03 | 0.04 | 0.10 | 0.07 |
| SEQID-02857 | D7TVX5 | — | 1 | 0.43 | 0.18 | 0.04 | 0.07 | 0.05 | 0.06 | 0.05 | 0.02 | 0.10 | 0.04 | 0.02 | 0.04 | 0.03 | 0.04 |
| | | | 1 | 0.47 | 0.21 | 0.06 | 0.06 | 0.05 | 0.07 | 0.05 | 0.01 | 0.07 | 0.02 | 0.02 | 0.03 | 0.11 | 0.07 |

TABLE 1-continued

| | | | | | | | | | | | | | | |
|---|---|---|---|---|---|---|---|---|---|---|---|---|---|---|
| SEQID-02858 | F6H710 | — | 1 | 0.47 | 0.23 | 0.06 | 0.05 | 0.03 | 0.06 | 0.02 | 0.04 | 0.09 | 0.04 | 0.03 | 0.06 | 0.09 | 0.09 |
| SEQID-02859 | F6HAU0 | — | 1 | 0.48 | 0.22 | 0.04 | 0.05 | 0.04 | 0.09 | 0.01 | 0.03 | 0.05 | 0.05 | 0.03 | 0.06 | 0.09 | 0.03 |
| SEQID-02860 | D7TJI9 | — | 1 | 0.46 | 0.23 | 0.06 | 0.06 | 0.05 | 0.05 | 0.02 | 0.03 | 0.07 | 0.03 | 0.03 | 0.07 | 0.08 | 0.05 |
| SEQID-02861 | F6H7B3 | — | 1 | 0.47 | 0.22 | 0.05 | 0.06 | 0.04 | 0.09 | 0.01 | 0.04 | 0.11 | 0.04 | 0.01 | 0.09 | 0.09 | 0.11 |
| SEQID-02862 | D7TVF4 | — | 1 | 0.49 | 0.23 | 0.03 | 0.05 | 0.04 | 0.05 | 0.02 | 0.03 | 0.09 | 0.03 | 0.01 | 0.07 | 0.09 | 0.10 |
| SEQID-02863 | D7TZ79 | — | 1 | 0.53 | 0.27 | 0.08 | 0.10 | 0.04 | 0.07 | 0.01 | 0.04 | 0.09 | 0.05 | 0.01 | 0.09 | 0.10 | 0.05 |
| SEQID-02864 | F6H2N7 | — | 1 | 0.45 | 0.22 | 0.05 | 0.16 | 0.03 | 0.06 | 0.02 | 0.05 | 0.09 | 0.05 | 0.03 | 0.04 | 0.12 | 0.06 |
| SEQID-02865 | F6HQM5 | — | 1 | 0.22 | 0.09 | 0.03 | 0.02 | 0.03 | 0.07 | 0.01 | 0.04 | 0.08 | 0.03 | 0.06 | 0.07 | 0.03 | 0.01 |
| SEQID-02866 | Q9FS43 | — | 0 | 0.52 | 0.20 | 0.06 | 0.09 | 0.05 | 0.06 | 0.02 | 0.02 | 0.09 | 0.04 | 0.01 | 0.09 | 0.04 | 0.12 |
| SEQID-02867 | F6GX20 | — | 1 | 0.44 | 0.25 | 0.04 | 0.04 | 0.01 | 0.07 | 0.02 | 0.04 | 0.09 | 0.03 | 0.04 | 0.03 | 0.09 | 0.06 |
| SEQID-02868 | F6HDT7 | — | 1 | 0.42 | 0.16 | 0.04 | 0.09 | 0.06 | 0.10 | 0.02 | 0.03 | 0.10 | 0.03 | 0.03 | 0.05 | 0.09 | 0.07 |
| SEQID-02869 | F6GU22 | — | 1 | 0.40 | 0.19 | 0.04 | 0.03 | 0.04 | 0.07 | 0.07 | 0.03 | 0.04 | 0.03 | 0.04 | 0.07 | 0.07 | 0.05 |
| SEQID-02870 | A5AX75 | — | 1 | 0.45 | 0.31 | 0.06 | 0.05 | 0.06 | 0.05 | 0.01 | 0.04 | 0.14 | 0.04 | 0.02 | 0.04 | 0.13 | 0.08 |
| SEQID-02871 | Q0MX16 | — | 1 | 0.53 | 0.25 | 0.09 | 0.05 | 0.03 | 0.03 | 0.01 | 0.04 | 0.05 | 0.03 | 0.02 | 0.09 | 0.09 | 0.05 |
| SEQID-02872 | A5AP38 | — | 1 | 0.42 | 0.18 | 0.05 | 0.07 | 0.05 | 0.06 | 0.01 | 0.03 | 0.09 | 0.03 | 0.03 | 0.09 | 0.06 | 0.06 |
| SEQID-02873 | D7SZX9 | — | 1 | 0.49 | 0.24 | 0.06 | 0.03 | 0.03 | 0.10 | 0.01 | 0.03 | 0.03 | 0.05 | 0.01 | 0.05 | 0.11 | 0.08 |
| SEQID-02874 | D7TMY3 | — | 1 | 0.48 | 0.24 | 0.06 | 0.08 | 0.04 | 0.06 | 0.03 | 0.03 | 0.08 | 0.03 | 0.03 | 0.06 | 0.03 | 0.06 |
| SEQID-02875 | D7TCC4 | — | 1 | 0.47 | 0.23 | 0.04 | 0.03 | 0.02 | 0.04 | 0.01 | 0.03 | 0.10 | 0.03 | 0.02 | 0.07 | 0.09 | 0.06 |
| SEQID-02876 | F6GUN5 | — | 1 | 0.46 | 0.20 | 0.08 | 0.12 | 0.05 | 0.04 | 0.00 | 0.03 | 0.05 | 0.05 | 0.03 | 0.06 | 0.06 | 0.12 |
| SEQID-02877 | D7TVX4 | — | 1 | 0.47 | 0.21 | 0.03 | 0.09 | 0.04 | 0.06 | 0.02 | 0.03 | 0.07 | 0.03 | 0.03 | 0.06 | 0.10 | 0.07 |
| SEQID-02878 | D7UD99 | — | 1 | 0.44 | 0.17 | 0.03 | 0.10 | 0.06 | 0.06 | 0.01 | 0.03 | 0.06 | 0.03 | 0.05 | 0.05 | 0.07 | 0.05 |
| SEQID-02879 | F6GK4 | — | 1 | 0.45 | 0.17 | 0.03 | 0.09 | 0.06 | 0.06 | 0.01 | 0.03 | 0.07 | 0.03 | 0.05 | 0.04 | 0.06 | 0.06 |
| SEQID-02880 | F6GTT4 | — | 1 | 0.51 | 0.23 | 0.03 | 0.05 | 0.04 | 0.06 | 0.01 | 0.01 | 0.22 | 0.05 | 0.00 | 0.07 | 0.03 | 0.10 |
| SEQID-02881 | F6GTT2 | — | 0 | 0.44 | 0.25 | 0.07 | 0.19 | 0.02 | 0.05 | 0.00 | 0.03 | 0.07 | 0.02 | 0.03 | 0.05 | 0.10 | 0.18 |
| SEQID-02882 | F6HEU9 | — | 1 | 0.34 | 0.15 | 0.05 | 0.04 | 0.03 | 0.05 | 0.03 | 0.05 | 0.09 | 0.02 | 0.04 | 0.03 | 0.05 | 0.05 |
| SEQID-02883 | Q4U339 | — | 1 | 0.54 | 0.25 | 0.05 | 0.05 | 0.04 | 0.06 | 0.01 | 0.13 | 0.03 | 0.04 | 0.04 | 0.10 | 0.07 | 0.03 |
| SEQID-02884 | F6HYG1 | — | 1 | 0.51 | 0.21 | 0.05 | 0.14 | 0.01 | 0.07 | 0.01 | 0.04 | 0.07 | 0.01 | 0.02 | 0.08 | 0.13 | 0.06 |
| SEQID-02885 | F6HFK7 | — | 1 | 0.44 | 0.20 | 0.09 | 0.05 | 0.02 | 0.04 | 0.02 | 0.05 | 0.11 | 0.04 | 0.01 | 0.05 | 0.07 | 0.10 |
| SEQID-02886 | A8M68 | — | 1 | 0.39 | 0.19 | 0.06 | 0.06 | 0.05 | 0.05 | 0.00 | 0.09 | 0.09 | 0.03 | 0.02 | 0.05 | 0.10 | 0.09 |
| SEQID-02887 | F6H8W9 | — | 1 | 0.51 | 0.18 | 0.07 | 0.08 | 0.07 | 0.06 | 0.01 | 0.03 | 0.05 | 0.03 | 0.01 | 0.04 | 0.11 | 0.06 |
| SEQID-02888 | A5B3K2 | — | 0 | 0.52 | 0.25 | 0.03 | 0.03 | 0.07 | 0.04 | 0.01 | 0.05 | 0.11 | 0.04 | 0.01 | 0.06 | 0.09 | 0.11 |
| SEQID-02889 | D7SYA1 | — | 1 | 0.49 | 0.18 | 0.06 | 0.01 | 0.04 | 0.03 | 0.01 | 0.05 | 0.05 | 0.02 | 0.00 | 0.05 | 0.05 | 0.17 |
| SEQID-02890 | D7U394 | — | 1 | 0.46 | 0.15 | 0.05 | 0.19 | 0.03 | 0.02 | 0.00 | 0.03 | 0.22 | 0.02 | 0.03 | 0.03 | 0.07 | 0.18 |
| SEQID-02891 | D7T745 | — | 1 | 0.54 | 0.25 | 0.05 | 0.04 | 0.03 | 0.05 | 0.03 | 0.05 | 0.07 | 0.02 | 0.03 | 0.05 | 0.07 | 0.03 |
| SEQID-02892 | A5BIQ8 | — | 1 | 0.46 | 0.21 | 0.06 | 0.06 | 0.04 | 0.07 | 0.01 | 0.03 | 0.07 | 0.03 | 0.04 | 0.03 | 0.10 | 0.06 |
| SEQID-02893 | Q5PXH0 | — | 1 | 0.48 | 0.20 | 0.04 | 0.14 | 0.01 | 0.04 | 0.01 | 0.03 | 0.07 | 0.03 | 0.02 | 0.08 | 0.06 | 0.10 |
| SEQID-02894 | F6I0K9 | — | 1 | 0.53 | 0.25 | 0.09 | 0.05 | 0.02 | 0.04 | 0.01 | 0.03 | 0.03 | 0.02 | 0.02 | 0.09 | 0.09 | 0.04 |
| SEQID-02895 | D7U9L9 | — | 1 | 0.47 | 0.24 | 0.03 | 0.07 | 0.02 | 0.07 | 0.02 | 0.04 | 0.10 | 0.03 | 0.03 | 0.06 | 0.09 | 0.09 |
| SEQID-02896 | A5BIN1 | — | 1 | 0.46 | 0.23 | 0.05 | 0.08 | 0.03 | 0.06 | 0.00 | 0.02 | 0.09 | 0.04 | 0.02 | 0.06 | 0.06 | 0.08 |
| SEQID-02897 | F6GSQ2 | — | 1 | 0.46 | 0.22 | 0.03 | 0.09 | 0.05 | 0.05 | 0.02 | 0.02 | 0.08 | 0.02 | 0.03 | 0.08 | 0.09 | 0.06 |
| SEQID-02898 | F6GY49 | — | 1 | 0.44 | 0.21 | 0.05 | 0.07 | 0.04 | 0.05 | 0.01 | 0.03 | 0.09 | 0.03 | 0.03 | 0.08 | 0.03 | 0.06 |
| SEQID-02899 | F6H2P8 | — | 1 | 0.53 | 0.17 | 0.04 | 0.11 | 0.04 | 0.05 | 0.00 | 0.03 | 0.07 | 0.06 | 0.05 | 0.05 | 0.05 | 0.15 |
| SEQID-02900 | F6H15 | — | 1 | 0.49 | 0.26 | 0.07 | 0.06 | 0.05 | 0.05 | 0.01 | 0.05 | 0.07 | 0.04 | 0.02 | 0.06 | 0.12 | 0.08 |
| SEQID-02901 | D7TLZ5 | — | 1 | 0.47 | 0.24 | 0.05 | 0.03 | 0.04 | 0.06 | 0.00 | 0.03 | 0.07 | 0.03 | 0.02 | 0.08 | 0.07 | 0.09 |
| SEQID-02902 | F6I1W0 | — | 1 | 0.52 | 0.26 | 0.06 | 0.05 | 0.05 | 0.05 | 0.01 | 0.02 | 0.10 | 0.03 | 0.03 | 0.06 | 0.10 | 0.09 |
| SEQID-02903 | F6HXL0 | — | 1 | 0.49 | 0.22 | 0.04 | 0.05 | 0.03 | 0.05 | 0.01 | 0.05 | 0.09 | 0.04 | 0.03 | 0.06 | 0.08 | 0.07 |
| SEQID-02904 | F6HUX3 | — | 1 | 0.43 | 0.22 | 0.05 | 0.07 | 0.03 | 0.05 | 0.02 | 0.03 | 0.05 | 0.05 | 0.02 | 0.03 | 0.09 | 0.06 |
| SEQID-02905 | F6HSN5 | — | 1 | 0.34 | 0.16 | 0.03 | 0.06 | 0.05 | 0.06 | 0.00 | 0.04 | 0.06 | 0.07 | 0.02 | 0.05 | 0.09 | 0.04 |
| SEQID-02906 | F6I6WS | — | 1 | 0.46 | 0.23 | 0.09 | 0.06 | 0.05 | 0.06 | 0.02 | 0.04 | 0.06 | 0.12 | 0.03 | 0.05 | 0.10 | 0.06 |
| SEQID-02907 | E0CR04 | — | 1 | 0.47 | 0.23 | 0.05 | 0.05 | 0.03 | 0.05 | 0.01 | 0.03 | 0.04 | 0.03 | 0.02 | 0.06 | 0.12 | 0.09 |
| SEQID-02908 | F6HCU9 | — | 1 | 0.49 | 0.21 | 0.04 | 0.06 | 0.05 | 0.07 | 0.01 | 0.03 | 0.07 | 0.06 | 0.04 | 0.05 | 0.10 | 0.15 |
| SEQID-02909 | F6HH37 | — | 1 | 0.34 | 0.18 | 0.02 | 0.04 | 0.04 | 0.03 | 0.02 | 0.02 | 0.14 | 0.04 | 0.02 | 0.04 | 0.09 | 0.03 |
| SEQID-02910 | F6HES2 | — | 0 | 0.41 | 0.23 | 0.05 | 0.02 | 0.04 | 0.09 | 0.01 | 0.01 | 0.20 | 0.02 | 0.02 | 0.04 | 0.06 | 0.10 |

TABLE 1-continued

| | | | | | | | | | | | | | | |
|---|---|---|---|---|---|---|---|---|---|---|---|---|---|---|
| SEQID-02911 | F6GUN0 | — | 1 | 0.44 | 0.24 | 0.07 | 0.06 | 0.03 | 0.06 | 0.02 | 0.07 | 0.09 | 0.02 | 0.05 | 0.13 | 0.05 |
| SEQID-02912 | A5BAX1 | — | 1 | 0.52 | 0.20 | 0.03 | 0.02 | 0.04 | 0.06 | 0.02 | 0.03 | 0.14 | 0.03 | 0.06 | 0.09 | 0.07 | 0.11 |
| SEQID-02913 | A5C3I9 | — | 0 | 0.50 | 0.20 | 0.04 | 0.04 | 0.03 | 0.11 | 0.02 | 0.04 | 0.07 | 0.05 | 0.06 | 0.07 | 0.06 | 0.11 |
| SEQID-02914 | A5C718 | — | 1 | 0.46 | 0.16 | 0.05 | 0.03 | 0.04 | 0.04 | 0.03 | 0.02 | 0.05 | 0.07 | 0.03 | 0.05 | 0.10 | 0.06 |
| SEQID-02915 | D7SJX8 | — | 1 | 0.57 | 0.22 | 0.03 | 0.04 | 0.03 | 0.05 | 0.00 | 0.02 | 0.07 | 0.02 | 0.01 | 0.05 | 0.06 | 0.11 |
| SEQID-02916 | D7UC61 | — | 1 | 0.46 | 0.15 | 0.09 | 0.04 | 0.07 | 0.04 | 0.02 | 0.03 | 0.17 | 0.02 | 0.05 | 0.02 | 0.09 | 0.19 |
| SEQID-02917 | F6HUH1 | — | 1 | 0.42 | 0.15 | 0.03 | 0.05 | 0.05 | 0.07 | 0.01 | 0.02 | 0.03 | 0.05 | 0.01 | 0.04 | 0.06 | 0.04 |
| SEQID-02918 | D7T5I6 | — | 1 | 0.44 | 0.22 | 0.06 | 0.04 | 0.02 | 0.06 | 0.02 | 0.03 | 0.11 | 0.05 | 0.02 | 0.06 | 0.09 | 0.06 |
| SEQID-02919 | D7SGX1 | — | 1 | 0.47 | 0.25 | 0.06 | 0.04 | 0.05 | 0.09 | 0.01 | 0.02 | 0.11 | 0.03 | 0.02 | 0.07 | 0.11 | 0.10 |
| SEQID-02920 | F6GSZ1 | — | 0 | 0.25 | 0.11 | 0.05 | 0.09 | 0.02 | 0.06 | 0.00 | 0.02 | 0.05 | 0.17 | 0.01 | 0.03 | 0.10 | 0.02 |
| SEQID-02921 | A5B427 | — | 1 | 0.50 | 0.24 | 0.04 | 0.06 | 0.04 | 0.07 | 0.01 | 0.03 | 0.08 | 0.04 | 0.05 | 0.06 | 0.03 | 0.05 |
| SEQID-02922 | F6H6J3 | — | 1 | 0.33 | 0.18 | 0.06 | 0.03 | 0.02 | 0.11 | 0.00 | 0.04 | 0.05 | 0.06 | 0.04 | 0.03 | 0.11 | 0.05 |
| SEQID-02923 | D7TfD80 | — | 1 | 0.49 | 0.20 | 0.04 | 0.05 | 0.05 | 0.03 | 0.01 | 0.06 | 0.10 | 0.03 | 0.02 | 0.06 | 0.07 | 0.10 |
| SEQID-02924 | F6I229 | — | 1 | 0.46 | 0.18 | 0.06 | 0.04 | 0.02 | 0.09 | 0.01 | 0.05 | 0.09 | 0.05 | 0.02 | 0.04 | 0.09 | 0.11 |
| SEQID-02925 | A5BV59 | — | 1 | 0.50 | 0.22 | 0.05 | 0.08 | 0.03 | 0.06 | 0.01 | 0.02 | 0.04 | 0.04 | 0.06 | 0.06 | 0.09 | 0.07 |
| SEQID-02926 | D7SJS6 | — | 1 | 0.49 | 0.26 | 0.05 | 0.05 | 0.06 | 0.09 | 0.01 | 0.03 | 0.09 | 0.04 | 0.03 | 0.06 | 0.11 | 0.07 |
| SEQID-02927 | D7TWQ4 | — | 1 | 0.48 | 0.22 | 0.07 | 0.06 | 0.04 | 0.06 | 0.01 | 0.03 | 0.06 | 0.04 | 0.05 | 0.07 | 0.09 | 0.09 |
| SEQID-02928 | F6GU55 | — | 1 | 0.45 | 0.20 | 0.07 | 0.09 | 0.04 | 0.05 | 0.02 | 0.05 | 0.02 | 0.05 | 0.02 | 0.05 | 0.09 | 0.09 |
| SEQID-02929 | F6HUT2 | — | 1 | 0.42 | 0.19 | 0.06 | 0.07 | 0.05 | 0.06 | 0.01 | 0.06 | 0.03 | 0.03 | 0.03 | 0.07 | 0.09 | 0.04 |
| SEQID-02930 | F6HDW4 | — | 1 | 0.49 | 0.18 | 0.04 | 0.06 | 0.05 | 0.06 | 0.02 | 0.03 | 0.10 | 0.04 | 0.03 | 0.05 | 0.07 | 0.09 |
| SEQID-02931 | A5BF93 | — | 1 | 0.49 | 0.26 | 0.07 | 0.05 | 0.04 | 0.05 | 0.03 | 0.04 | 0.08 | 0.05 | 0.01 | 0.09 | 0.09 | 0.10 |
| SEQID-02932 | F6GZN9 | — | 1 | 0.49 | 0.19 | 0.05 | 0.05 | 0.04 | 0.06 | 0.02 | 0.04 | 0.09 | 0.03 | 0.03 | 0.06 | 0.09 | 0.06 |
| SEQID-02933 | D7SYS5 | — | 1 | 0.44 | 0.18 | 0.04 | 0.04 | 0.03 | 0.07 | 0.02 | 0.03 | 0.07 | 0.04 | 0.06 | 0.05 | 0.09 | 0.07 |
| SEQID-02934 | D7SYK8 | — | 0 | 0.41 | 0.20 | 0.06 | 0.08 | 0.06 | 0.06 | 0.02 | 0.04 | 0.09 | 0.05 | 0.03 | 0.09 | 0.03 | 0.06 |
| SEQID-02935 | D7SS06 | — | 1 | 0.41 | 0.19 | 0.04 | 0.07 | 0.02 | 0.09 | 0.05 | 0.02 | 0.08 | 0.04 | 0.04 | 0.05 | 0.10 | 0.07 |
| SEQID-02936 | F6HKX8 | — | 1 | 0.43 | 0.21 | 0.05 | 0.07 | 0.04 | 0.05 | 0.02 | 0.04 | 0.10 | 0.03 | 0.03 | 0.05 | 0.09 | 0.09 |
| SEQID-02937 | A5BZF5 | — | 1 | 0.39 | 0.17 | 0.06 | 0.05 | 0.04 | 0.07 | 0.01 | 0.04 | 0.09 | 0.02 | 0.02 | 0.04 | 0.06 | 0.06 |
| SEQID-02938 | D7T5P6 | — | 1 | 0.45 | 0.19 | 0.05 | 0.04 | 0.05 | 0.05 | 0.00 | 0.09 | 0.21 | 0.01 | 0.01 | 0.04 | 0.14 | 0.10 |
| SEQID-02939 | D7TW33 | — | 1 | 0.46 | 0.19 | 0.05 | 0.09 | 0.03 | 0.06 | 0.03 | 0.04 | 0.10 | 0.08 | 0.03 | 0.03 | 0.09 | 0.11 |
| SEQID-02940 | P56643 | — | 1 | 0.45 | 0.22 | 0.06 | 0.03 | 0.03 | 0.06 | 0.02 | 0.07 | 0.07 | 0.07 | 0.02 | 0.10 | 0.09 | 0.05 |
| SEQID-02941 | D7ST8 | — | 1 | 0.49 | 0.22 | 0.05 | 0.08 | 0.03 | 0.06 | 0.02 | 0.03 | 0.06 | 0.05 | 0.02 | 0.06 | 0.09 | 0.10 |
| SEQID-02942 | D7TK33 | — | 1 | 0.47 | 0.23 | 0.04 | 0.07 | 0.04 | 0.05 | 0.02 | 0.04 | 0.09 | 0.05 | 0.06 | 0.06 | 0.10 | 0.06 |
| SEQID-02943 | D7SYK8 | — | 1 | 0.46 | 0.22 | 0.06 | 0.07 | 0.04 | 0.06 | 0.02 | 0.04 | 0.07 | 0.09 | 0.03 | 0.09 | 0.08 | 0.06 |
| SEQID-02944 | D7SH83 | — | 1 | 0.46 | 0.21 | 0.06 | 0.06 | 0.03 | 0.06 | 0.05 | 0.04 | 0.08 | 0.05 | 0.03 | 0.05 | 0.09 | 0.09 |
| SEQID-02945 | F6HHX2 | — | 1 | 0.43 | 0.20 | 0.06 | 0.07 | 0.03 | 0.06 | 0.01 | 0.04 | 0.10 | 0.05 | 0.05 | 0.07 | 0.09 | 0.06 |
| SEQID-02946 | F6HTM3 | — | 1 | 0.43 | 0.23 | 0.06 | 0.05 | 0.04 | 0.05 | 0.00 | 0.06 | 0.09 | 0.02 | 0.02 | 0.09 | 0.06 | 0.10 |
| SEQID-02947 | D7SZW5 | — | 1 | 0.48 | 0.22 | 0.03 | 0.06 | 0.05 | 0.04 | 0.00 | 0.09 | 0.21 | 0.01 | 0.03 | 0.04 | 0.14 | 0.10 |
| SEQID-02948 | A5AQ89 | — | 1 | 0.48 | 0.23 | 0.06 | 0.03 | 0.02 | 0.02 | 0.02 | 0.04 | 0.10 | 0.08 | 0.01 | 0.03 | 0.09 | 0.11 |
| SEQID-02949 | D7TBK8 | — | 1 | 0.52 | 0.26 | 0.08 | 0.03 | 0.02 | 0.06 | 0.02 | 0.07 | 0.07 | 0.07 | 0.02 | 0.10 | 0.09 | 0.05 |
| SEQID-02950 | A5B7Q8 | — | 1 | 0.50 | 0.22 | 0.07 | 0.03 | 0.02 | 0.06 | 0.02 | 0.03 | 0.09 | 0.05 | 0.02 | 0.06 | 0.06 | 0.10 |
| SEQID-02951 | D7SIH0 | — | 0 | 0.44 | 0.19 | 0.02 | 0.04 | 0.04 | 0.04 | 0.03 | 0.07 | 0.12 | 0.05 | 0.02 | 0.06 | 0.10 | 0.06 |
| SEQID-02952 | A5BYC0 | — | 1 | 0.52 | 0.22 | 0.06 | 0.05 | 0.05 | 0.04 | 0.01 | 0.03 | 0.07 | 0.03 | 0.01 | 0.05 | 0.09 | 0.09 |
| SEQID-02953 | D7SPB2 | — | 1 | 0.47 | 0.23 | 0.07 | 0.06 | 0.04 | 0.07 | 0.01 | 0.02 | 0.06 | 0.04 | 0.04 | 0.07 | 0.09 | 0.07 |
| SEQID-02954 | D7SLS3 | — | 1 | 0.44 | 0.22 | 0.04 | 0.09 | 0.04 | 0.04 | 0.02 | 0.04 | 0.09 | 0.03 | 0.05 | 0.09 | 0.07 | 0.07 |
| SEQID-02955 | D7T475 | — | 1 | 0.42 | 0.16 | 0.03 | 0.03 | 0.03 | 0.02 | 0.01 | 0.04 | 0.04 | 0.03 | 0.04 | 0.04 | 0.06 | 0.10 |
| SEQID-02956 | D7U7S6 | — | 1 | 0.52 | 0.24 | 0.06 | 0.21 | 0.05 | 0.04 | 0.01 | 0.09 | 0.11 | 0.04 | 0.01 | 0.05 | 0.09 | 0.11 |
| SEQID-02957 | D7T6Q0 | — | 1 | 0.42 | 0.20 | 0.06 | 0.02 | 0.05 | 0.04 | 0.03 | 0.05 | 0.04 | 0.03 | 0.02 | 0.05 | 0.10 | 0.07 |
| SEQID-02958 | D7TPB9 | — | 1 | 0.48 | 0.22 | 0.08 | 0.06 | 0.02 | 0.03 | 0.02 | 0.03 | 0.07 | 0.05 | 0.04 | 0.05 | 0.08 | 0.10 |
| SEQID-02959 | F6I4V0 | — | 1 | 0.50 | 0.22 | 0.07 | 0.02 | 0.03 | 0.05 | 0.02 | 0.03 | 0.09 | 0.04 | 0.03 | 0.05 | 0.06 | 0.09 |
| SEQID-02960 | D7TRL3 | — | 0 | 0.45 | 0.19 | 0.03 | 0.05 | 0.02 | 0.04 | 0.01 | 0.07 | 0.12 | 0.03 | 0.04 | 0.06 | 0.09 | 0.10 |
| SEQID-02961 | D7TU16 | — | 1 | 0.48 | 0.18 | 0.04 | 0.16 | 0.03 | 0.09 | 0.01 | 0.02 | 0.09 | 0.04 | 0.00 | 0.05 | 0.09 | 0.15 |
| SEQID-02962 | D7UCH9 | — | 1 | 0.56 | 0.28 | 0.07 | 0.06 | 0.02 | 0.05 | 0.01 | 0.01 | 0.06 | 0.03 | 0.02 | 0.09 | 0.13 | 0.09 |
| SEQID-02963 | E0CQY0 | — | 1 | 0.45 | 0.16 | 0.06 | 0.05 | 0.07 | 0.04 | 0.03 | 0.06 | 0.01 | 0.06 | 0.02 | 0.04 | 0.05 | 0.05 |

TABLE 1-continued

| | | | | | | | | | | | | | | | |
|---|---|---|---|---|---|---|---|---|---|---|---|---|---|---|---|
| SEQID-02964 | E0CSN8 | — | 1 | 0.45 | 0.17 | 0.06 | 0.07 | 0.04 | 0.07 | 0.02 | 0.01 | 0.06 | 0.05 | 0.03 | 0.03 | 0.09 | 0.06 |
| SEQID-02965 | D7T4T3 | — | 1 | 0.46 | 0.22 | 0.04 | 0.05 | 0.03 | 0.06 | 0.03 | 0.07 | 0.09 | 0.04 | 0.04 | 0.04 | 0.09 | 0.06 |
| SEQID-02966 | F6GU78 | — | 1 | 0.43 | 0.18 | 0.03 | 0.10 | 0.05 | 0.09 | 0.02 | 0.03 | 0.11 | 0.02 | 0.01 | 0.03 | 0.09 | 0.11 |
| SEQID-02967 | D75R32 | — | 1 | 0.44 | 0.19 | 0.09 | 0.04 | 0.05 | 0.06 | 0.02 | 0.06 | 0.13 | 0.04 | 0.05 | 0.04 | 0.11 | 0.11 |
| SEQID-02968 | D7TH54 | — | 1 | 0.49 | 0.17 | 0.05 | 0.02 | 0.05 | 0.06 | 0.02 | 0.04 | 0.06 | 0.04 | 0.05 | 0.05 | 0.09 | 0.08 |
| SEQID-02969 | F6HQD3 | — | 1 | 0.47 | 0.21 | 0.04 | 0.07 | 0.03 | 0.07 | 0.01 | 0.04 | 0.09 | 0.04 | 0.03 | 0.07 | 0.08 | 0.05 |
| SEQID-02970 | F6GUL7 | — | 1 | 0.50 | 0.22 | 0.04 | 0.11 | 0.03 | 0.05 | 0.01 | 0.01 | 0.05 | 0.05 | 0.05 | 0.03 | 0.09 | 0.11 |
| SEQID-02971 | F6GX19 | — | 1 | 0.48 | 0.21 | 0.04 | 0.09 | 0.04 | 0.07 | 0.03 | 0.03 | 0.09 | 0.02 | 0.04 | 0.03 | 0.13 | 0.07 |
| SEQID-02972 | F6HQD6 | — | 1 | 0.49 | 0.21 | 0.05 | 0.05 | 0.05 | 0.06 | 0.01 | 0.02 | 0.07 | 0.04 | 0.03 | 0.04 | 0.09 | 0.07 |
| SEQID-02973 | D7TM77 | — | 1 | 0.47 | 0.20 | 0.06 | 0.03 | 0.03 | 0.05 | 0.03 | 0.02 | 0.10 | 0.03 | 0.06 | 0.06 | 0.07 | 0.09 |
| SEQID-02974 | F6HKS7 | — | 1 | 0.49 | 0.30 | 0.07 | 0.05 | 0.05 | 0.05 | 0.00 | 0.04 | 0.06 | 0.05 | 0.05 | 0.05 | 0.10 | 0.06 |
| SEQID-02975 | A5ARE0 | — | 1 | 0.51 | 0.24 | 0.04 | 0.04 | 0.03 | 0.05 | 0.01 | 0.04 | 0.08 | 0.06 | 0.04 | 0.04 | 0.10 | 0.06 |
| SEQID-02976 | D7TVP9 | — | 1 | 0.46 | 0.19 | 0.05 | 0.09 | 0.04 | 0.06 | 0.03 | 0.04 | 0.07 | 0.03 | 0.05 | 0.04 | 0.09 | 0.08 |
| SEQID-02977 | F6HL98 | — | 1 | 0.50 | 0.25 | 0.02 | 0.05 | 0.04 | 0.09 | 0.03 | 0.03 | 0.06 | 0.05 | 0.03 | 0.05 | 0.17 | 0.06 |
| SEQID-02978 | F6HBC6 | — | 1 | 0.50 | 0.22 | 0.06 | 0.04 | 0.04 | 0.05 | 0.01 | 0.03 | 0.06 | 0.05 | 0.02 | 0.05 | 0.11 | 0.09 |
| SEQID-02979 | D7TA50 | — | 1 | 0.48 | 0.23 | 0.07 | 0.03 | 0.02 | 0.05 | 0.03 | 0.03 | 0.07 | 0.05 | 0.05 | 0.06 | 0.09 | 0.09 |
| SEQID-02980 | D7T3J3 | — | 1 | 0.47 | 0.19 | 0.05 | 0.06 | 0.06 | 0.07 | 0.01 | 0.03 | 0.07 | 0.04 | 0.04 | 0.06 | 0.09 | 0.06 |
| SEQID-02981 | D7TKK5 | — | 1 | 0.49 | 0.22 | 0.05 | 0.06 | 0.04 | 0.05 | 0.02 | 0.04 | 0.10 | 0.03 | 0.03 | 0.06 | 0.10 | 0.06 |
| SEQID-02982 | D7U0Q3 | — | 1 | 0.48 | 0.24 | 0.05 | 0.06 | 0.04 | 0.06 | 0.01 | 0.04 | 0.09 | 0.04 | 0.03 | 0.08 | 0.08 | 0.11 |
| SEQID-02983 | F6I4H0 | — | 1 | 0.50 | 0.21 | 0.05 | 0.08 | 0.03 | 0.05 | 0.02 | 0.04 | 0.07 | 0.04 | 0.04 | 0.04 | 0.11 | 0.07 |
| SEQID-02984 | A5ALT5 | — | 0 | 0.41 | 0.16 | 0.03 | 0.07 | 0.03 | 0.08 | 0.03 | 0.03 | 0.07 | 0.05 | 0.02 | 0.07 | 0.07 | 0.09 |
| SEQID-02985 | D7T6C5 | — | 1 | 0.44 | 0.23 | 0.05 | 0.08 | 0.04 | 0.07 | 0.01 | 0.05 | 0.11 | 0.03 | 0.01 | 0.04 | 0.11 | 0.11 |
| SEQID-02986 | F6H0K6 | — | 1 | 0.43 | 0.19 | 0.05 | 0.06 | 0.05 | 0.06 | 0.01 | 0.03 | 0.10 | 0.03 | 0.02 | 0.07 | 0.11 | 0.09 |
| SEQID-02987 | F6GY09 | — | 1 | 0.47 | 0.21 | 0.07 | 0.07 | 0.04 | 0.06 | 0.01 | 0.03 | 0.09 | 0.04 | 0.04 | 0.06 | 0.10 | 0.08 |
| SEQID-02988 | F6HK38 | — | 1 | 0.50 | 0.18 | 0.04 | 0.05 | 0.06 | 0.04 | 0.02 | 0.03 | 0.10 | 0.04 | 0.02 | 0.05 | 0.09 | 0.12 |
| SEQID-02989 | F6HE13 | — | 1 | 0.34 | 0.14 | 0.05 | 0.06 | 0.05 | 0.04 | 0.02 | 0.14 | 0.05 | 0.05 | 0.01 | 0.03 | 0.06 | 0.03 |
| SEQID-02990 | D7TCZ8 | — | 1 | 0.49 | 0.19 | 0.05 | 0.06 | 0.05 | 0.05 | 0.02 | 0.03 | 0.09 | 0.04 | 0.02 | 0.05 | 0.09 | 0.07 |
| SEQID-02991 | F6GST3 | — | 1 | 0.44 | 0.22 | 0.04 | 0.08 | 0.05 | 0.07 | 0.02 | 0.04 | 0.09 | 0.04 | 0.04 | 0.06 | 0.10 | 0.07 |
| SEQID-02992 | F6HKF1 | — | 1 | 0.48 | 0.23 | 0.04 | 0.07 | 0.03 | 0.06 | 0.01 | 0.05 | 0.07 | 0.05 | 0.02 | 0.07 | 0.10 | 0.09 |
| SEQID-02993 | D7U4U5 | — | 1 | 0.44 | 0.22 | 0.04 | 0.09 | 0.06 | 0.07 | 0.01 | 0.05 | 0.03 | 0.03 | 0.02 | 0.07 | 0.08 | 0.04 |
| SEQID-02994 | F6HY11 | — | 1 | 0.49 | 0.24 | 0.08 | 0.04 | 0.03 | 0.05 | 0.02 | 0.02 | 0.07 | 0.05 | 0.02 | 0.05 | 0.11 | 0.09 |
| SEQID-02995 | D7SIX7 | — | 1 | 0.47 | 0.28 | 0.06 | 0.08 | 0.03 | 0.07 | 0.02 | 0.05 | 0.08 | 0.02 | 0.02 | 0.07 | 0.14 | 0.05 |
| SEQID-02996 | F6H392 | — | 0 | 0.24 | 0.09 | 0.07 | 0.09 | 0.04 | 0.04 | 0.00 | 0.15 | 0.04 | 0.07 | 0.01 | 0.04 | 0.02 | 0.03 |
| SEQID-02997 | E0CSK6 | — | 1 | 0.47 | 0.24 | 0.05 | 0.09 | 0.05 | 0.06 | 0.01 | 0.05 | 0.08 | 0.04 | 0.03 | 0.09 | 0.10 | 0.07 |
| SEQID-02998 | Q07J21 | — | 1 | 0.55 | 0.22 | 0.06 | 0.05 | 0.04 | 0.04 | 0.00 | 0.05 | 0.03 | 0.05 | 0.07 | 0.06 | 0.12 | 0.02 |
| SEQID-02999 | E0CQR2 | — | 1 | 0.43 | 0.16 | 0.04 | 0.07 | 0.04 | 0.07 | 0.01 | 0.02 | 0.09 | 0.04 | 0.04 | 0.04 | 0.07 | 0.05 |
| SEQID-03000 | D7SRR6 | — | 0 | 0.34 | 0.18 | 0.05 | 0.08 | 0.07 | 0.05 | 0.02 | 0.10 | 0.06 | 0.04 | 0.04 | 0.04 | 0.08 | 0.02 |
| SEQID-03001 | D7STT1 | — | 1 | 0.47 | 0.22 | 0.06 | 0.06 | 0.04 | 0.06 | 0.03 | 0.04 | 0.05 | 0.06 | 0.03 | 0.05 | 0.10 | 0.06 |
| SEQID-03002 | F6HH36 | — | 1 | 0.45 | 0.21 | 0.04 | 0.05 | 0.05 | 0.05 | 0.01 | 0.00 | 0.09 | 0.03 | 0.02 | 0.03 | 0.09 | 0.05 |
| SEQID-03003 | A5AHP0 | — | 1 | 0.49 | 0.29 | 0.04 | 0.04 | 0.02 | 0.06 | 0.03 | 0.09 | 0.08 | 0.02 | 0.03 | 0.09 | 0.13 | 0.07 |
| SEQID-03004 | F6GUM1 | — | 1 | 0.46 | 0.21 | 0.05 | 0.05 | 0.05 | 0.05 | 0.01 | 0.03 | 0.09 | 0.03 | 0.03 | 0.05 | 0.10 | 0.06 |
| SEQID-03005 | D7T3A6 | — | 1 | 0.46 | 0.20 | 0.03 | 0.06 | 0.04 | 0.04 | 0.01 | 0.04 | 0.10 | 0.04 | 0.04 | 0.05 | 0.09 | 0.06 |
| SEQID-03006 | 6273402 | — | 1 | 0.41 | 0.17 | 0.04 | 0.07 | 0.06 | 0.06 | 0.02 | 0.06 | 0.08 | 0.03 | 0.03 | 0.04 | 0.09 | 0.08 |
| SEQID-03007 | 83173888 | — | 0 | 0.44 | 0.26 | 0.02 | 0.09 | 0.04 | 0.04 | 0.02 | 0.08 | 0.10 | 0.02 | 0.02 | 0.05 | 0.11 | 0.06 |
| SEQID-03008 | 21952337 | — | 1 | 0.48 | 0.22 | 0.06 | 0.06 | 0.06 | 0.07 | 0.01 | 0.07 | 0.12 | 0.02 | 0.02 | 0.04 | 0.09 | 0.07 |
| SEQID-03009 | 367460278 | — | 1 | 0.46 | 0.16 | 0.05 | 0.08 | 0.05 | 0.05 | 0.00 | 0.03 | 0.08 | 0.03 | 0.02 | 0.06 | 0.11 | 0.09 |
| SEQID-03010 | 2103286 | — | 1 | 0.39 | 0.16 | 0.04 | 0.06 | 0.06 | 0.08 | 0.03 | 0.00 | 0.05 | 0.04 | 0.01 | 0.09 | 0.06 | 0.09 |
| SEQID-03011 | 3319882 | — | 1 | 0.52 | 0.22 | 0.04 | 0.08 | 0.04 | 0.02 | 0.01 | 0.09 | 0.11 | 0.04 | 0.02 | 0.03 | 0.11 | 0.04 |
| SEQID-03012 | 301131212 | — | 1 | 0.47 | 0.21 | 0.05 | 0.05 | 0.05 | 0.06 | 0.03 | 0.03 | 0.09 | 0.04 | 0.02 | 0.06 | 0.07 | 0.13 |
| SEQID-03013 | 21068668 | — | 1 | 0.47 | 0.22 | 0.03 | 0.07 | 0.02 | 0.06 | 0.01 | 0.01 | 0.12 | 0.03 | 0.03 | 0.08 | 0.07 | 0.06 |
| SEQID-03014 | 3021333 | — | 1 | 0.46 | 0.24 | 0.08 | 0.10 | 0.06 | 0.06 | 0.01 | 0.04 | 0.09 | 0.04 | 0.02 | 0.06 | 0.09 | 0.05 |
| SEQID-03015 | 13437787 | — | 1 | 0.43 | 0.22 | 0.06 | 0.05 | 0.05 | 0.06 | 0.01 | 0.03 | 0.06 | 0.04 | 0.03 | 0.05 | 0.11 | 0.08 |
| SEQID-03016 | 3413165 | — | 1 | 0.52 | 0.25 | 0.06 | 0.08 | 0.04 | 0.08 | 0.01 | 0.01 | 0.06 | 0.04 | 0.01 | 0.09 | 0.09 | 0.09 |

TABLE 1-continued

| SEQID | ID | | | | | | | | | | | | | | | |
|---|---|---|---|---|---|---|---|---|---|---|---|---|---|---|---|---|
| SEQID-03017 | 3175990 | — | 1 | 0.48 | 0.22 | 0.04 | 0.05 | 0.04 | 0.09 | 0.01 | 0.02 | 0.07 | 0.04 | 0.03 | 0.05 | 0.10 | 0.09 |
| SEQID-03018 | 197089784 | — | 1 | 0.46 | 0.20 | 0.06 | 0.09 | 0.03 | 0.06 | 0.02 | 0.04 | 0.08 | 0.05 | 0.04 | 0.05 | 0.09 | 0.06 |
| SEQID-03019 | 38566732 | — | 1 | 0.52 | 0.17 | 0.03 | 0.02 | 0.03 | 0.04 | 0.02 | 0.04 | 0.06 | 0.09 | 0.04 | 0.05 | 0.04 | 0.12 |
| SEQID-03020 | 10334493 | — | 1 | 0.47 | 0.25 | 0.07 | 0.05 | 0.04 | 0.05 | 0.02 | 0.04 | 0.07 | 0.04 | 0.03 | 0.06 | 0.09 | 0.07 |
| SEQID-03021 | 4586588 | — | 1 | 0.53 | 0.18 | 0.06 | 0.07 | 0.02 | 0.06 | 0.03 | 0.02 | 0.07 | 0.04 | 0.03 | 0.09 | 0.06 | 0.12 |
| SEQID-03022 | 143612111 | — | 1 | 0.39 | 0.19 | 0.07 | 0.08 | 0.05 | 0.07 | 0.02 | 0.03 | 0.14 | 0.02 | 0.01 | 0.06 | 0.10 | 0.07 |
| SEQID-03023 | 10334503 | — | 1 | 0.46 | 0.19 | 0.05 | 0.08 | 0.03 | 0.06 | 0.07 | 0.01 | 0.07 | 0.03 | 0.04 | 0.10 | 0.07 | 0.09 |
| SEQID-03024 | 4586594 | — | 0 | 0.55 | 0.26 | 0.02 | 0.06 | 0.05 | 0.07 | 0.08 | 0.02 | 0.07 | 0.03 | 0.01 | 0.05 | 0.10 | 0.12 |
| SEQID-03025 | 20975622 | — | 1 | 0.53 | 0.20 | 0.02 | 0.05 | 0.03 | 0.09 | 0.04 | 0.04 | 0.09 | 0.03 | 0.07 | 0.05 | 0.08 | 0.12 |
| SEQID-03026 | 228552592 | — | 1 | 0.40 | 0.19 | 0.06 | 0.02 | 0.05 | 0.03 | 0.02 | 0.03 | 0.14 | 0.03 | 0.02 | 0.09 | 0.11 | 0.09 |
| SEQID-03027 | 7208773 | — | 1 | 0.48 | 0.24 | 0.04 | 0.06 | 0.04 | 0.06 | 0.01 | 0.05 | 0.09 | 0.03 | 0.03 | 0.09 | 0.07 | 0.07 |
| SEQID-03028 | 3043428 | — | 1 | 0.44 | 0.24 | 0.06 | 0.13 | 0.04 | 0.07 | 0.01 | 0.05 | 0.05 | 0.02 | 0.03 | 0.09 | 0.09 | 0.09 |
| SEQID-03029 | 60219077 | — | 1 | 0.49 | 0.23 | 0.05 | 0.06 | 0.04 | 0.06 | 0.02 | 0.02 | 0.09 | 0.04 | 0.03 | 0.07 | 0.09 | 0.07 |
| SEQID-03030 | 84569909 | — | 1 | 0.44 | 0.16 | 0.05 | 0.09 | 0.03 | 0.08 | 0.11 | 0.03 | 0.06 | 0.03 | 0.03 | 0.01 | 0.09 | 0.09 |
| SEQID-03031 | 7208784 | — | 1 | 0.53 | 0.19 | 0.04 | 0.07 | 0.09 | 0.06 | 0.00 | 0.03 | 0.05 | 0.04 | 0.03 | 0.03 | 0.09 | 0.18 |
| SEQID-03032 | 207003822 | — | 0 | 0.54 | 0.19 | 0.08 | 0.05 | 0.04 | 0.06 | 0.00 | 0.03 | 0.10 | 0.02 | 0.02 | 0.07 | 0.04 | 0.23 |
| SEQID-03033 | 499171 | — | 0 | 0.47 | 0.17 | 0.06 | 0.01 | 0.05 | 0.02 | 0.01 | 0.02 | 0.11 | 0.03 | 0.02 | 0.06 | 0.06 | 0.13 |
| SEQID-03034 | 219725672 | — | 0 | 0.43 | 0.21 | 0.06 | 0.07 | 0.05 | 0.04 | 0.01 | 0.03 | 0.06 | 0.02 | 0.02 | 0.09 | 0.06 | 0.04 |
| SEQID-03035 | 315440443 | — | 0 | 0.49 | 0.19 | 0.09 | 0.08 | 0.04 | 0.07 | 0.00 | 0.04 | 0.04 | 0.03 | 0.03 | 0.06 | 0.01 | 0.03 |
| SEQID-03036 | 45720184 | — | 1 | 0.49 | 0.09 | 0.09 | 0.04 | 0.04 | 0.03 | 0.00 | 0.04 | 0.10 | 0.08 | 0.03 | 0.01 | 0.01 | 0.12 |
| SEQID-03037 | 4586580 | — | 1 | 0.25 | 0.06 | 0.09 | 0.06 | 0.07 | 0.06 | 0.02 | 0.03 | 0.10 | 0.03 | 0.06 | 0.06 | 0.09 | 0.06 |
| SEQID-03038 | 6469141 | — | 1 | 0.43 | 0.19 | 0.06 | 0.06 | 0.03 | 0.06 | 0.00 | 0.03 | 0.06 | 0.03 | 0.01 | 0.07 | 0.07 | 0.07 |
| SEQID-03039 | 6850936 | — | 1 | 0.47 | 0.22 | 0.03 | 0.09 | 0.03 | 0.07 | 0.01 | 0.06 | 0.07 | 0.04 | 0.03 | 0.06 | 0.09 | 0.13 |
| SEQID-03040 | 4586578 | — | 0 | 0.52 | 0.28 | 0.09 | 0.02 | 0.09 | 0.04 | 0.01 | 0.03 | 0.05 | 0.05 | 0.04 | 0.08 | 0.12 | 0.11 |
| SEQID-03041 | O65759 | — | 1 | 0.53 | 0.26 | 0.06 | 0.07 | 0.06 | 0.09 | 0.03 | 0.05 | 0.05 | 0.06 | 0.02 | 0.07 | 0.08 | 0.11 |
| SEQID-03042 | O49817 | — | 0 | 0.44 | 0.23 | 0.03 | 0.10 | 0.03 | 0.04 | 0.00 | 0.04 | 0.07 | 0.06 | 0.01 | 0.05 | 0.11 | 0.08 |
| SEQID-03043 | 3928152 | — | 1 | 0.40 | 0.03 | 0.10 | 0.04 | 0.05 | 0.02 | 0.00 | 0.17 | 0.08 | 0.04 | 0.02 | 0.01 | 0.01 | 0.16 |
| SEQID-03044 | 21684781 | — | 1 | 0.50 | 0.21 | 0.04 | 0.08 | 0.06 | 0.03 | 0.01 | 0.04 | 0.05 | 0.03 | 0.02 | 0.04 | 0.08 | 0.03 |
| SEQID-03045 | K9I869 | — | 1 | 0.43 | 0.18 | 0.03 | 0.07 | 0.07 | 0.02 | 0.00 | 0.04 | 0.05 | 0.08 | 0.03 | 0.05 | 0.09 | 0.06 |
| SEQID-03046 | K9I432 | — | 1 | 0.50 | 0.20 | 0.05 | 0.09 | 0.05 | 0.06 | 0.01 | 0.03 | 0.06 | 0.04 | 0.04 | 0.06 | 0.03 | 0.07 |
| SEQID-03047 | K9HSF5 | — | 1 | 0.54 | 0.18 | 0.04 | 0.11 | 0.02 | 0.04 | 0.01 | 0.02 | 0.06 | 0.04 | 0.06 | 0.05 | 0.06 | 0.13 |
| SEQID-03048 | K9HCC6 | — | 0 | 0.53 | 0.26 | 0.06 | 0.02 | 0.05 | 0.05 | 0.01 | 0.07 | 0.06 | 0.04 | 0.04 | 0.07 | 0.10 | 0.09 |
| SEQID-03049 | K9HXR0 | — | 1 | 0.49 | 0.23 | 0.09 | 0.04 | 0.06 | 0.05 | 0.03 | 0.06 | 0.05 | 0.05 | 0.02 | 0.08 | 0.06 | 0.07 |
| SEQID-03050 | K9HXM3 | — | 1 | 0.46 | 0.21 | 0.06 | 0.09 | 0.04 | 0.04 | 0.01 | 0.05 | 0.09 | 0.04 | 0.01 | 0.05 | 0.06 | 0.09 |
| SEQID-03051 | K9HHN3 | — | 1 | 0.49 | 0.23 | 0.04 | 0.07 | 0.04 | 0.04 | 0.00 | 0.04 | 0.08 | 0.04 | 0.02 | 0.06 | 0.10 | 0.09 |
| SEQID-03052 | K9I0P5 | — | 1 | 0.43 | 0.20 | 0.03 | 0.08 | 0.05 | 0.04 | 0.01 | 0.07 | 0.04 | 0.03 | 0.04 | 0.03 | 0.03 | 0.09 |
| SEQID-03053 | K9I1X4 | — | 1 | 0.46 | 0.19 | 0.05 | 0.07 | 0.06 | 0.06 | 0.00 | 0.01 | 0.07 | 0.03 | 0.04 | 0.07 | 0.06 | 0.09 |
| SEQID-03054 | K9HML4 | — | 1 | 0.44 | 0.24 | 0.07 | 0.10 | 0.06 | 0.05 | 0.00 | 0.05 | 0.09 | 0.05 | 0.01 | 0.06 | 0.10 | 0.06 |
| SEQID-03055 | K5HHZ0 | — | 1 | 0.45 | 0.23 | 0.07 | 0.07 | 0.04 | 0.04 | 0.01 | 0.04 | 0.07 | 0.03 | 0.02 | 0.06 | 0.09 | 0.06 |
| SEQID-03056 | K9HIT2 | — | 1 | 0.46 | 0.22 | 0.06 | 0.03 | 0.04 | 0.03 | 0.00 | 0.05 | 0.11 | 0.05 | 0.03 | 0.07 | 0.07 | 0.06 |
| SEQID-03057 | K9HU82 | — | 1 | 0.48 | 0.24 | 0.06 | 0.07 | 0.05 | 0.05 | 0.02 | 0.04 | 0.07 | 0.04 | 0.03 | 0.06 | 0.10 | 0.08 |
| SEQID-03058 | K9I9C0 | — | 1 | 0.46 | 0.21 | 0.07 | 0.05 | 0.03 | 0.02 | 0.01 | 0.04 | 0.08 | 0.04 | 0.04 | 0.07 | 0.06 | 0.07 |
| SEQID-03059 | K9HD94 | — | 1 | 0.42 | 0.20 | 0.06 | 0.11 | 0.02 | 0.05 | 0.02 | 0.05 | 0.10 | 0.05 | 0.05 | 0.07 | 0.09 | 0.03 |
| SEQID-03060 | K9ICT4 | — | 0 | 0.47 | 0.24 | 0.05 | 0.03 | 0.05 | 0.03 | 0.02 | 0.05 | 0.09 | 0.03 | 0.03 | 0.09 | 0.09 | 0.06 |
| SEQID-03061 | K9HUL5 | — | 1 | 0.42 | 0.21 | 0.06 | 0.03 | 0.01 | 0.04 | 0.00 | 0.07 | 0.11 | 0.04 | 0.02 | 0.04 | 0.09 | 0.09 |
| SEQID-03062 | K9HE05 | — | 1 | 0.47 | 0.23 | 0.07 | 0.03 | 0.05 | 0.05 | 0.01 | 0.04 | 0.08 | 0.05 | 0.02 | 0.09 | 0.09 | 0.10 |
| SEQID-03063 | K9HNG2 | — | 1 | 0.53 | 0.21 | 0.05 | 0.15 | 0.05 | 0.04 | 0.01 | 0.05 | 0.07 | 0.05 | 0.03 | 0.07 | 0.07 | 0.08 |
| SEQID-03064 | K9HUX9 | — | 1 | 0.45 | 0.20 | 0.07 | 0.07 | 0.04 | 0.03 | 0.00 | 0.03 | 0.04 | 0.06 | 0.06 | 0.06 | 0.06 | 0.09 |
| SEQID-03065 | K9IBU7 | — | 1 | 0.47 | 0.22 | 0.07 | 0.07 | 0.04 | 0.06 | 0.01 | 0.04 | 0.06 | 0.04 | 0.03 | 0.06 | 0.10 | 0.06 |
| SEQID-03066 | K9IFT9 | — | 1 | 0.53 | 0.21 | 0.05 | 0.05 | 0.05 | 0.04 | 0.01 | 0.02 | 0.08 | 0.05 | 0.03 | 0.09 | 0.05 | 0.13 |
| SEQID-03067 | K9I536 | — | 1 | 0.51 | 0.20 | 0.06 | 0.05 | 0.06 | 0.05 | 0.00 | 0.04 | 0.06 | 0.04 | 0.04 | 0.07 | 0.09 | 0.08 |
| SEQID-03068 | K9IV44 | — | 1 | 0.47 | 0.31 | 0.07 | 0.07 | 0.07 | 0.02 | 0.01 | 0.05 | 0.06 | 0.06 | 0.04 | 0.09 | 0.09 | 0.09 |
| SEQID-03069 | K9I985 | — | 1 | 0.48 | 0.21 | 0.05 | 0.06 | 0.02 | 0.04 | 0.00 | 0.04 | 0.07 | 0.03 | 0.01 | 0.05 | 0.10 | 0.08 |
| | | | 1 | 0.45 | 0.22 | 0.06 | 0.03 | 0.05 | 0.05 | 0.00 | 0.04 | 0.09 | 0.03 | 0.03 | 0.05 | 0.11 | 0.06 |

TABLE 1-continued

| SEQID | Name | | | | | | | | | | | | | | |
|---|---|---|---|---|---|---|---|---|---|---|---|---|---|---|---|
| SEQID-03070 | K9HT30 | — | — | 0 | 0.47 | 0.24 | 0.08 | 0.06 | 0.05 | 0.05 | 0.00 | 0.02 | 0.09 | 0.04 | 0.01 | 0.06 | 0.09 | 0.07 |
| SEQID-03071 | K9I6L1 | — | — | 1 | 0.41 | 0.16 | 0.07 | 0.11 | 0.02 | 0.07 | 0.01 | 0.03 | 0.12 | 0.05 | 0.02 | 0.04 | 0.07 | 0.12 |
| SEQID-03072 | K9HBQ7 | — | — | 1 | 0.48 | 0.23 | 0.06 | 0.06 | 0.05 | 0.07 | 0.01 | 0.02 | 0.05 | 0.04 | 0.03 | 0.07 | 0.06 | 0.09 |
| SEQID-03073 | K9HHA9 | — | — | 1 | 0.46 | 0.21 | 0.05 | 0.07 | 0.03 | 0.06 | 0.02 | 0.04 | 0.09 | 0.06 | 0.02 | 0.05 | 0.09 | 0.06 |
| SEQID-03074 | K9HDW7 | — | — | 1 | 0.45 | 0.20 | 0.06 | 0.06 | 0.03 | 0.03 | 0.01 | 0.05 | 0.10 | 0.06 | 0.02 | 0.05 | 0.09 | 0.07 |
| SEQID-03075 | K9H7U6 | — | — | 1 | 0.47 | 0.17 | 0.09 | 0.06 | 0.05 | 0.09 | 0.01 | 0.05 | 0.06 | 0.03 | 0.05 | 0.06 | 0.07 | 0.07 |
| SEQID-03076 | K9HES3 | — | — | 1 | 0.46 | 0.21 | 0.04 | 0.03 | 0.05 | 0.05 | 0.01 | 0.04 | 0.09 | 0.03 | 0.05 | 0.05 | 0.07 | 0.07 |
| SEQID-03077 | K9HVW3 | — | — | 1 | 0.51 | 0.22 | 0.05 | 0.13 | 0.05 | 0.03 | 0.00 | 0.04 | 0.05 | 0.03 | 0.01 | 0.09 | 0.10 | 0.13 |
| SEQID-03078 | K9HRT5 | — | — | 1 | 0.45 | 0.21 | 0.06 | 0.12 | 0.02 | 0.02 | 0.01 | 0.05 | 0.09 | 0.03 | 0.05 | 0.05 | 0.08 | 0.12 |
| SEQID-03079 | K9HST7 | — | — | 1 | 0.46 | 0.21 | 0.07 | 0.14 | 0.05 | 0.03 | 0.01 | 0.04 | 0.04 | 0.03 | 0.01 | 0.04 | 0.11 | 0.10 |
| SEQID-03080 | K9HI72 | — | — | 1 | 0.43 | 0.22 | 0.07 | 0.09 | 0.03 | 0.06 | 0.01 | 0.04 | 0.07 | 0.03 | 0.03 | 0.05 | 0.09 | 0.06 |
| SEQID-03081 | K9I88 | — | — | 1 | 0.45 | 0.19 | 0.06 | 0.05 | 0.03 | 0.05 | 0.00 | 0.04 | 0.10 | 0.03 | 0.01 | 0.04 | 0.10 | 0.10 |
| SEQID-03082 | K9I379 | — | — | 1 | 0.50 | 0.24 | 0.04 | 0.07 | 0.05 | 0.05 | 0.01 | 0.04 | 0.06 | 0.03 | 0.03 | 0.08 | 0.10 | 0.09 |
| SEQID-03083 | K9H9R8 | — | — | 1 | 0.44 | 0.20 | 0.07 | 0.06 | 0.03 | 0.08 | 0.00 | 0.05 | 0.07 | 0.03 | 0.02 | 0.06 | 0.07 | 0.06 |
| SEQID-03084 | K9I8C2 | — | — | 1 | 0.47 | 0.25 | 0.05 | 0.08 | 0.05 | 0.07 | 0.01 | 0.03 | 0.06 | 0.03 | 0.03 | 0.09 | 0.09 | 0.06 |
| SEQID-03085 | K9I5N9 | — | — | 1 | 0.45 | 0.18 | 0.04 | 0.07 | 0.05 | 0.06 | 0.01 | 0.04 | 0.08 | 0.03 | 0.04 | 0.06 | 0.09 | 0.06 |
| SEQID-03086 | K9HM3 | — | — | 1 | 0.48 | 0.23 | 0.06 | 0.07 | 0.03 | 0.06 | 0.01 | 0.04 | 0.09 | 0.03 | 0.02 | 0.06 | 0.10 | 0.08 |
| SEQID-03087 | K9I618 | — | — | 1 | 0.50 | 0.22 | 0.06 | 0.07 | 0.03 | 0.07 | 0.00 | 0.04 | 0.08 | 0.03 | 0.03 | 0.08 | 0.07 | 0.08 |
| SEQID-03088 | K9HM52 | — | — | 1 | 0.50 | 0.23 | 0.02 | 0.15 | 0.06 | 0.05 | 0.01 | 0.01 | 0.03 | 0.04 | 0.04 | 0.06 | 0.09 | 0.05 |
| SEQID-03089 | K9I619 | — | — | 1 | 0.51 | 0.26 | 0.06 | 0.12 | 0.06 | 0.07 | 0.01 | 0.06 | 0.06 | 0.04 | 0.04 | 0.06 | 0.08 | 0.11 |
| SEQID-03090 | K9HF90 | — | — | 1 | 0.41 | 0.13 | 0.04 | 0.16 | 0.05 | 0.04 | 0.03 | 0.04 | 0.06 | 0.04 | 0.02 | 0.10 | 0.06 | 0.09 |
| SEQID-03091 | K9H895 | — | — | 1 | 0.41 | 0.13 | 0.07 | 0.19 | 0.03 | 0.08 | 0.01 | 0.04 | 0.13 | 0.01 | 0.02 | 0.05 | 0.09 | 0.10 |
| SEQID-03092 | K9HYF2 | — | — | 1 | 0.50 | 0.19 | 0.09 | 0.03 | 0.03 | 0.03 | 0.00 | 0.06 | 0.06 | 0.03 | 0.02 | 0.04 | 0.08 | 0.07 |
| SEQID-03093 | K9HQ4 | — | — | 1 | 0.50 | 0.28 | 0.07 | 0.05 | 0.05 | 0.05 | 0.00 | 0.06 | 0.08 | 0.05 | 0.02 | 0.07 | 0.08 | 0.16 |
| SEQID-03094 | K9HEE4 | — | — | 1 | 0.45 | 0.22 | 0.06 | 0.06 | 0.02 | 0.05 | 0.01 | 0.04 | 0.09 | 0.04 | 0.02 | 0.06 | 0.12 | 0.08 |
| SEQID-03095 | K9HUG1 | — | — | 1 | 0.48 | 0.19 | 0.04 | 0.05 | 0.03 | 0.07 | 0.00 | 0.03 | 0.07 | 0.03 | 0.04 | 0.06 | 0.09 | 0.07 |
| SEQID-03096 | K9HV61 | — | — | 1 | 0.45 | 0.21 | 0.07 | 0.06 | 0.04 | 0.04 | 0.01 | 0.05 | 0.08 | 0.05 | 0.05 | 0.06 | 0.08 | 0.05 |
| SEQID-03097 | K9I1Z8 | — | — | 0 | 0.51 | 0.18 | 0.03 | 0.09 | 0.01 | 0.05 | 0.00 | 0.02 | 0.06 | 0.04 | 0.04 | 0.07 | 0.09 | 0.05 |
| SEQID-03098 | K9I4C3 | — | — | 1 | 0.42 | 0.20 | 0.04 | 0.15 | 0.03 | 0.04 | 0.02 | 0.06 | 0.04 | 0.05 | 0.02 | 0.09 | 0.06 | 0.18 |
| SEQID-03099 | K9HY15 | — | — | 1 | 0.42 | 0.22 | 0.06 | 0.19 | 0.02 | 0.04 | 0.00 | 0.03 | 0.07 | 0.05 | 0.03 | 0.06 | 0.09 | 0.10 |
| SEQID-03100 | K9I3C6 | — | — | 1 | 0.52 | 0.25 | 0.05 | 0.04 | 0.04 | 0.03 | 0.00 | 0.03 | 0.08 | 0.03 | 0.03 | 0.06 | 0.11 | 0.09 |
| SEQID-03101 | K9HE77 | — | — | 1 | 0.48 | 0.21 | 0.04 | 0.15 | 0.04 | 0.04 | 0.02 | 0.05 | 0.08 | 0.03 | 0.02 | 0.07 | 0.14 | 0.10 |
| SEQID-03102 | K9HMK1 | — | — | 1 | 0.48 | 0.19 | 0.06 | 0.09 | 0.06 | 0.05 | 0.01 | 0.04 | 0.06 | 0.03 | 0.02 | 0.07 | 0.03 | 0.15 |
| SEQID-03103 | K9HVM2 | — | — | 1 | 0.48 | 0.21 | 0.07 | 0.06 | 0.02 | 0.04 | 0.01 | 0.03 | 0.03 | 0.07 | 0.00 | 0.03 | 0.08 | 0.15 |
| SEQID-03104 | K9I7D4 | — | — | 0 | 0.49 | 0.22 | 0.07 | 0.05 | 0.03 | 0.03 | 0.01 | 0.03 | 0.10 | 0.04 | 0.02 | 0.04 | 0.09 | 0.09 |
| SEQID-03105 | K9HVE8 | — | — | 1 | 0.48 | 0.22 | 0.05 | 0.05 | 0.04 | 0.04 | 0.01 | 0.05 | 0.03 | 0.04 | 0.02 | 0.06 | 0.06 | 0.13 |
| SEQID-03106 | K9HYK9 | — | — | 1 | 0.45 | 0.21 | 0.05 | 0.06 | 0.04 | 0.06 | 0.01 | 0.05 | 0.10 | 0.06 | 0.03 | 0.07 | 0.07 | 0.09 |
| SEQID-03107 | K9HHM1 | — | — | 1 | 0.51 | 0.25 | 0.06 | 0.06 | 0.05 | 0.04 | 0.01 | 0.02 | 0.07 | 0.03 | 0.02 | 0.04 | 0.03 | 0.03 |
| SEQID-03108 | K9HF89 | — | — | 1 | 0.47 | 0.21 | 0.07 | 0.06 | 0.08 | 0.05 | 0.01 | 0.09 | 0.03 | 0.05 | 0.03 | 0.08 | 0.11 | 0.06 |
| SEQID-03109 | K9HI57 | — | — | 1 | 0.37 | 0.17 | 0.06 | 0.11 | 0.02 | 0.09 | 0.01 | 0.06 | 0.13 | 0.03 | 0.02 | 0.07 | 0.06 | 0.02 |
| SEQID-03110 | K9I7S9 | — | — | 1 | 0.40 | 0.17 | 0.02 | 0.21 | 0.06 | 0.07 | 0.01 | 0.03 | 0.03 | 0.03 | 0.03 | 0.06 | 0.05 | 0.09 |
| SEQID-03111 | K9I5Q6 | — | — | 1 | 0.49 | 0.22 | 0.04 | 0.06 | 0.04 | 0.05 | 0.01 | 0.05 | 0.08 | 0.03 | 0.06 | 0.06 | 0.09 | 0.10 |
| SEQID-03112 | K9HMM0 | — | — | 1 | 0.47 | 0.23 | 0.06 | 0.09 | 0.05 | 0.05 | 0.01 | 0.04 | 0.06 | 0.03 | 0.05 | 0.06 | 0.10 | 0.07 |
| SEQID-03113 | K9I794 | — | — | 1 | 0.46 | 0.17 | 0.05 | 0.06 | 0.04 | 0.05 | 0.01 | 0.04 | 0.07 | 0.04 | 0.05 | 0.04 | 0.09 | 0.07 |
| SEQID-03114 | K9I1B2 | — | — | 1 | 0.47 | 0.19 | 0.04 | 0.07 | 0.03 | 0.09 | 0.02 | 0.03 | 0.09 | 0.04 | 0.05 | 0.04 | 0.09 | 0.06 |
| SEQID-03115 | K9I6M4 | — | — | 1 | 0.47 | 0.22 | 0.04 | 0.05 | 0.04 | 0.07 | 0.01 | 0.03 | 0.13 | 0.02 | 0.01 | 0.07 | 0.10 | 0.09 |
| SEQID-03116 | K9HWR2 | — | — | 1 | 0.46 | 0.24 | 0.05 | 0.08 | 0.04 | 0.06 | 0.01 | 0.04 | 0.06 | 0.03 | 0.02 | 0.06 | 0.10 | 0.11 |
| SEQID-03117 | K5HA66 | — | — | 1 | 0.45 | 0.20 | 0.07 | 0.06 | 0.04 | 0.05 | 0.01 | 0.04 | 0.06 | 0.03 | 0.03 | 0.07 | 0.11 | 0.06 |
| SEQID-03118 | K9HQF1 | — | — | 1 | 0.48 | 0.20 | 0.04 | 0.03 | 0.04 | 0.04 | 0.01 | 0.04 | 0.07 | 0.05 | 0.03 | 0.08 | 0.08 | 0.07 |
| SEQID-03119 | K9HZD5 | — | — | 1 | 0.55 | 0.18 | 0.04 | 0.04 | 0.04 | 0.05 | 0.01 | 0.04 | 0.04 | 0.04 | 0.03 | 0.05 | 0.05 | 0.06 |
| SEQID-03120 | K9HRR8 | — | — | 1 | 0.52 | 0.21 | 0.04 | 0.05 | 0.00 | 0.07 | 0.02 | 0.04 | 0.09 | 0.07 | 0.03 | 0.04 | 0.08 | 0.10 |
| SEQID-03121 | K9HM68 | — | — | 1 | 0.49 | 0.21 | 0.07 | 0.12 | 0.05 | 0.05 | 0.01 | 0.04 | 0.05 | 0.04 | 0.01 | 0.05 | 0.09 | 0.10 |
| SEQID-03122 | K9I509 | — | — | 1 | 0.45 | 0.20 | 0.10 | 0.07 | 0.05 | 0.06 | 0.01 | 0.04 | 0.07 | 0.03 | 0.03 | 0.08 | 0.06 | 0.05 |

TABLE 1-continued

| SEQID-03123 | K9HMX1 | — | — | 0 | 0.46 | 0.27 | 0.09 | 0.03 | 0.03 | 0.06 | 0.01 | 0.04 | 0.05 | 0.05 | 0.02 | 0.06 | 0.11 | 0.07 |
|---|---|---|---|---|---|---|---|---|---|---|---|---|---|---|---|---|---|---|
| SEQID-03124 | K9H1O3 | — | — | 1 | 0.43 | 0.21 | 0.06 | 0.08 | 0.04 | 0.05 | 0.01 | 0.04 | 0.10 | 0.04 | 0.04 | 0.07 | 0.08 | 0.07 |
| SEQID-03125 | K9HPE6 | — | — | 1 | 0.43 | 0.21 | 0.05 | 0.03 | 0.06 | 0.05 | 0.01 | 0.04 | 0.07 | 0.03 | 0.04 | 0.07 | 0.07 | 0.06 |
| SEQID-03126 | K9HEC5 | — | — | 1 | 0.44 | 0.21 | 0.07 | 0.07 | 0.05 | 0.06 | 0.01 | 0.04 | 0.06 | 0.04 | 0.02 | 0.05 | 0.11 | 0.07 |
| SEQID-03127 | K9H4L4 | — | — | 1 | 0.52 | 0.22 | 0.06 | 0.03 | 0.05 | 0.06 | 0.01 | 0.04 | 0.06 | 0.05 | 0.03 | 0.08 | 0.07 | 0.09 |
| SEQID-03128 | K9H4N1 | — | — | 1 | 0.51 | 0.22 | 0.06 | 0.04 | 0.04 | 0.06 | 0.02 | 0.03 | 0.07 | 0.04 | 0.03 | 0.07 | 0.09 | 0.09 |
| SEQID-03129 | K9HK61 | — | — | 1 | 0.50 | 0.20 | 0.06 | 0.05 | 0.02 | 0.05 | 0.01 | 0.04 | 0.06 | 0.05 | 0.05 | 0.06 | 0.09 | 0.06 |
| SEQID-03130 | K9HQA9 | — | — | 1 | 0.53 | 0.26 | 0.05 | 0.07 | 0.03 | 0.07 | 0.01 | 0.04 | 0.08 | 0.05 | 0.03 | 0.06 | 0.11 | 0.05 |
| SEQID-03131 | K9HAR9 | — | — | 1 | 0.45 | 0.22 | 0.05 | 0.09 | 0.04 | 0.06 | 0.01 | 0.03 | 0.06 | 0.05 | 0.02 | 0.06 | 0.10 | 0.07 |
| SEQID-03132 | K9I219 | — | — | 1 | 0.46 | 0.20 | 0.05 | 0.03 | 0.03 | 0.05 | 0.01 | 0.04 | 0.08 | 0.04 | 0.03 | 0.06 | 0.09 | 0.06 |
| SEQID-03133 | K9HC31 | — | — | 1 | 0.47 | 0.20 | 0.04 | 0.06 | 0.04 | 0.05 | 0.01 | 0.04 | 0.06 | 0.04 | 0.04 | 0.04 | 0.10 | 0.06 |
| SEQID-03134 | K9HCT6 | — | — | 1 | 0.42 | 0.17 | 0.04 | 0.10 | 0.05 | 0.04 | 0.01 | 0.04 | 0.05 | 0.05 | 0.04 | 0.05 | 0.05 | 0.04 |
| SEQID-03135 | K9HHW4 | — | — | 1 | 0.50 | 0.21 | 0.06 | 0.03 | 0.04 | 0.02 | 0.01 | 0.08 | 0.03 | 0.04 | 0.03 | 0.05 | 0.07 | 0.02 |
| SEQID-03136 | K9HP63 | — | — | 1 | 0.48 | 0.21 | 0.03 | 0.13 | 0.04 | 0.08 | 0.01 | 0.04 | 0.05 | 0.04 | 0.01 | 0.06 | 0.08 | 0.13 |
| SEQID-03137 | K9HN29 | — | — | 1 | 0.50 | 0.22 | 0.04 | 0.06 | 0.04 | 0.08 | 0.01 | 0.03 | 0.06 | 0.03 | 0.04 | 0.05 | 0.08 | 0.06 |
| SEQID-03138 | K9HQ79 | — | — | 1 | 0.43 | 0.20 | 0.05 | 0.07 | 0.03 | 0.05 | 0.01 | 0.04 | 0.05 | 0.04 | 0.04 | 0.05 | 0.08 | 0.08 |
| SEQID-03139 | K9HPY6 | — | — | 1 | 0.47 | 0.22 | 0.05 | 0.03 | 0.03 | 0.06 | 0.02 | 0.03 | 0.07 | 0.06 | 0.02 | 0.06 | 0.10 | 0.06 |
| SEQID-03140 | K9HJ92 | — | — | 1 | 0.42 | 0.19 | 0.06 | 0.03 | 0.04 | 0.06 | 0.01 | 0.04 | 0.06 | 0.04 | 0.03 | 0.06 | 0.08 | 0.05 |
| SEQID-03141 | K9I7R9 | — | — | 1 | 0.50 | 0.24 | 0.05 | 0.11 | 0.03 | 0.03 | 0.01 | 0.03 | 0.07 | 0.05 | 0.03 | 0.08 | 0.08 | 0.10 |
| SEQID-03142 | K9HJT2 | — | — | 1 | 0.47 | 0.22 | 0.05 | 0.06 | 0.06 | 0.07 | 0.00 | 0.03 | 0.07 | 0.03 | 0.03 | 0.06 | 0.08 | 0.08 |
| SEQID-03143 | K9I574 | — | — | 1 | 0.44 | 0.20 | 0.08 | 0.17 | 0.07 | 0.05 | 0.01 | 0.04 | 0.03 | 0.04 | 0.02 | 0.06 | 0.08 | 0.03 |
| SEQID-03144 | K9HQA4 | — | — | 1 | 0.43 | 0.20 | 0.07 | 0.14 | 0.04 | 0.04 | 0.02 | 0.03 | 0.06 | 0.05 | 0.04 | 0.06 | 0.07 | 0.06 |
| SEQID-03145 | K9H297 | — | — | 1 | 0.45 | 0.21 | 0.05 | 0.07 | 0.03 | 0.05 | 0.01 | 0.04 | 0.07 | 0.05 | 0.04 | 0.04 | 0.11 | 0.07 |
| SEQID-03146 | K9I361 | — | — | 1 | 0.47 | 0.24 | 0.07 | 0.10 | 0.04 | 0.06 | 0.01 | 0.06 | 0.05 | 0.04 | 0.02 | 0.04 | 0.09 | 0.05 |
| SEQID-03147 | K9HBR0 | — | — | 0 | 0.41 | 0.24 | 0.09 | 0.05 | 0.02 | 0.05 | 0.02 | 0.10 | 0.07 | 0.03 | 0.02 | 0.09 | 0.05 | 0.08 |
| SEQID-03148 | K9I7W3 | — | — | 0 | 0.54 | 0.18 | 0.06 | 0.07 | 0.04 | 0.09 | 0.00 | 0.03 | 0.02 | 0.03 | 0.02 | 0.11 | 0.06 | 0.17 |
| SEQID-03149 | K9I1Y2 | — | — | 1 | 0.48 | 0.29 | 0.05 | 0.14 | 0.04 | 0.06 | 0.01 | 0.03 | 0.04 | 0.05 | 0.03 | 0.06 | 0.09 | 0.07 |
| SEQID-03150 | K9HOT0 | — | — | 1 | 0.42 | 0.16 | 0.01 | 0.06 | 0.03 | 0.03 | 0.00 | 0.04 | 0.05 | 0.05 | 0.01 | 0.12 | 0.09 | 0.07 |
| SEQID-03151 | K9HT24 | — | — | 1 | 0.48 | 0.23 | 0.03 | 0.11 | 0.04 | 0.06 | 0.01 | 0.03 | 0.04 | 0.06 | 0.01 | 0.05 | 0.05 | 0.04 |
| SEQID-03152 | K9I2D5 | — | — | 1 | 0.47 | 0.21 | 0.07 | 0.06 | 0.01 | 0.08 | 0.01 | 0.04 | 0.03 | 0.03 | 0.02 | 0.07 | 0.09 | 0.09 |
| SEQID-03153 | K9HI94 | — | — | 1 | 0.45 | 0.17 | 0.04 | 0.17 | 0.03 | 0.03 | 0.00 | 0.04 | 0.02 | 0.02 | 0.03 | 0.07 | 0.07 | 0.09 |
| SEQID-03154 | K9I5L3 | — | — | 1 | 0.48 | 0.25 | 0.08 | 0.14 | 0.04 | 0.04 | 0.00 | 0.04 | 0.07 | 0.03 | 0.04 | 0.05 | 0.06 | 0.11 |
| SEQID-03155 | K9HP79 | — | — | 1 | 0.46 | 0.19 | 0.06 | 0.08 | 0.05 | 0.07 | 0.00 | 0.06 | 0.05 | 0.03 | 0.04 | 0.09 | 0.09 | 0.10 |
| SEQID-03156 | K9H787 | — | — | 1 | 0.46 | 0.15 | 0.04 | 0.10 | 0.05 | 0.06 | 0.01 | 0.04 | 0.07 | 0.04 | 0.04 | 0.09 | 0.08 | 0.06 |
| SEQID-03157 | K9HEU3 | — | — | 1 | 0.51 | 0.16 | 0.05 | 0.03 | 0.04 | 0.05 | 0.03 | 0.03 | 0.07 | 0.05 | 0.00 | 0.03 | 0.09 | 0.09 |
| SEQID-03158 | K9HGS4 | — | — | 1 | 0.51 | 0.14 | 0.07 | 0.03 | 0.03 | 0.07 | 0.00 | 0.04 | 0.09 | 0.06 | 0.03 | 0.06 | 0.05 | 0.09 |
| SEQID-03159 | K9HNK9 | — | — | 1 | 0.44 | 0.19 | 0.08 | 0.10 | 0.03 | 0.06 | 0.00 | 0.03 | 0.07 | 0.02 | 0.00 | 0.03 | 0.08 | 0.10 |
| SEQID-03160 | K9HGC5 | — | — | 1 | 0.43 | 0.23 | 0.07 | 0.07 | 0.04 | 0.07 | 0.01 | 0.05 | 0.07 | 0.04 | 0.03 | 0.07 | 0.06 | 0.06 |
| SEQID-03161 | K9HVR1 | — | — | 1 | 0.51 | 0.20 | 0.04 | 0.04 | 0.03 | 0.07 | 0.02 | 0.05 | 0.06 | 0.04 | 0.01 | 0.07 | 0.10 | 0.05 |
| SEQID-03162 | K9HID1 | — | — | 0 | 0.40 | 0.14 | 0.06 | 0.05 | 0.03 | 0.06 | 0.00 | 0.09 | 0.09 | 0.04 | 0.07 | 0.05 | 0.07 | 0.07 |
| SEQID-03163 | K9HWF5 | — | — | 1 | 0.49 | 0.22 | 0.07 | 0.09 | 0.04 | 0.07 | 0.01 | 0.04 | 0.09 | 0.04 | 0.06 | 0.04 | 0.07 | 0.09 |
| SEQID-03164 | K9HFM8 | — | — | 1 | 0.47 | 0.24 | 0.06 | 0.05 | 0.03 | 0.07 | 0.03 | 0.03 | 0.07 | 0.05 | 0.01 | 0.05 | 0.10 | 0.12 |
| SEQID-03165 | K9HCU6 | — | — | 1 | 0.47 | 0.18 | 0.05 | 0.03 | 0.03 | 0.07 | 0.00 | 0.04 | 0.09 | 0.05 | 0.01 | 0.08 | 0.09 | 0.09 |
| SEQID-03166 | K9I5M1 | — | — | 1 | 0.46 | 0.23 | 0.05 | 0.06 | 0.05 | 0.06 | 0.00 | 0.03 | 0.07 | 0.04 | 0.03 | 0.07 | 0.08 | 0.09 |
| SEQID-03167 | K9HP80 | — | — | 1 | 0.47 | 0.23 | 0.05 | 0.07 | 0.05 | 0.05 | 0.00 | 0.03 | 0.05 | 0.04 | 0.04 | 0.05 | 0.11 | 0.10 |
| SEQID-03168 | K9I3Y1 | — | — | 1 | 0.48 | 0.21 | 0.03 | 0.04 | 0.05 | 0.06 | 0.01 | 0.02 | 0.07 | 0.04 | 0.05 | 0.05 | 0.09 | 0.06 |
| SEQID-03169 | K9HRV8 | — | — | 0 | 0.46 | 0.23 | 0.07 | 0.05 | 0.03 | 0.05 | 0.00 | 0.04 | 0.09 | 0.05 | 0.02 | 0.08 | 0.07 | 0.05 |
| SEQID-03170 | K9HH49 | — | — | 1 | 0.43 | 0.24 | 0.07 | 0.09 | 0.03 | 0.06 | 0.02 | 0.05 | 0.06 | 0.05 | 0.02 | 0.07 | 0.09 | 0.07 |
| SEQID-03171 | K9IB94 | — | — | 1 | 0.47 | 0.16 | 0.05 | 0.09 | 0.05 | 0.05 | 0.00 | 0.04 | 0.08 | 0.03 | 0.05 | 0.04 | 0.06 | 0.04 |
| SEQID-03172 | K9I3N1 | — | — | 1 | 0.49 | 0.22 | 0.04 | 0.07 | 0.04 | 0.07 | 0.01 | 0.04 | 0.03 | 0.04 | 0.05 | 0.06 | 0.09 | 0.05 |
| SEQID-03173 | K9HP17 | — | — | 1 | 0.45 | 0.24 | 0.06 | 0.06 | 0.05 | 0.06 | 0.01 | 0.02 | 0.07 | 0.04 | 0.03 | 0.06 | 0.10 | 0.07 |
| SEQID-03174 | K9HR9 | — | — | 1 | 0.54 | 0.22 | 0.04 | 0.07 | 0.07 | 0.04 | 0.01 | 0.04 | 0.08 | 0.03 | 0.04 | 0.08 | 0.09 | 0.15 |
| SEQID-03175 | K9HXT8 | — | — | 1 | 0.52 | 0.24 | 0.06 | 0.13 | 0.02 | 0.05 | 0.00 | 0.03 | 0.06 | 0.03 | 0.02 | 0.07 | 0.09 | 0.14 |

TABLE 1-continued

| SEQID | ID | | | | | | | | | | | | | | | | | |
|---|---|---|---|---|---|---|---|---|---|---|---|---|---|---|---|---|---|---|
| SEQID-03176 | K9HZL6 | — | — | 0 | 0.42 | 0.22 | 0.09 | 0.13 | 0.01 | 0.04 | 0.01 | 0.06 | 0.05 | 0.05 | 0.01 | 0.06 | 0.09 | 0.11 |
| SEQID-03177 | K9HHS6 | — | — | 1 | 0.51 | 0.23 | 0.04 | 0.12 | 0.01 | 0.03 | 0.00 | 0.05 | 0.05 | 0.03 | 0.04 | 0.09 | 0.09 | 0.11 |
| SEQID-03178 | K9HJC3 | — | — | 1 | 0.47 | 0.25 | 0.08 | 0.07 | 0.03 | 0.06 | 0.01 | 0.04 | 0.09 | 0.04 | 0.02 | 0.09 | 0.09 | 0.12 |
| SEQID-03179 | K9HXR3 | — | — | 1 | 0.50 | 0.18 | 0.04 | 0.14 | 0.03 | 0.05 | 0.01 | 0.04 | 0.02 | 0.04 | 0.02 | 0.06 | 0.06 | 0.13 |
| SEQID-03180 | K9I3A2 | — | — | 1 | 0.50 | 0.17 | 0.09 | 0.11 | 0.05 | 0.07 | 0.01 | 0.02 | 0.04 | 0.01 | 0.04 | 0.05 | 0.06 | 0.18 |
| SEQID-03181 | K9I737 | — | — | 0 | 0.45 | 0.17 | 0.05 | 0.14 | 0.02 | 0.03 | 0.01 | 0.02 | 0.06 | 0.03 | 0.05 | 0.06 | 0.02 | 0.09 |
| SEQID-03182 | K9I4D4 | — | — | 0 | 0.52 | 0.23 | 0.05 | 0.15 | 0.05 | 0.04 | 0.00 | 0.04 | 0.04 | 0.04 | 0.06 | 0.06 | 0.11 | 0.13 |
| SEQID-03183 | K9HA62 | — | — | 1 | 0.55 | 0.26 | 0.03 | 0.06 | 0.02 | 0.06 | 0.01 | 0.05 | 0.05 | 0.05 | 0.02 | 0.06 | 0.13 | 0.16 |
| SEQID-03184 | K9HYH7 | — | — | 1 | 0.57 | 0.26 | 0.08 | 0.06 | 0.03 | 0.04 | 0.02 | 0.02 | 0.02 | 0.03 | 0.05 | 0.09 | 0.12 | 0.06 |
| SEQID-03185 | K9HVR7 | — | — | 1 | 0.46 | 0.21 | 0.03 | 0.08 | 0.04 | 0.06 | 0.01 | 0.04 | 0.04 | 0.03 | 0.05 | 0.04 | 0.07 | 0.06 |
| SEQID-03186 | K9HU08 | — | — | 1 | 0.49 | 0.26 | 0.05 | 0.06 | 0.04 | 0.09 | 0.01 | 0.03 | 0.09 | 0.05 | 0.05 | 0.06 | 0.12 | 0.06 |
| SEQID-03187 | K9I3W7 | — | — | 1 | 0.50 | 0.22 | 0.04 | 0.06 | 0.04 | 0.05 | 0.00 | 0.06 | 0.04 | 0.05 | 0.05 | 0.05 | 0.09 | 0.06 |
| SEQID-03188 | K9I5W6 | — | — | 1 | 0.42 | 0.16 | 0.07 | 0.09 | 0.03 | 0.04 | 0.02 | 0.03 | 0.05 | 0.03 | 0.03 | 0.05 | 0.06 | 0.05 |
| SEQID-03189 | K9I0R0 | — | — | 1 | 0.51 | 0.24 | 0.05 | 0.07 | 0.05 | 0.09 | 0.00 | 0.03 | 0.03 | 0.06 | 0.05 | 0.05 | 0.12 | 0.09 |
| SEQID-03190 | K9HPF6 | — | — | 1 | 0.40 | 0.22 | 0.07 | 0.04 | 0.04 | 0.06 | 0.01 | 0.07 | 0.12 | 0.03 | 0.01 | 0.09 | 0.09 | 0.09 |
| SEQID-03191 | K9HZH4 | — | — | 1 | 0.43 | 0.25 | 0.06 | 0.08 | 0.04 | 0.04 | 0.02 | 0.08 | 0.05 | 0.04 | 0.09 | 0.09 | 0.07 | 0.04 |
| SEQID-03192 | K9I560 | — | — | 1 | 0.45 | 0.23 | 0.04 | 0.06 | 0.04 | 0.04 | 0.01 | 0.04 | 0.04 | 0.04 | 0.08 | 0.08 | 0.03 | 0.07 |
| SEQID-03193 | K9HMV4 | — | — | 1 | 0.45 | 0.22 | 0.06 | 0.05 | 0.06 | 0.06 | 0.01 | 0.04 | 0.07 | 0.04 | 0.06 | 0.06 | 0.07 | 0.05 |
| SEQID-03194 | K9HNW8 | — | — | 1 | 0.47 | 0.17 | 0.05 | 0.06 | 0.04 | 0.03 | 0.00 | 0.05 | 0.06 | 0.04 | 0.03 | 0.04 | 0.07 | 0.06 |
| SEQID-03195 | K9HPX5 | — | — | 1 | 0.48 | 0.23 | 0.06 | 0.07 | 0.06 | 0.05 | 0.02 | 0.06 | 0.07 | 0.03 | 0.04 | 0.06 | 0.09 | 0.07 |
| SEQID-03196 | K9HUE6 | — | — | 1 | 0.44 | 0.24 | 0.07 | 0.09 | 0.04 | 0.04 | 0.01 | 0.03 | 0.06 | 0.05 | 0.02 | 0.09 | 0.07 | 0.04 |
| SEQID-03197 | K9HU8 | — | — | 1 | 0.48 | 0.20 | 0.05 | 0.03 | 0.02 | 0.06 | 0.01 | 0.03 | 0.10 | 0.03 | 0.04 | 0.07 | 0.09 | 0.08 |
| SEQID-03198 | K9HCR7 | — | — | 1 | 0.47 | 0.21 | 0.07 | 0.06 | 0.04 | 0.05 | 0.02 | 0.03 | 0.07 | 0.04 | 0.07 | 0.06 | 0.09 | 0.06 |
| SEQID-03199 | K9HE21 | — | — | 1 | 0.48 | 0.23 | 0.04 | 0.07 | 0.03 | 0.06 | 0.00 | 0.03 | 0.09 | 0.04 | 0.06 | 0.06 | 0.13 | 0.06 |
| SEQID-03200 | K9HEI4 | — | — | 1 | 0.47 | 0.24 | 0.06 | 0.09 | 0.04 | 0.06 | 0.01 | 0.04 | 0.03 | 0.04 | 0.04 | 0.05 | 0.11 | 0.05 |
| SEQID-03201 | K9HY34 | — | — | 1 | 0.49 | 0.21 | 0.07 | 0.07 | 0.04 | 0.06 | 0.01 | 0.05 | 0.07 | 0.03 | 0.08 | 0.09 | 0.11 | 0.05 |
| SEQID-03202 | K9HS49 | — | — | 1 | 0.49 | 0.20 | 0.05 | 0.06 | 0.04 | 0.06 | 0.01 | 0.05 | 0.06 | 0.04 | 0.06 | 0.09 | 0.09 | 0.09 |
| SEQID-03203 | K9HSL7 | — | — | 1 | 0.45 | 0.22 | 0.06 | 0.03 | 0.05 | 0.05 | 0.02 | 0.06 | 0.07 | 0.03 | 0.04 | 0.07 | 0.07 | 0.06 |
| SEQID-03204 | K9I6Y5 | — | — | 0 | 0.50 | 0.20 | 0.06 | 0.06 | 0.04 | 0.04 | 0.02 | 0.03 | 0.09 | 0.03 | 0.04 | 0.05 | 0.10 | 0.05 |
| SEQID-03205 | K9HUY3 | — | — | 1 | 0.46 | 0.22 | 0.05 | 0.07 | 0.03 | 0.09 | 0.01 | 0.05 | 0.09 | 0.05 | 0.02 | 0.06 | 0.07 | 0.10 |
| SEQID-03206 | K9HCM5 | — | — | 1 | 0.48 | 0.21 | 0.05 | 0.08 | 0.05 | 0.06 | 0.02 | 0.05 | 0.09 | 0.04 | 0.05 | 0.06 | 0.09 | 0.07 |
| SEQID-03207 | K9HFN2 | — | — | 1 | 0.50 | 0.17 | 0.04 | 0.05 | 0.03 | 0.07 | 0.01 | 0.03 | 0.07 | 0.03 | 0.06 | 0.04 | 0.09 | 0.07 |
| SEQID-03208 | K9I3M2 | — | — | 1 | 0.46 | 0.17 | 0.04 | 0.07 | 0.04 | 0.09 | 0.01 | 0.04 | 0.05 | 0.04 | 0.05 | 0.04 | 0.07 | 0.07 |
| SEQID-03209 | K9HV87 | — | — | 1 | 0.42 | 0.17 | 0.05 | 0.07 | 0.06 | 0.08 | 0.01 | 0.04 | 0.06 | 0.04 | 0.04 | 0.04 | 0.07 | 0.04 |
| SEQID-03210 | K9I6W6 | — | — | 1 | 0.45 | 0.21 | 0.04 | 0.09 | 0.05 | 0.07 | 0.02 | 0.04 | 0.05 | 0.03 | 0.05 | 0.06 | 0.06 | 0.06 |
| SEQID-03211 | K9HXM7 | — | — | 1 | 0.47 | 0.22 | 0.05 | 0.08 | 0.04 | 0.07 | 0.01 | 0.05 | 0.08 | 0.05 | 0.05 | 0.06 | 0.10 | 0.07 |
| SEQID-03212 | K9HBK9 | — | — | 1 | 0.46 | 0.24 | 0.05 | 0.09 | 0.04 | 0.05 | 0.01 | 0.03 | 0.08 | 0.04 | 0.02 | 0.05 | 0.10 | 0.08 |
| SEQID-03213 | K9HH69 | — | — | 1 | 0.43 | 0.21 | 0.06 | 0.08 | 0.04 | 0.06 | 0.01 | 0.04 | 0.08 | 0.03 | 0.05 | 0.05 | 0.10 | 0.05 |
| SEQID-03214 | K9HKG7 | — | — | 0 | 0.46 | 0.23 | 0.07 | 0.19 | 0.02 | 0.01 | 0.00 | 0.04 | 0.08 | 0.09 | 0.02 | 0.05 | 0.10 | 0.12 |
| SEQID-03215 | K9IL2 | — | — | 1 | 0.59 | 0.23 | 0.04 | 0.09 | 0.02 | 0.03 | 0.00 | 0.02 | 0.03 | 0.02 | 0.05 | 0.09 | 0.09 | 0.21 |
| SEQID-03216 | K9HK97 | — | — | 1 | 0.44 | 0.20 | 0.09 | 0.07 | 0.04 | 0.04 | 0.00 | 0.03 | 0.09 | 0.05 | 0.01 | 0.09 | 0.06 | 0.11 |
| SEQID-03217 | K9HLM3 | — | — | 0 | 0.43 | 0.18 | 0.11 | 0.17 | 0.04 | 0.01 | 0.00 | 0.07 | 0.06 | 0.05 | 0.01 | 0.04 | 0.10 | 0.11 |
| SEQID-03218 | K9HB34 | — | — | 1 | 0.43 | 0.21 | 0.04 | 0.18 | 0.01 | 0.03 | 0.00 | 0.04 | 0.08 | 0.02 | 0.02 | 0.06 | 0.09 | 0.09 |
| SEQID-03219 | K9HHM4 | — | — | 1 | 0.53 | 0.19 | 0.03 | 0.17 | 0.04 | 0.06 | 0.00 | 0.02 | 0.06 | 0.02 | 0.02 | 0.05 | 0.07 | 0.12 |
| SEQID-03220 | K9I2C7 | — | — | 1 | 0.41 | 0.14 | 0.04 | 0.11 | 0.03 | 0.02 | 0.00 | 0.03 | 0.06 | 0.07 | 0.09 | 0.05 | 0.07 | 0.07 |
| SEQID-03221 | K9I0P4 | — | — | 0 | 0.46 | 0.23 | 0.04 | 0.10 | 0.01 | 0.03 | 0.01 | 0.04 | 0.09 | 0.09 | 0.01 | 0.02 | 0.08 | 0.07 |
| SEQID-03222 | K9HQL8 | — | — | 0 | 0.48 | 0.25 | 0.07 | 0.14 | 0.05 | 0.05 | 0.01 | 0.01 | 0.06 | 0.05 | 0.03 | 0.05 | 0.10 | 0.10 |
| SEQID-03223 | K9HQV1 | — | — | 1 | 0.43 | 0.20 | 0.04 | 0.13 | 0.02 | 0.07 | 0.00 | 0.03 | 0.09 | 0.02 | 0.01 | 0.07 | 0.09 | 0.11 |
| SEQID-03224 | K9I5G0 | — | — | 1 | 0.45 | 0.24 | 0.05 | 0.06 | 0.04 | 0.03 | 0.00 | 0.04 | 0.09 | 0.05 | 0.02 | 0.07 | 0.06 | 0.08 |
| SEQID-03225 | K9ICR1 | — | — | 1 | 0.47 | 0.18 | 0.04 | 0.09 | 0.04 | 0.06 | 0.00 | 0.01 | 0.06 | 0.03 | 0.04 | 0.05 | 0.11 | 0.07 |
| SEQID-03226 | K9HNM9 | — | — | 0 | 0.40 | 0.15 | 0.07 | 0.19 | 0.04 | 0.03 | 0.00 | 0.05 | 0.06 | 0.04 | 0.04 | 0.05 | 0.07 | 0.15 |
| SEQID-03227 | K9HSQ2 | — | — | 1 | 0.48 | 0.24 | 0.04 | 0.16 | 0.02 | 0.06 | 0.01 | 0.05 | 0.07 | 0.03 | 0.04 | 0.06 | 0.09 | 0.11 |
| SEQID-03228 | K9HPQ3 | — | — | 1 | 0.43 | 0.21 | 0.07 | 0.03 | 0.03 | 0.05 | 0.00 | 0.03 | 0.11 | 0.04 | 0.03 | 0.06 | 0.10 | 0.09 |

TABLE 1-continued

| | | | | | | | | | | | | | | |
|---|---|---|---|---|---|---|---|---|---|---|---|---|---|---|
| SEQID-03229 | K9H7S5 | — | 1 | 0.50 | 0.26 | 0.06 | 0.04 | 0.06 | 0.01 | 0.03 | 0.07 | 0.05 | 0.02 | 0.06 | 0.09 | 0.07 |
| SEQID-03230 | K9HUD2 | — | 1 | 0.43 | 0.27 | 0.06 | 0.04 | 0.06 | 0.00 | 0.04 | 0.06 | 0.05 | 0.01 | 0.07 | 0.09 | 0.07 |
| SEQID-03231 | K9HP00 | — | 0 | 0.40 | 0.18 | 0.07 | 0.04 | 0.05 | 0.01 | 0.06 | 0.09 | 0.04 | 0.04 | 0.04 | 0.09 | 0.06 |
| SEQID-03232 | K9I605 | — | 1 | 0.51 | 0.26 | 0.04 | 0.04 | 0.04 | 0.01 | 0.04 | 0.10 | 0.04 | 0.03 | 0.10 | 0.11 | 0.09 |
| SEQID-03233 | K9HHI3 | — | 1 | 0.48 | 0.21 | 0.05 | 0.03 | 0.06 | 0.01 | 0.05 | 0.09 | 0.02 | 0.04 | 0.06 | 0.09 | 0.06 |
| SEQID-03234 | K9I835 | — | 1 | 0.47 | 0.21 | 0.03 | 0.05 | 0.06 | 0.03 | 0.07 | 0.09 | 0.04 | 0.05 | 0.06 | 0.09 | 0.04 |
| SEQID-03235 | K9HTL8 | — | 1 | 0.46 | 0.24 | 0.10 | 0.04 | 0.06 | 0.01 | 0.04 | 0.04 | 0.04 | 0.01 | 0.08 | 0.09 | 0.06 |
| SEQID-03236 | K9HZX9 | — | 1 | 0.41 | 0.18 | 0.03 | 0.04 | 0.08 | 0.01 | 0.02 | 0.09 | 0.03 | 0.03 | 0.04 | 0.07 | 0.03 |
| SEQID-03237 | K9HY97 | — | 1 | 0.42 | 0.18 | 0.11 | 0.05 | 0.06 | 0.03 | 0.02 | 0.09 | 0.04 | 0.00 | 0.06 | 0.09 | 0.03 |
| SEQID-03238 | K9HKZ1 | — | 1 | 0.43 | 0.25 | 0.07 | 0.04 | 0.05 | 0.01 | 0.07 | 0.09 | 0.04 | 0.03 | 0.09 | 0.09 | 0.06 |
| SEQID-03239 | K9HNA4 | — | 1 | 0.46 | 0.20 | 0.08 | 0.04 | 0.07 | 0.01 | 0.07 | 0.08 | 0.04 | 0.01 | 0.08 | 0.09 | 0.02 |
| SEQID-03240 | K9HR04 | — | 1 | 0.46 | 0.22 | 0.07 | 0.03 | 0.06 | 0.01 | 0.02 | 0.05 | 0.03 | 0.01 | 0.05 | 0.07 | 0.06 |
| SEQID-03241 | K9I209 | — | 1 | 0.45 | 0.16 | 0.04 | 0.03 | 0.05 | 0.01 | 0.03 | 0.09 | 0.04 | 0.02 | 0.05 | 0.07 | 0.05 |
| SEQID-03242 | K9I4P0 | — | 1 | 0.46 | 0.23 | 0.07 | 0.05 | 0.05 | 0.01 | 0.02 | 0.09 | 0.04 | 0.05 | 0.05 | 0.10 | 0.09 |
| SEQID-03243 | K9I7A5 | — | 1 | 0.47 | 0.22 | 0.06 | 0.03 | 0.06 | 0.01 | 0.05 | 0.08 | 0.04 | 0.03 | 0.07 | 0.10 | 0.06 |
| SEQID-03244 | K9HKA6 | — | 1 | 0.46 | 0.17 | 0.08 | 0.04 | 0.06 | 0.01 | 0.05 | 0.05 | 0.02 | 0.03 | 0.05 | 0.07 | 0.06 |
| SEQID-03245 | K9I17 | — | 1 | 0.48 | 0.20 | 0.05 | 0.04 | 0.05 | 0.01 | 0.02 | 0.09 | 0.05 | 0.03 | 0.05 | 0.09 | 0.04 |
| SEQID-03246 | K9I4A6 | — | 1 | 0.47 | 0.27 | 0.07 | 0.05 | 0.05 | 0.00 | 0.03 | 0.06 | 0.05 | 0.07 | 0.09 | 0.09 | 0.05 |
| SEQID-03247 | C9H105 | — | 1 | 0.43 | 0.20 | 0.05 | 0.04 | 0.06 | 0.02 | 0.05 | 0.09 | 0.04 | 0.03 | 0.07 | 0.09 | 0.06 |
| SEQID-03248 | K9HP50 | — | 1 | 0.52 | 0.25 | 0.07 | 0.05 | 0.04 | 0.01 | 0.03 | 0.05 | 0.04 | 0.04 | 0.09 | 0.10 | 0.04 |
| SEQID-03249 | K9HY17 | — | 1 | 0.44 | 0.19 | 0.10 | 0.03 | 0.04 | 0.01 | 0.02 | 0.09 | 0.02 | 0.05 | 0.09 | 0.09 | 0.05 |
| SEQID-03250 | K9HXU7 | — | 1 | 0.50 | 0.22 | 0.07 | 0.03 | 0.04 | 0.01 | 0.04 | 0.10 | 0.05 | 0.05 | 0.06 | 0.10 | 0.07 |
| SEQID-03251 | K9I7E3 | — | 1 | 0.45 | 0.30 | 0.05 | 0.02 | 0.07 | 0.00 | 0.04 | 0.07 | 0.05 | 0.01 | 0.09 | 0.14 | 0.04 |
| SEQID-03252 | K9I7B3 | — | 1 | 0.47 | 0.18 | 0.09 | 0.05 | 0.05 | 0.01 | 0.03 | 0.04 | 0.04 | 0.03 | 0.04 | 0.08 | 0.08 |
| SEQID-03253 | K9HBS2 | — | 1 | 0.43 | 0.21 | 0.06 | 0.03 | 0.06 | 0.01 | 0.04 | 0.09 | 0.04 | 0.02 | 0.05 | 0.09 | 0.07 |
| SEQID-03254 | K9HB75 | — | 1 | 0.49 | 0.22 | 0.05 | 0.05 | 0.05 | 0.00 | 0.03 | 0.10 | 0.02 | 0.03 | 0.05 | 0.12 | 0.10 |
| SEQID-03255 | K9HWN9 | — | 1 | 0.48 | 0.21 | 0.06 | 0.05 | 0.05 | 0.00 | 0.03 | 0.03 | 0.06 | 0.06 | 0.06 | 0.09 | 0.07 |
| SEQID-03256 | K9HS81 | — | 1 | 0.45 | 0.21 | 0.06 | 0.05 | 0.05 | 0.01 | 0.05 | 0.07 | 0.04 | 0.04 | 0.09 | 0.09 | 0.06 |
| SEQID-03257 | K9HS66 | — | 1 | 0.52 | 0.25 | 0.06 | 0.03 | 0.04 | 0.00 | 0.04 | 0.05 | 0.05 | 0.05 | 0.09 | 0.10 | 0.04 |
| SEQID-03258 | K9HSW9 | — | 1 | 0.44 | 0.19 | 0.07 | 0.04 | 0.04 | 0.01 | 0.04 | 0.09 | 0.05 | 0.05 | 0.06 | 0.09 | 0.05 |
| SEQID-03259 | K9HDE7 | — | 1 | 0.45 | 0.20 | 0.09 | 0.03 | 0.04 | 0.01 | 0.05 | 0.10 | 0.05 | 0.05 | 0.05 | 0.10 | 0.07 |
| SEQID-03260 | K9HXH0 | — | 1 | 0.50 | 0.21 | 0.07 | 0.02 | 0.05 | 0.00 | 0.02 | 0.07 | 0.05 | 0.05 | 0.07 | 0.07 | 0.07 |
| SEQID-03261 | K9HJZ1 | — | 1 | 0.47 | 0.21 | 0.05 | 0.05 | 0.07 | 0.00 | 0.04 | 0.10 | 0.04 | 0.02 | 0.06 | 0.10 | 0.09 |
| SEQID-03262 | K9I493 | — | 1 | 0.53 | 0.23 | 0.04 | 0.05 | 0.05 | 0.01 | 0.04 | 0.04 | 0.04 | 0.04 | 0.07 | 0.10 | 0.05 |
| SEQID-03263 | K9HTT2 | — | 1 | 0.42 | 0.21 | 0.06 | 0.04 | 0.04 | 0.02 | 0.05 | 0.09 | 0.03 | 0.04 | 0.07 | 0.09 | 0.06 |
| SEQID-03264 | K9I887 | — | 1 | 0.45 | 0.22 | 0.06 | 0.04 | 0.06 | 0.00 | 0.04 | 0.07 | 0.05 | 0.04 | 0.07 | 0.09 | 0.05 |
| SEQID-03265 | K9HZD7 | — | 1 | 0.46 | 0.27 | 0.05 | 0.04 | 0.04 | 0.06 | 0.05 | 0.00 | 0.05 | 0.02 | 0.04 | 0.12 | 0.09 |
| SEQID-03266 | K9HS81 | — | 1 | 0.48 | 0.23 | 0.09 | 0.06 | 0.02 | 0.00 | 0.02 | 0.06 | 0.03 | 0.03 | 0.03 | 0.09 | 0.07 |
| SEQID-03267 | K9I1P6 | — | 1 | 0.49 | 0.20 | 0.07 | 0.03 | 0.07 | 0.01 | 0.02 | 0.00 | 0.03 | 0.02 | 0.07 | 0.09 | 0.05 |
| SEQID-03268 | K9I1B16 | — | 1 | 0.49 | 0.22 | 0.06 | 0.04 | 0.02 | 0.00 | 0.05 | 0.03 | 0.03 | 0.03 | 0.06 | 0.10 | 0.05 |
| SEQID-03269 | K9HBH5 | — | 0 | 0.55 | 0.17 | 0.09 | 0.04 | 0.08 | 0.02 | 0.02 | 0.10 | 0.03 | 0.06 | 0.10 | 0.10 | 0.11 |
| SEQID-03270 | K9HG97 | — | 1 | 0.45 | 0.21 | 0.02 | 0.04 | 0.04 | 0.00 | 0.02 | 0.06 | 0.04 | 0.01 | 0.04 | 0.07 | 0.04 |
| SEQID-03271 | K9HJ84 | — | 0 | 0.38 | 0.16 | 0.12 | 0.01 | 0.01 | 0.00 | 0.02 | 0.05 | 0.04 | 0.05 | 0.06 | 0.01 | 0.12 |
| SEQID-03272 | K9HNE7 | — | 1 | 0.41 | 0.23 | 0.17 | 0.06 | 0.03 | 0.01 | 0.05 | 0.05 | 0.08 | 0.05 | 0.04 | 0.12 | 0.13 |
| SEQID-03273 | K9HE11 | — | 0 | 0.48 | 0.18 | 0.09 | 0.02 | 0.06 | 0.02 | 0.08 | 0.00 | 0.03 | 0.02 | 0.03 | 0.09 | 0.11 |
| SEQID-03274 | K9HHP1 | — | 1 | 0.42 | 0.21 | 0.04 | 0.04 | 0.04 | 0.06 | 0.02 | 0.07 | 0.03 | 0.03 | 0.07 | 0.05 | 0.04 |
| SEQID-03275 | K9HLA6 | — | 1 | 0.44 | 0.18 | 0.06 | 0.02 | 0.04 | 0.00 | 0.02 | 0.03 | 0.05 | 0.02 | 0.03 | 0.04 | 0.19 |
| SEQID-03276 | K9HNG3 | — | 1 | 0.55 | 0.27 | 0.09 | 0.04 | 0.09 | 0.00 | 0.04 | 0.10 | 0.03 | 0.04 | 0.06 | 0.08 | 0.05 |
| SEQID-03277 | K9HR78 | — | 1 | 0.48 | 0.21 | 0.02 | 0.04 | 0.04 | 0.00 | 0.04 | 0.06 | 0.03 | 0.06 | 0.07 | 0.12 | 0.11 |
| SEQID-03278 | K9HT12 | — | 0 | 0.46 | 0.13 | 0.12 | 0.01 | 0.01 | 0.00 | 0.05 | 0.00 | 0.04 | 0.01 | 0.04 | 0.08 | 0.17 |
| SEQID-03279 | K9HZV3 | — | 1 | 0.41 | 0.20 | 0.17 | 0.03 | 0.03 | 0.00 | 0.02 | 0.05 | 0.04 | 0.00 | 0.05 | 0.04 | 0.17 |
| SEQID-03280 | K9IGL3 | — | 0 | 0.40 | 0.17 | 0.03 | 0.04 | 0.04 | 0.01 | 0.02 | 0.05 | 0.05 | 0.00 | 0.05 | 0.09 | 0.06 |
| SEQID-03281 | K9HK30 | — | 1 | 0.50 | 0.16 | 0.12 | 0.04 | 0.04 | 0.00 | 0.02 | 0.03 | 0.03 | 0.02 | 0.07 | 0.09 | 0.09 |
| | K9GL3 | — | 0 | 0.48 | 0.19 | 0.02 | 0.02 | 0.09 | 0.01 | 0.03 | 0.10 | 0.03 | 0.02 | 0.04 | 0.09 | 0.05 |
| | K9H6B7 | — | 1 | 0.41 | 0.19 | 0.12 | 0.05 | 0.06 | 0.01 | 0.04 | 0.04 | 0.03 | 0.01 | 0.06 | 0.12 | 0.04 |

TABLE 1-continued

| | | | | | | | | | | | | | | |
|---|---|---|---|---|---|---|---|---|---|---|---|---|---|---|
| SEQID-03282 | K9HB81 | — | — | 0 | 0.48 | 0.23 | 0.05 | 0.09 | 0.03 | 0.04 | 0.01 | 0.06 | 0.07 | 0.02 | 0.01 | 0.05 | 0.12 | 0.09 |
| SEQID-03283 | K9I5V8 | — | — | 1 | 0.44 | 0.23 | 0.05 | 0.11 | 0.04 | 0.09 | 0.01 | 0.05 | 0.04 | 0.03 | 0.04 | 0.07 | 0.07 | 0.05 |
| SEQID-03284 | K9I6Q8 | — | — | 1 | 0.46 | 0.22 | 0.06 | 0.07 | 0.05 | 0.06 | 0.01 | 0.04 | 0.07 | 0.05 | 0.02 | 0.07 | 0.08 | 0.08 |
| SEQID-03285 | K9HEZ0 | — | — | 1 | 0.47 | 0.23 | 0.03 | 0.05 | 0.03 | 0.05 | 0.01 | 0.04 | 0.07 | 0.04 | 0.03 | 0.09 | 0.10 | 0.06 |
| SEQID-03286 | K9HAI6 | — | — | 1 | 0.50 | 0.21 | 0.09 | 0.04 | 0.07 | 0.04 | 0.00 | 0.04 | 0.07 | 0.03 | 0.06 | 0.09 | 0.06 | 0.09 |
| SEQID-03287 | K9HQU8 | — | — | 1 | 0.44 | 0.20 | 0.06 | 0.07 | 0.04 | 0.06 | 0.02 | 0.04 | 0.06 | 0.06 | 0.03 | 0.05 | 0.09 | 0.04 |
| SEQID-03288 | K9HRI1 | — | — | 1 | 0.53 | 0.20 | 0.03 | 0.02 | 0.04 | 0.07 | 0.00 | 0.04 | 0.09 | 0.02 | 0.06 | 0.08 | 0.06 | 0.10 |
| SEQID-03289 | K9HWB2 | — | — | 1 | 0.46 | 0.25 | 0.08 | 0.06 | 0.04 | 0.04 | 0.01 | 0.05 | 0.08 | 0.04 | 0.01 | 0.04 | 0.09 | 0.07 |
| SEQID-03290 | K9I4L8 | — | — | 1 | 0.41 | 0.15 | 0.04 | 0.06 | 0.03 | 0.09 | 0.02 | 0.07 | 0.03 | 0.06 | 0.02 | 0.04 | 0.06 | 0.04 |
| SEQID-03291 | K9IAZ9 | — | — | 1 | 0.48 | 0.22 | 0.06 | 0.07 | 0.02 | 0.06 | 0.00 | 0.03 | 0.12 | 0.03 | 0.04 | 0.06 | 0.07 | 0.06 |
| SEQID-03292 | K9HC09 | — | — | 1 | 0.49 | 0.20 | 0.05 | 0.08 | 0.05 | 0.05 | 0.01 | 0.03 | 0.06 | 0.05 | 0.02 | 0.05 | 0.09 | 0.06 |
| SEQID-03293 | K9KG89 | — | — | 0 | 0.50 | 0.23 | 0.06 | 0.06 | 0.05 | 0.06 | 0.02 | 0.04 | 0.03 | 0.03 | 0.01 | 0.07 | 0.07 | 0.06 |
| SEQID-03294 | K9HYS1 | — | — | 1 | 0.54 | 0.22 | 0.07 | 0.07 | 0.03 | 0.04 | 0.00 | 0.05 | 0.01 | 0.04 | 0.02 | 0.06 | 0.11 | 0.10 |
| SEQID-03295 | K9H7W0 | — | — | 1 | 0.45 | 0.19 | 0.05 | 0.03 | 0.03 | 0.02 | 0.01 | 0.06 | 0.07 | 0.04 | 0.03 | 0.07 | 0.09 | 0.05 |
| SEQID-03296 | K9HZB7 | — | — | 1 | 0.44 | 0.25 | 0.08 | 0.08 | 0.05 | 0.05 | 0.00 | 0.07 | 0.08 | 0.03 | 0.01 | 0.08 | 0.09 | 0.06 |
| SEQID-03297 | K9I599 | — | — | 1 | 0.62 | 0.29 | 0.07 | 0.09 | 0.02 | 0.06 | 0.01 | 0.07 | 0.02 | 0.05 | 0.01 | 0.11 | 0.09 | 0.06 |
| SEQID-03298 | K9HF28 | — | — | 1 | 0.44 | 0.25 | 0.06 | 0.11 | 0.04 | 0.05 | 0.03 | 0.06 | 0.07 | 0.04 | 0.03 | 0.06 | 0.12 | 0.06 |
| SEQID-03299 | K9HS24 | — | — | 0 | 0.47 | 0.25 | 0.05 | 0.06 | 0.06 | 0.06 | 0.01 | 0.02 | 0.07 | 0.05 | 0.01 | 0.08 | 0.12 | 0.07 |
| SEQID-03300 | K9HV19 | — | — | 1 | 0.54 | 0.25 | 0.07 | 0.04 | 0.03 | 0.03 | 0.00 | 0.02 | 0.08 | 0.05 | 0.01 | 0.09 | 0.10 | 0.10 |
| SEQID-03301 | K9I0Z6 | — | — | 1 | 0.45 | 0.22 | 0.07 | 0.08 | 0.05 | 0.04 | 0.01 | 0.03 | 0.07 | 0.05 | 0.01 | 0.07 | 0.09 | 0.06 |
| SEQID-03302 | K9HG59 | — | — | 1 | 0.47 | 0.23 | 0.07 | 0.05 | 0.02 | 0.05 | 0.03 | 0.04 | 0.07 | 0.04 | 0.05 | 0.08 | 0.08 | 0.07 |
| SEQID-03303 | K9HA97 | — | — | 1 | 0.52 | 0.30 | 0.07 | 0.06 | 0.04 | 0.03 | 0.01 | 0.02 | 0.07 | 0.05 | 0.03 | 0.08 | 0.07 | 0.07 |
| SEQID-03304 | K9HJX8 | — | — | 1 | 0.47 | 0.25 | 0.06 | 0.07 | 0.03 | 0.02 | 0.02 | 0.04 | 0.07 | 0.05 | 0.05 | 0.06 | 0.16 | 0.06 |
| SEQID-03305 | K9HL00 | — | — | 1 | 0.50 | 0.23 | 0.05 | 0.08 | 0.03 | 0.07 | 0.01 | 0.05 | 0.07 | 0.05 | 0.05 | 0.06 | 0.10 | 0.07 |
| SEQID-03306 | K9I4Y2 | — | — | 0 | 0.46 | 0.24 | 0.08 | 0.06 | 0.04 | 0.06 | 0.01 | 0.05 | 0.06 | 0.04 | 0.05 | 0.07 | 0.08 | 0.07 |
| SEQID-03307 | K9I6P1 | — | — | 1 | 0.47 | 0.19 | 0.07 | 0.05 | 0.03 | 0.06 | 0.01 | 0.04 | 0.04 | 0.05 | 0.02 | 0.08 | 0.06 | 0.08 |
| SEQID-03308 | K9HYS9 | — | — | 1 | 0.46 | 0.21 | 0.05 | 0.05 | 0.04 | 0.05 | 0.01 | 0.03 | 0.07 | 0.03 | 0.02 | 0.04 | 0.11 | 0.04 |
| SEQID-03309 | K9HZC3 | — | — | 1 | 0.47 | 0.20 | 0.03 | 0.10 | 0.05 | 0.04 | 0.00 | 0.06 | 0.11 | 0.02 | 0.03 | 0.06 | 0.09 | 0.09 |
| SEQID-03310 | K9I376 | — | — | 1 | 0.46 | 0.21 | 0.05 | 0.07 | 0.03 | 0.05 | 0.01 | 0.04 | 0.05 | 0.04 | 0.04 | 0.06 | 0.09 | 0.09 |
| SEQID-03311 | K9IA06 | — | — | 1 | 0.43 | 0.20 | 0.03 | 0.10 | 0.03 | 0.05 | 0.01 | 0.05 | 0.05 | 0.03 | 0.04 | 0.04 | 0.07 | 0.02 |
| SEQID-03312 | K9HZ98 | — | — | 0 | 0.46 | 0.25 | 0.05 | 0.10 | 0.02 | 0.04 | 0.01 | 0.04 | 0.10 | 0.04 | 0.02 | 0.07 | 0.10 | 0.09 |
| SEQID-03313 | K9I4C4 | — | — | 1 | 0.48 | 0.25 | 0.04 | 0.10 | 0.03 | 0.04 | 0.01 | 0.06 | 0.07 | 0.04 | 0.01 | 0.08 | 0.09 | 0.05 |
| SEQID-03314 | K9I7S4 | — | — | 1 | 0.44 | 0.20 | 0.06 | 0.08 | 0.04 | 0.05 | 0.01 | 0.05 | 0.08 | 0.05 | 0.01 | 0.05 | 0.06 | 0.08 |
| SEQID-03315 | K9I9Q1 | — | — | 1 | 0.52 | 0.25 | 0.06 | 0.04 | 0.05 | 0.06 | 0.00 | 0.06 | 0.08 | 0.03 | 0.02 | 0.06 | 0.11 | 0.12 |
| SEQID-03316 | K9I3E2 | — | — | 1 | 0.50 | 0.18 | 0.04 | 0.05 | 0.04 | 0.04 | 0.01 | 0.03 | 0.08 | 0.04 | 0.05 | 0.04 | 0.09 | 0.08 |
| SEQID-03317 | K9I1BU9 | — | — | 1 | 0.45 | 0.21 | 0.07 | 0.08 | 0.05 | 0.05 | 0.00 | 0.05 | 0.06 | 0.04 | 0.03 | 0.06 | 0.10 | 0.07 |
| SEQID-03318 | K9I7V8 | — | — | 1 | 0.42 | 0.20 | 0.09 | 0.06 | 0.03 | 0.06 | 0.00 | 0.06 | 0.08 | 0.03 | 0.01 | 0.07 | 0.09 | 0.07 |
| SEQID-03319 | K9HS31 | — | — | 1 | 0.47 | 0.19 | 0.04 | 0.09 | 0.03 | 0.06 | 0.00 | 0.04 | 0.07 | 0.03 | 0.03 | 0.07 | 0.07 | 0.05 |
| SEQID-03320 | WHBKS | — | — | 1 | 0.49 | 0.24 | 0.05 | 0.06 | 0.04 | 0.05 | 0.01 | 0.07 | 0.08 | 0.04 | 0.06 | 0.07 | 0.07 | 0.06 |
| SEQID-03321 | K9HSCD | — | — | 1 | 0.47 | 0.22 | 0.04 | 0.10 | 0.02 | 0.04 | 0.00 | 0.05 | 0.08 | 0.04 | 0.05 | 0.05 | 0.11 | 0.07 |
| SEQID-03322 | K9HY69 | — | — | 1 | 0.48 | 0.24 | 0.06 | 0.08 | 0.05 | 0.06 | 0.02 | 0.06 | 0.07 | 0.03 | 0.01 | 0.08 | 0.09 | 0.07 |
| SEQID-03323 | K9I3V1 | — | — | 1 | 0.47 | 0.25 | 0.06 | 0.05 | 0.07 | 0.05 | 0.01 | 0.03 | 0.08 | 0.05 | 0.03 | 0.08 | 0.09 | 0.06 |
| SEQID-03324 | K9I3X6 | — | — | 1 | 0.48 | 0.22 | 0.05 | 0.06 | 0.04 | 0.06 | 0.01 | 0.04 | 0.07 | 0.04 | 0.05 | 0.06 | 0.10 | 0.06 |
| SEQID-03325 | K9H2Q3 | — | — | 1 | 0.44 | 0.21 | 0.07 | 0.07 | 0.03 | 0.07 | 0.00 | 0.04 | 0.08 | 0.03 | 0.04 | 0.06 | 0.09 | 0.07 |
| SEQID-03326 | K9HTU2 | — | — | 1 | 0.47 | 0.23 | 0.08 | 0.08 | 0.05 | 0.04 | 0.00 | 0.04 | 0.08 | 0.03 | 0.04 | 0.07 | 0.09 | 0.07 |
| SEQID-03327 | K9HX91 | — | — | 1 | 0.46 | 0.18 | 0.05 | 0.07 | 0.03 | 0.03 | 0.01 | 0.07 | 0.09 | 0.05 | 0.06 | 0.07 | 0.10 | 0.07 |
| SEQID-03328 | K9HZK9 | — | — | 1 | 0.46 | 0.21 | 0.07 | 0.07 | 0.05 | 0.05 | 0.01 | 0.05 | 0.05 | 0.05 | 0.02 | 0.07 | 0.11 | 0.06 |
| SEQID-03329 | K9I853 | — | — | 1 | 0.34 | 0.17 | 0.04 | 0.04 | 0.07 | 0.07 | 0.02 | 0.06 | 0.04 | 0.03 | 0.03 | 0.05 | 0.08 | 0.02 |
| SEQID-03330 | K9I6R8 | — | — | 1 | 0.48 | 0.19 | 0.05 | 0.07 | 0.04 | 0.04 | 0.01 | 0.03 | 0.04 | 0.05 | 0.00 | 0.04 | 0.09 | 0.06 |
| SEQID-03331 | K3HIF4 | — | — | 1 | 0.46 | 0.20 | 0.06 | 0.04 | 0.04 | 0.04 | 0.01 | 0.04 | 0.06 | 0.04 | 0.04 | 0.05 | 0.10 | 0.05 |
| SEQID-03332 | K9H9TS | — | — | 1 | 0.49 | 0.22 | 0.06 | 0.09 | 0.03 | 0.03 | 0.01 | 0.05 | 0.06 | 0.03 | 0.05 | 0.05 | 0.09 | 0.05 |
| SEQID-03333 | K9HBV6 | — | — | 1 | 0.50 | 0.22 | 0.06 | 0.09 | 0.03 | 0.03 | 0.01 | 0.04 | 0.07 | 0.03 | 0.01 | 0.05 | 0.12 | 0.04 |
| SEQID-03334 | K9HKCS | — | — | 1 | 0.46 | 0.21 | 0.07 | 0.07 | 0.05 | 0.05 | 0.00 | 0.07 | 0.09 | 0.04 | 0.02 | 0.07 | 0.07 | 0.09 |

TABLE 1-continued

| SEQID-03335 | K9HT37 | — | — | 1 | 0.50 | 0.27 | 0.06 | 0.08 | 0.04 | 0.04 | 0.01 | 0.02 | 0.05 | 0.04 | 0.03 | 0.10 | 0.09 | 0.05 |
|---|---|---|---|---|---|---|---|---|---|---|---|---|---|---|---|---|---|---|
| SEQID-03336 | K9HPY2 | — | — | 1 | 0.48 | 0.21 | 0.09 | 0.08 | 0.05 | 0.05 | 0.01 | 0.04 | 0.06 | 0.05 | 0.02 | 0.06 | 0.07 | 0.08 |
| SEQID-03337 | K9HWU9 | — | — | 1 | 0.43 | 0.20 | 0.07 | 0.07 | 0.05 | 0.07 | 0.01 | 0.03 | 0.06 | 0.05 | 0.02 | 0.06 | 0.11 | 0.04 |
| SEQID-03338 | K9HX18 | — | — | 1 | 0.52 | 0.24 | 0.04 | 0.07 | 0.04 | 0.05 | 0.01 | 0.04 | 0.08 | 0.03 | 0.04 | 0.07 | 0.10 | 0.04 |
| SEQID-03339 | K9HZ01 | — | — | 1 | 0.46 | 0.22 | 0.06 | 0.08 | 0.05 | 0.07 | 0.01 | 0.04 | 0.06 | 0.03 | 0.04 | 0.05 | 0.09 | 0.05 |
| SEQID-03340 | K9HPA6 | — | — | 1 | 0.49 | 0.21 | 0.05 | 0.06 | 0.05 | 0.05 | 0.01 | 0.04 | 0.06 | 0.03 | 0.04 | 0.06 | 0.09 | 0.07 |
| SEQID-03341 | K9HCQ7 | — | — | 1 | 0.46 | 0.20 | 0.05 | 0.09 | 0.04 | 0.06 | 0.01 | 0.03 | 0.06 | 0.03 | 0.05 | 0.06 | 0.08 | 0.03 |
| SEQID-03342 | K9IDW4 | — | — | 1 | 0.45 | 0.19 | 0.05 | 0.07 | 0.04 | 0.04 | 0.01 | 0.05 | 0.07 | 0.03 | 0.03 | 0.05 | 0.09 | 0.06 |
| SEQID-03343 | K9HZG6 | — | — | 1 | 0.49 | 0.20 | 0.05 | 0.06 | 0.05 | 0.06 | 0.01 | 0.03 | 0.08 | 0.03 | 0.03 | 0.05 | 0.08 | 0.09 |
| SEQID-03344 | K9IB19 | — | — | 1 | 0.47 | 0.20 | 0.05 | 0.07 | 0.04 | 0.07 | 0.01 | 0.04 | 0.10 | 0.03 | 0.03 | 0.06 | 0.09 | 0.08 |
| SEQID-03345 | K9HZG5 | — | — | 1 | 0.48 | 0.25 | 0.07 | 0.06 | 0.04 | 0.09 | 0.01 | 0.04 | 0.07 | 0.04 | 0.03 | 0.07 | 0.10 | 0.07 |
| SEQID-03346 | K9HB63 | — | — | 1 | 0.49 | 0.22 | 0.08 | 0.05 | 0.04 | 0.05 | 0.01 | 0.04 | 0.02 | 0.04 | 0.04 | 0.05 | 0.10 | 0.05 |
| SEQID-03347 | 77737588 | — | — | 1 | 0.48 | 0.21 | 0.08 | 0.05 | 0.03 | 0.03 | 0.02 | 0.03 | 0.03 | 0.03 | 0.04 | 0.05 | 0.10 | 0.06 |
| SEQID-03348 | 77737572 | — | — | 1 | 0.51 | 0.24 | 0.05 | 0.07 | 0.03 | 0.05 | 0.01 | 0.03 | 0.06 | 0.04 | 0.01 | 0.05 | 0.09 | 0.05 |
| SEQID-03349 | 218319228 | — | — | 1 | 0.47 | 0.21 | 0.05 | 0.06 | 0.04 | 0.05 | 0.02 | 0.03 | 0.07 | 0.04 | 0.01 | 0.07 | 0.10 | 0.08 |
| SEQID-03350 | P48417 | — | — | 1 | 0.47 | 0.21 | 0.05 | 0.06 | 0.04 | 0.06 | 0.01 | 0.03 | 0.07 | 0.03 | 0.03 | 0.07 | 0.09 | 0.06 |
| SEQID-03351 | 57118119 | — | — | 1 | 0.39 | 0.15 | 0.07 | 0.11 | 0.06 | 0.04 | 0.03 | 0.04 | 0.09 | 0.04 | 0.02 | 0.05 | 0.07 | 0.03 |
| SEQID-03352 | 76056895 | — | — | 1 | 0.50 | 0.23 | 0.08 | 0.04 | 0.05 | 0.07 | 0.02 | 0.02 | 0.06 | 0.04 | 0.01 | 0.05 | 0.05 | 0.13 |
| SEQID-03353 | 41411212 | — | — | 1 | 0.47 | 0.18 | 0.04 | 0.10 | 0.05 | 0.05 | 0.00 | 0.01 | 0.14 | 0.05 | 0.01 | 0.06 | 0.06 | 0.10 |
| SEQID-03354 | 296S11511 | — | — | 1 | 0.44 | 0.14 | 0.04 | 0.09 | 0.05 | 0.06 | 0.00 | 0.01 | 0.07 | 0.03 | 0.02 | 0.05 | 0.06 | 0.10 |
| SEQID-03355 | 20502190 | — | — | 1 | 0.33 | 0.15 | 0.04 | 0.10 | 0.01 | 0.03 | 0.04 | 0.26 | 0.05 | 0.06 | 0.01 | 0.05 | 0.05 | 0.03 |
| SEQID-03356 | 20502192 | — | — | 1 | 0.32 | 0.15 | 0.04 | 0.09 | 0.03 | 0.05 | 0.04 | 0.24 | 0.05 | 0.05 | 0.01 | 0.04 | 0.07 | 0.04 |
| SEQID-03357 | 237637012 | — | — | 1 | 0.45 | 0.19 | 0.06 | 0.09 | 0.05 | 0.05 | 0.02 | 0.03 | 0.09 | 0.04 | 0.04 | 0.04 | 0.09 | 0.06 |
| SEQID-03358 | P82381 | — | — | 1 | 0.48 | 0.20 | 0.06 | 0.12 | 0.07 | 0.05 | 0.03 | 0.00 | 0.07 | 0.04 | 0.05 | 0.04 | 0.03 | 0.07 |
| SEQID-03359 | 295416082 | — | — | 1 | 0.47 | 0.23 | 0.04 | 0.22 | 0.02 | 0.03 | 0.00 | 0.07 | 0.04 | 0.07 | 0.02 | 0.07 | 0.08 | 0.11 |
| SEQID-03360 | 257712682 | — | — | 1 | 0.23 | 0.04 | 0.09 | 0.03 | 0.08 | 0.01 | 0.07 | 0.02 | 0.11 | 0.02 | 0.06 | 0.10 | 0.05 | 0.04 |
| SEQID-03361 | 206981241 | — | — | 1 | 0.51 | 0.16 | 0.09 | 0.06 | 0.04 | 0.02 | 0.00 | 0.02 | 0.02 | 0.02 | 0.02 | 0.06 | 0.05 | 0.23 |
| SEQID-03362 | 77737574 | — | — | 1 | 0.47 | 0.25 | 0.03 | 0.05 | 0.03 | 0.07 | 0.00 | 0.10 | 0.10 | 0.07 | 0.03 | 0.05 | 0.11 | 0.03 |
| SEQID-03363 | 257712524 | — | — | 1 | 0.44 | 0.16 | 0.06 | 0.14 | 0.04 | 0.03 | 0.03 | 0.05 | 0.02 | 0.04 | 0.03 | 0.06 | 0.06 | 0.11 |
| SEQID-03364 | 395146536 | — | — | 1 | 0.47 | 0.21 | 0.05 | 0.06 | 0.03 | 0.04 | 0.01 | 0.03 | 0.03 | 0.04 | 0.03 | 0.05 | 0.10 | 0.09 |
| SEQID-03365 | 227304504 | — | — | 1 | 0.54 | 0.22 | 0.04 | 0.11 | 0.05 | 0.08 | 0.01 | 0.02 | 0.04 | 0.04 | 0.04 | 0.07 | 0.10 | 0.13 |
| SEQID-03366 | 77737580 | — | — | 1 | 0.51 | 0.26 | 0.08 | 0.06 | 0.01 | 0.05 | 0.00 | 0.10 | 0.01 | 0.06 | 0.03 | 0.07 | 0.11 | 0.03 |
| SEQID-03367 | 218401648 | — | — | 1 | 0.45 | 0.18 | 0.06 | 0.09 | 0.07 | 0.03 | 0.03 | 0.04 | 0.02 | 0.04 | 0.01 | 0.05 | 0.07 | 0.03 |
| SEQID-03368 | 219922540 | — | — | 1 | 0.45 | 0.24 | 0.09 | 0.06 | 0.06 | 0.04 | 0.01 | 0.09 | 0.06 | 0.05 | 0.02 | 0.08 | 0.10 | 0.06 |
| SEQID-03369 | 395146556 | — | — | 1 | 0.48 | 0.26 | 0.07 | 0.04 | 0.04 | 0.05 | 0.01 | 0.04 | 0.07 | 0.06 | 0.01 | 0.06 | 0.10 | 0.09 |
| SEQID-03370 | 395146543 | — | — | 1 | 0.42 | 0.17 | 0.09 | 0.07 | 0.07 | 0.07 | 0.02 | 0.04 | 0.06 | 0.04 | 0.02 | 0.07 | 0.06 | 0.04 |
| SEQID-03371 | 219725692 | — | — | 1 | 0.56 | 0.24 | 0.08 | 0.05 | 0.02 | 0.08 | 0.00 | 0.06 | 0.09 | 0.05 | 0.03 | 0.07 | 0.09 | 0.07 |
| SEQID-03372 | 290760343 | — | — | 1 | 0.43 | 0.23 | 0.06 | 0.06 | 0.03 | 0.03 | 0.00 | 0.03 | 0.07 | 0.03 | 0.03 | 0.05 | 0.14 | 0.15 |
| SEQID-03373 | 257672199 | — | — | 0 | 0.48 | 0.25 | 0.03 | 0.07 | 0.05 | 0.03 | 0.02 | 0.06 | 0.10 | 0.06 | 0.04 | 0.08 | 0.10 | 0.08 |
| SEQID-03374 | 77737576 | — | — | 0 | 0.49 | 0.25 | 0.05 | 0.05 | 0.01 | 0.01 | 0.02 | 0.10 | 0.09 | 0.07 | 0.01 | 0.06 | 0.09 | 0.07 |
| SEQID-03375 | 21B339750 | — | — | 1 | 0.47 | 0.21 | 0.05 | 0.08 | 0.05 | 0.02 | 0.01 | 0.04 | 0.08 | 0.07 | 0.03 | 0.06 | 0.11 | 0.13 |
| SEQID-03376 | 168304 | — | — | 0 | 0.45 | 0.18 | 0.09 | 0.17 | 0.01 | 0.07 | 0.02 | 0.07 | 0.02 | 0.07 | 0.03 | 0.05 | 0.11 | 0.02 |
| SEQID-03377 | 295204445 | — | — | 1 | 0.54 | 0.27 | 0.02 | 0.07 | 0.08 | 0.03 | 0.01 | 0.03 | 0.06 | 0.07 | 0.02 | 0.08 | 0.12 | 0.04 |
| SEQID-03378 | 219789721 | — | — | 1 | 0.48 | 0.25 | 0.02 | 0.04 | 0.06 | 0.05 | 0.02 | 0.04 | 0.04 | 0.04 | 0.01 | 0.06 | 0.06 | 0.08 |
| SEQID-03379 | 295416104 | — | — | 0 | 0.46 | 0.24 | 0.06 | 0.07 | 0.03 | 0.07 | 0.00 | 0.03 | 0.03 | 0.05 | 0.02 | 0.07 | 0.09 | 0.07 |
| SEQID-03380 | 213573202 | — | — | 0 | 0.48 | 0.23 | 0.06 | 0.06 | 0.06 | 0.08 | 0.00 | 0.04 | 0.08 | 0.03 | 0.03 | 0.07 | 0.10 | 0.06 |
| SEQID-03381 | 291048676 | — | — | 1 | 0.49 | 0.25 | 0.03 | 0.05 | 0.06 | 0.03 | 0.00 | 0.04 | 0.09 | 0.06 | 0.04 | 0.08 | 0.09 | 0.08 |
| SEQID-03382 | 395146546 | — | — | 1 | 0.47 | 0.21 | 0.05 | 0.08 | 0.05 | 0.07 | 0.02 | 0.05 | 0.10 | 0.04 | 0.01 | 0.06 | 0.09 | 0.07 |
| SEQID-03383 | M0ZKT2 | — | — | 1 | 0.45 | 0.18 | 0.09 | 0.17 | 0.01 | 0.07 | 0.01 | 0.04 | 0.09 | 0.03 | 0.04 | 0.05 | 0.08 | 0.07 |
| SEQID-03384 | M1AM20 | — | — | 1 | 0.54 | 0.27 | 0.02 | 0.04 | 0.08 | 0.03 | 0.01 | 0.07 | 0.08 | 0.03 | 0.02 | 0.05 | 0.08 | 0.12 |
| SEQID-03385 | MWMY4 | — | — | 1 | 0.52 | 0.27 | 0.02 | 0.04 | 0.06 | 0.07 | 0.02 | 0.03 | 0.06 | 0.07 | 0.02 | 0.07 | 0.11 | 0.09 |
| SEQID-03386 | M0ZXL4 | — | — | 0 | 0.51 | 0.26 | 0.02 | 0.07 | 0.03 | 0.08 | 0.00 | 0.04 | 0.04 | 0.03 | 0.02 | 0.07 | 0.10 | 0.08 |
| SEQID-03387 | M1AMV9 | — | — | 0 | 0.57 | 0.22 | 0.01 | 0.05 | 0.05 | 0.08 | 0.02 | 0.09 | 0.04 | 0.05 | 0.03 | 0.09 | 0.12 | 0.10 |
| | M1AKE5 | — | — | 0 | 0.47 | 0.27 | 0.02 | 0.05 | 0.08 | 0.05 | 0.04 | 0.04 | 0.04 | 0.04 | 0.00 | 0.08 | 0.12 | 0.06 |

TABLE 1-continued

| | | | | | | | | | | | | | | |
|---|---|---|---|---|---|---|---|---|---|---|---|---|---|---|
| SEQID-03388 | M1AGXS | — | 1 | 0.47 | 0.20 | 0.06 | 0.06 | 0.04 | 0.06 | 0.00 | 0.05 | 0.07 | 0.04 | 0.02 | 0.05 | 0.10 | 0.07 |
| SEQID-03389 | M1C5FS | — | 1 | 0.48 | 0.21 | 0.05 | 0.02 | 0.07 | 0.06 | 0.01 | 0.03 | 0.09 | 0.04 | 0.03 | 0.07 | 0.08 | 0.06 |
| SEQID-03390 | M18VW6 | — | 1 | 0.48 | 0.22 | 0.04 | 0.05 | 0.06 | 0.06 | 0.00 | 0.04 | 0.08 | 0.03 | 0.02 | 0.06 | 0.11 | 0.07 |
| SEQID-03391 | M02HXS | — | 0 | 0.54 | 0.17 | 0.06 | 0.02 | 0.05 | 0.02 | 0.00 | 0.02 | 0.10 | 0.03 | 0.02 | 0.07 | 0.05 | 0.07 |
| SEQID-03392 | M02HUS | — | 0 | 0.47 | 0.22 | 0.04 | 0.02 | 0.21 | 0.03 | 0.10 | 0.02 | 0.05 | 0.09 | 0.02 | 0.07 | 0.08 | 0.23 |
| SEQID-03393 | J7EQ13 | — | 0 | 0.39 | 0.16 | 0.05 | 0.05 | 0.03 | 0.06 | 0.00 | 0.02 | 0.08 | 0.05 | 0.02 | 0.04 | 0.07 | 0.11 |
| SEQID-03394 | M1S3W0 | — | 1 | 0.48 | 0.20 | 0.06 | 0.03 | 0.10 | 0.04 | 0.00 | 0.05 | 0.07 | 0.02 | 0.03 | 0.04 | 0.11 | 0.09 |
| SEQID-03395 | 09M3H3 | — | 1 | 0.44 | 0.23 | 0.06 | 0.04 | 0.02 | 0.07 | 0.05 | 0.03 | 0.13 | 0.05 | 0.02 | 0.05 | 0.12 | 0.07 |
| SEQID-03396 | QSLK04 | — | 1 | 0.51 | 0.22 | 0.06 | 0.05 | 0.05 | 0.08 | 0.01 | 0.01 | 0.07 | 0.02 | 0.03 | 0.06 | 0.06 | 0.08 |
| SEQID-03397 | M1ACZ6 | — | 1 | 0.53 | 0.24 | 0.06 | 0.03 | 0.06 | 0.06 | 0.00 | 0.03 | 0.11 | 0.05 | 0.02 | 0.07 | 0.08 | 0.10 |
| SEQID-03398 | MQZI18 | — | 1 | 0.45 | 0.20 | 0.05 | 0.04 | 0.05 | 0.05 | 0.01 | 0.04 | 0.10 | 0.02 | 0.03 | 0.07 | 0.07 | 0.11 |
| SEQID-03399 | M1BF10 | — | 0 | 0.45 | 0.19 | 0.07 | 0.05 | 0.06 | 0.08 | 0.00 | 0.04 | 0.10 | 0.04 | 0.01 | 0.00 | 0.14 | 0.16 |
| SEQID-03400 | M1B1VV6 | — | 1 | 0.52 | 0.24 | 0.04 | 0.04 | 0.07 | 0.07 | 0.00 | 0.04 | 0.07 | 0.03 | 0.03 | 0.06 | 0.12 | 0.07 |
| SEQID-03401 | M16QM9 | — | 1 | 0.52 | 0.21 | 0.04 | 0.04 | 0.08 | 0.06 | 0.09 | 0.03 | 0.07 | 0.05 | 0.03 | 0.07 | 0.06 | 0.12 |
| SEQID-03402 | K7WJX9 | — | 0 | 0.44 | 0.10 | 0.06 | 0.06 | 0.16 | 0.06 | 0.01 | 0.00 | 0.10 | 0.03 | 0.03 | 0.01 | 0.06 | 0.03 |
| SEQID-03403 | M1CQ57 | — | 1 | 0.45 | 0.17 | 0.06 | 0.04 | 0.15 | 0.05 | 0.01 | 0.04 | 0.07 | 0.06 | 0.03 | 0.06 | 0.06 | 0.09 |
| SEQID-03404 | M02YD2 | — | 1 | 0.42 | 0.20 | 0.07 | 0.05 | 0.06 | 0.05 | 0.02 | 0.04 | 0.08 | 0.05 | 0.01 | 0.05 | 0.07 | 0.07 |
| SEQID-03405 | M161K7 | — | 0 | 0.39 | 0.22 | 0.08 | 0.06 | 0.11 | 0.02 | 0.00 | 0.04 | 0.06 | 0.08 | 0.02 | 0.05 | 0.11 | 0.10 |
| SEQID-03406 | M1B8F8 | — | 0 | 0.38 | 0.15 | 0.04 | 0.04 | 0.06 | 0.04 | 0.11 | 0.02 | 0.07 | 0.06 | 0.01 | 0.05 | 0.11 | 0.08 |
| SEQID-03407 | M1AW0 | — | 1 | 0.50 | 0.24 | 0.05 | 0.03 | 0.04 | 0.03 | 0.02 | 0.03 | 0.08 | 0.04 | 0.02 | 0.06 | 0.11 | 0.09 |
| SEQID-03408 | M1CVH4 | — | 1 | 0.44 | 0.17 | 0.04 | 0.05 | 0.09 | 0.07 | 0.01 | 0.02 | 0.07 | 0.03 | 0.05 | 0.05 | 0.06 | 0.06 |
| SEQID-03409 | M1CQ02 | — | 1 | 0.49 | 0.22 | 0.06 | 0.04 | 0.06 | 0.06 | 0.01 | 0.03 | 0.08 | 0.03 | 0.02 | 0.06 | 0.09 | 0.08 |
| SEQID-03410 | MWR3 | — | 0 | 0.48 | 0.21 | 0.07 | 0.07 | 0.11 | 0.04 | 0.02 | 0.01 | 0.03 | 0.06 | 0.03 | 0.07 | 0.05 | 0.13 |
| SEQID-03411 | M1AMY3 | — | 1 | 0.51 | 0.26 | 0.03 | 0.03 | 0.02 | 0.10 | 0.02 | 0.02 | 0.06 | 0.03 | 0.02 | 0.07 | 0.11 | 0.07 |
| SEQID-03412 | M0ZI9B | — | 1 | 0.47 | 0.22 | 0.07 | 0.07 | 0.07 | 0.05 | 0.01 | 0.03 | 0.08 | 0.04 | 0.04 | 0.06 | 0.09 | 0.08 |
| SEQID-03413 | MQZSD6 | — | 1 | 0.47 | 0.22 | 0.07 | 0.05 | 0.04 | 0.06 | 0.00 | 0.04 | 0.09 | 0.05 | 0.02 | 0.06 | 0.08 | 0.10 |
| SEQID-03414 | M1D7J7 | — | 1 | 0.44 | 0.24 | 0.06 | 0.05 | 0.06 | 0.04 | 0.03 | 0.06 | 0.09 | 0.04 | 0.04 | 0.06 | 0.18 | 0.04 |
| SEQID-03415 | M0ZS12 | — | 1 | 0.46 | 0.23 | 0.06 | 0.03 | 0.26 | 0.04 | 0.02 | 0.04 | 0.04 | 0.04 | 0.01 | 0.11 | 0.15 | 0.04 |
| SEQID-03416 | A0Z275 | — | 1 | 0.52 | 0.26 | 0.08 | 0.03 | 0.04 | 0.05 | 0.01 | 0.01 | 0.06 | 0.06 | 0.01 | 0.09 | 0.07 | 0.05 |
| SEQID-03417 | A1A073 | — | 1 | 0.58 | 0.21 | 0.05 | 0.08 | 0.10 | 0.02 | 0.00 | 0.02 | 0.05 | 0.03 | 0.08 | 0.13 | 0.10 | 0.12 |
| SEQID-03418 | A1A091 | — | 0 | 0.61 | 0.15 | 0.03 | 0.05 | 0.09 | 0.07 | 0.00 | 0.07 | 0.05 | 0.04 | 0.09 | 0.04 | 0.02 | 0.16 |
| SEQID-03419 | A2WLS0 | — | 0 | 0.45 | 0.26 | 0.03 | 0.03 | 0.13 | 0.04 | 0.02 | 0.03 | 0.09 | 0.03 | 0.02 | 0.08 | 0.08 | 0.08 |
| SEQID-03420 | A2YN17 | — | 0 | 0.37 | 0.09 | 0.04 | 0.04 | 0.00 | 0.07 | 0.16 | 0.03 | 0.12 | 0.07 | 0.04 | 0.02 | 0.00 | 0.16 |
| SEQID-03421 | A1GGCS | — | 0 | 0.36 | 0.17 | 0.05 | 0.01 | 0.14 | 0.06 | 0.02 | 0.05 | 0.11 | 0.08 | 0.04 | 0.01 | 0.10 | 0.06 |
| SEQID-03422 | A4GYV1 | — | 1 | 0.51 | 0.24 | 0.04 | 0.06 | 0.20 | 0.02 | 0.01 | 0.04 | 0.01 | 0.03 | 0.03 | 0.12 | 0.09 | 0.10 |
| SEQID-03423 | A5A779 | — | 1 | 0.58 | 0.21 | 0.07 | 0.10 | 0.10 | 0.10 | 0.00 | 0.00 | 0.04 | 0.08 | 0.08 | 0.10 | 0.09 | 0.12 |
| SEQID-03424 | A5LHGJ | — | 1 | 0.44 | 0.24 | 0.04 | 0.04 | 0.10 | 0.05 | 0.03 | 0.06 | 0.10 | 0.01 | 0.04 | 0.01 | 0.18 | 0.04 |
| SEQID-03425 | A5VI25 | — | 0 | 0.36 | 0.20 | 0.05 | 0.00 | 0.26 | 0.04 | 0.03 | 0.04 | 0.09 | 0.04 | 0.09 | 0.04 | 0.15 | 0.04 |
| SEQID-03426 | A5VIV3 | — | 1 | 0.34 | 0.15 | 0.04 | 0.03 | 0.04 | 0.03 | 0.00 | 0.05 | 0.14 | 0.02 | 0.02 | 0.04 | 0.07 | 0.05 |
| SEQID-03427 | A5Y79S | — | 0 | 0.51 | 0.22 | 0.04 | 0.03 | 0.06 | 0.03 | 0.02 | 0.03 | 0.10 | 0.04 | 0.03 | 0.06 | 0.10 | 0.09 |
| SEQID-03428 | A6QLV3 | — | 0 | 0.37 | 0.15 | 0.04 | 0.05 | 0.07 | 0.00 | 0.10 | 0.01 | 0.10 | 0.04 | 0.05 | 0.03 | 0.08 | 0.09 |
| SEQID-03429 | A6QPV8 | — | 1 | 0.49 | 0.27 | 0.03 | 0.04 | 0.06 | 0.05 | 0.01 | 0.04 | 0.09 | 0.01 | 0.03 | 0.05 | 0.18 | 0.10 |
| SEQID-03430 | A6ZNN4 | — | 1 | 0.50 | 0.15 | 0.06 | 0.03 | 0.04 | 0.03 | 0.27 | 0.02 | 0.08 | 0.08 | 0.04 | 0.04 | 0.05 | 0.18 |
| SEQID-03431 | A62UT6 | — | 0 | 0.36 | 0.04 | 0.00 | 0.00 | 0.00 | 0.02 | 0.00 | 0.02 | 0.12 | 0.05 | 0.05 | 0.02 | 0.02 | 0.18 |
| SEQID-03432 | A7V3J1 | — | 1 | 0.53 | 0.13 | 0.03 | 0.03 | 0.08 | 0.05 | 0.01 | 0.02 | 0.08 | 0.03 | 0.04 | 0.04 | 0.06 | 0.23 |
| SEQID-03433 | A7YWC8 | — | 1 | 0.58 | 0.19 | 0.03 | 0.06 | 0.12 | 0.06 | 0.00 | 0.00 | 0.05 | 0.03 | 0.09 | 0.11 | 0.06 | 0.13 |
| SEQID-03434 | B1A953 | — | 0 | 0.31 | 0.22 | 0.12 | 0.01 | 0.15 | 0.01 | 0.01 | 0.09 | 0.12 | 0.03 | 0.02 | 0.02 | 0.17 | 0.01 |
| SEQID-03435 | B1A969 | — | 0 | 0.43 | 0.21 | 0.04 | 0.04 | 0.27 | 0.05 | 0.01 | 0.04 | 0.01 | 0.03 | 0.03 | 0.11 | 0.08 | 0.07 |
| SEQID-03436 | B2G634 | — | 1 | 0.40 | 0.22 | 0.02 | 0.04 | 0.32 | 0.03 | 0.07 | 0.06 | 0.01 | 0.03 | 0.03 | 0.15 | 0.03 | 0.11 |
| SEQID-03437 | B2G729 | — | 1 | 0.57 | 0.24 | 0.04 | 0.04 | 0.01 | 0.00 | 0.00 | 0.03 | 0.09 | 0.03 | 0.03 | 0.08 | 0.09 | 0.12 |
| SEQID-03438 | 83WC71 | — | 0 | 0.41 | 0.09 | 0.04 | 0.04 | 0.00 | 0.06 | 0.06 | 0.07 | 0.15 | 0.00 | 0.01 | 0.04 | 0.04 | 0.01 |
| SEQID-03439 | B5K212 | — | 1 | 0.37 | 0.17 | 0.05 | 0.05 | 0.05 | 0.08 | 0.06 | 0.05 | 0.08 | 0.02 | 0.04 | 0.02 | 0.09 | 0.03 |
| SEQID-03440 | B5K9P2 | — | 1 | 0.45 | 0.17 | 0.05 | 0.04 | 0.05 | 0.06 | 0.06 | 0.04 | 0.08 | 0.04 | 0.04 | 0.02 | 0.07 | 0.06 |
| | | | 1 | 0.44 | 0.17 | 0.05 | 0.05 | 0.05 | 0.04 | 0.09 | 0.04 | 0.08 | 0.03 | 0.04 | 0.02 | 0.06 | 0.06 |

TABLE 1-continued

| | | | | | | | | | | | | | | |
|---|---|---|---|---|---|---|---|---|---|---|---|---|---|---|
| SEQID-03441 | B7GNC2 | — | 0 | 0.57 | 0.29 | 0.05 | 0.12 | 0.09 | 0.03 | 0.00 | 0.02 | 0.06 | 0.03 | 0.06 | 0.05 | 0.10 | 0.10 |
| SEQID-03442 | B7GND6 | — | 1 | 0.61 | 0.15 | 0.03 | 0.09 | 0.02 | 0.07 | 0.00 | 0.02 | 0.05 | 0.04 | 0.08 | 0.04 | 0.02 | 0.17 |
| SEQID-03443 | B3DW17 | — | 1 | 0.60 | 0.15 | 0.03 | 0.10 | 0.02 | 0.07 | 0.00 | 0.02 | 0.04 | 0.04 | 0.09 | 0.04 | 0.02 | 0.15 |
| SEQID-03444 | E1BLN6 | — | 1 | 0.23 | 0.12 | 0.02 | 0.11 | 0.01 | 0.02 | 0.10 | 0.10 | 0.06 | 0.03 | 0.01 | 0.02 | 0.04 | 0.03 |
| SEQID-03445 | E7Q5T7 | — | 1 | 0.42 | 0.19 | 0.03 | 0.05 | 0.07 | 0.06 | 0.00 | 0.06 | 0.16 | 0.01 | 0.02 | 0.05 | 0.11 | 0.11 |
| SEQID-03446 | F1MUE4 | — | 1 | 0.49 | 0.24 | 0.04 | 0.07 | 0.03 | 0.05 | 0.03 | 0.05 | 0.12 | 0.12 | 0.02 | 0.02 | 0.16 | 0.08 |
| SEQID-03447 | F1MWJ0 | — | 1 | 0.30 | 0.18 | 0.02 | 0.03 | 0.02 | 0.05 | 0.01 | 0.05 | 0.01 | 0.03 | 0.02 | 0.05 | 0.07 | 0.04 |
| SEQID-03448 | F1SGG1 | — | 1 | 0.40 | 0.23 | 0.05 | 0.11 | 0.04 | 0.02 | 0.03 | 0.07 | 0.12 | 0.10 | 0.02 | 0.05 | 0.13 | 0.06 |
| SEQID-03449 | G1NEV4 | — | 1 | 0.38 | 0.19 | 0.05 | 0.10 | 0.04 | 0.06 | 0.00 | 0.05 | 0.09 | 0.12 | 0.01 | 0.04 | 0.10 | 0.06 |
| SEQID-03450 | G3MXL3 | — | 1 | 0.37 | 0.18 | 0.05 | 0.08 | 0.04 | 0.04 | 0.00 | 0.07 | 0.08 | 0.03 | 0.01 | 0.02 | 0.09 | 0.06 |
| SEQID-03451 | I3LR13 | — | 1 | 0.40 | 0.19 | 0.04 | 0.11 | 0.02 | 0.04 | 0.01 | 0.03 | 0.09 | 0.09 | 0.04 | 0.04 | 0.12 | 0.06 |
| SEQID-03452 | O04433 | — | 1 | 0.51 | 0.14 | 0.03 | 0.07 | 0.02 | 0.04 | 0.02 | 0.03 | 0.09 | 0.02 | 0.04 | 0.02 | 0.07 | 0.02 |
| SEQID-03453 | O42395 | — | 1 | 0.32 | 0.09 | 0.04 | 0.12 | 0.01 | 0.02 | 0.12 | 0.03 | 0.09 | 0.06 | 0.06 | 0.04 | 0.03 | 0.32 |
| SEQID-03454 | O62650 | — | 1 | 0.37 | 0.15 | 0.03 | 0.07 | 0.03 | 0.05 | 0.10 | 0.03 | 0.09 | 0.04 | 0.01 | 0.03 | 0.08 | 0.08 |
| SEQID-03455 | P00127 | — | 1 | 0.35 | 0.14 | 0.04 | 0.03 | 0.02 | 0.06 | 0.01 | 0.04 | 0.10 | 0.02 | 0.06 | 0.01 | 0.07 | 0.09 |
| SEQID-03456 | P02313 | — | 0 | 0.34 | 0.03 | 0.12 | 0.10 | 0.05 | 0.15 | 0.00 | 0.06 | 0.27 | 0.06 | 0.01 | 0.00 | 0.07 | 0.07 |
| SEQID-03457 | P02314 | — | 0 | 0.37 | 0.03 | 0.11 | 0.07 | 0.09 | 0.10 | 0.00 | 0.04 | 0.10 | 0.02 | 0.00 | 0.00 | 0.01 | 0.29 |
| SEQID-03458 | P02687 | — | 0 | 0.39 | 0.03 | 0.05 | 0.15 | 0.03 | 0.09 | 0.00 | 0.04 | 0.10 | 0.05 | 0.00 | 0.00 | 0.01 | 0.30 |
| SEQID-03459 | P04101 | — | 0 | 0.10 | 0.10 | 0.02 | 0.60 | 0.00 | 0.06 | 0.16 | 0.00 | 0.01 | 0.08 | 0.07 | 0.02 | 0.06 | 0.00 |
| SEQID-03460 | P05016 | — | 1 | 0.05 | 0.05 | 0.02 | 0.11 | 0.03 | 0.00 | 0.02 | 0.00 | 0.00 | 0.02 | 0.02 | 0.02 | 0.00 | 0.09 |
| SEQID-03461 | P05739 | — | 1 | 0.54 | 0.27 | 0.03 | 0.04 | 0.07 | 0.04 | 0.00 | 0.03 | 0.10 | 0.01 | 0.02 | 0.04 | 0.17 | 0.10 |
| SEQID-03462 | P07107 | — | 1 | 0.53 | 0.23 | 0.05 | 0.08 | 0.04 | 0.03 | 0.00 | 0.04 | 0.09 | 0.02 | 0.01 | 0.01 | 0.11 | 0.17 |
| SEQID-03463 | P07924 | — | 1 | 0.52 | 0.13 | 0.06 | 0.02 | 0.02 | 0.09 | 0.10 | 0.03 | 0.13 | 0.03 | 0.03 | 0.05 | 0.06 | 0.19 |
| SEQID-03464 | P03771 | — | 0 | 0.41 | 0.20 | 0.04 | 0.17 | 0.03 | 0.05 | 0.00 | 0.09 | 0.06 | 0.04 | 0.04 | 0.12 | 0.06 | 0.09 |
| SEQID-03465 | P0C074 | — | 1 | 0.52 | 0.17 | 0.02 | 0.15 | 0.09 | 0.02 | 0.00 | 0.06 | 0.08 | 0.02 | 0.11 | 0.07 | 0.07 | 0.06 |
| SEQID-03466 | P0C0T4 | — | 0 | 0.40 | 0.19 | 0.02 | 0.14 | 0.03 | 0.05 | 0.00 | 0.09 | 0.03 | 0.03 | 0.03 | 0.05 | 0.12 | 0.09 |
| SEQID-03467 | P0C453 | — | 1 | 0.49 | 0.21 | 0.09 | 0.09 | 0.00 | 0.04 | 0.02 | 0.05 | 0.05 | 0.02 | 0.03 | 0.08 | 0.08 | 0.19 |
| SEQID-03468 | P0C5N1 | — | 1 | 0.52 | 0.11 | 0.02 | 0.11 | 0.03 | 0.00 | 0.01 | 0.00 | 0.02 | 0.02 | 0.03 | 0.03 | 0.03 | 0.22 |
| SEQID-03469 | P0C5N3 | — | 1 | 0.62 | 0.25 | 0.02 | 0.21 | 0.03 | 0.03 | 0.16 | 0.00 | 0.00 | 0.03 | 0.15 | 0.10 | 0.12 | 0.04 |
| SEQID-03470 | P10669 | — | 1 | 0.60 | 0.23 | 0.02 | 0.03 | 0.05 | 0.05 | 0.02 | 0.04 | 0.13 | 0.03 | 0.01 | 0.06 | 0.14 | 0.16 |
| SEQID-03471 | P12902 | — | 0 | 0.37 | 0.15 | 0.03 | 0.06 | 0.05 | 0.05 | 0.00 | 0.04 | 0.11 | 0.02 | 0.01 | 0.03 | 0.03 | 0.09 |
| SEQID-03472 | P13204 | — | 1 | 0.36 | 0.01 | 0.12 | 0.06 | 0.04 | 0.07 | 0.10 | 0.04 | 0.18 | 0.04 | 0.01 | 0.01 | 0.01 | 0.29 |
| SEQID-03473 | P14402 | — | 1 | 0.35 | 0.23 | 0.04 | 0.17 | 0.03 | 0.05 | 0.00 | 0.01 | 0.08 | 0.03 | 0.04 | 0.00 | 0.16 | 0.01 |
| SEQID-03474 | P15720 | — | 0 | 0.06 | 0.01 | 0.01 | 0.72 | 0.00 | 0.01 | 0.03 | 0.07 | 0.00 | 0.07 | 0.04 | 0.02 | 0.00 | 0.00 |
| SEQID-03475 | P13114 | — | 1 | 0.41 | 0.10 | 0.04 | 0.16 | 0.04 | 0.04 | 0.00 | 0.00 | 0.02 | 0.02 | 0.00 | 0.02 | 0.04 | 0.03 |
| SEQID-03476 | P19948 | — | 1 | 0.56 | 0.26 | 0.03 | 0.04 | 0.06 | 0.03 | 0.02 | 0.03 | 0.09 | 0.01 | 0.10 | 0.04 | 0.17 | 0.11 |
| SEQID-03477 | P20158 | — | 1 | 0.50 | 0.25 | 0.04 | 0.18 | 0.05 | 0.02 | 0.01 | 0.04 | 0.00 | 0.09 | 0.02 | 0.12 | 0.10 | 0.11 |
| SEQID-03478 | P20159 | — | 0 | 0.28 | 0.06 | 0.03 | 0.18 | 0.07 | 0.03 | 0.16 | 0.04 | 0.04 | 0.00 | 0.07 | 0.04 | 0.00 | 0.11 |
| SEQID-03479 | P23935 | — | 0 | 0.29 | 0.10 | 0.03 | 0.15 | 0.04 | 0.01 | 0.16 | 0.00 | 0.04 | 0.05 | 0.01 | 0.02 | 0.00 | 0.10 |
| SEQID-03480 | P24052 | — | 0 | 0.52 | 0.25 | 0.03 | 0.05 | 0.00 | 0.04 | 0.07 | 0.04 | 0.04 | 0.04 | 0.03 | 0.02 | 0.02 | 0.12 |
| SEQID-03481 | P25362 | — | 1 | 0.49 | 0.14 | 0.04 | 0.04 | 0.07 | 0.06 | 0.01 | 0.02 | 0.12 | 0.03 | 0.01 | 0.07 | 0.13 | 0.20 |
| SEQID-03482 | P27007 | — | 1 | 0.52 | 0.19 | 0.07 | 0.04 | 0.04 | 0.03 | 0.01 | 0.07 | 0.09 | 0.05 | 0.01 | 0.02 | 0.09 | 0.13 |
| SEQID-03483 | P30562 | — | 1 | 0.45 | 0.30 | 0.04 | 0.05 | 0.02 | 0.07 | 0.00 | 0.02 | 0.10 | 0.01 | 0.03 | 0.04 | 0.11 | 0.07 |
| SEQID-03484 | P31162 | — | 1 | 0.60 | 0.21 | 0.07 | 0.10 | 0.03 | 0.05 | 0.10 | 0.03 | 0.11 | 0.00 | 0.01 | 0.03 | 0.10 | 0.23 |
| SEQID-03485 | P31853 | — | 1 | 0.62 | 0.20 | 0.06 | 0.04 | 0.02 | 0.05 | 0.00 | 0.05 | 0.10 | 0.04 | 0.10 | 0.06 | 0.12 | 0.09 |
| SEQID-03486 | P32046 | — | 0 | 0.54 | 0.26 | 0.03 | 0.09 | 0.08 | 0.05 | 0.00 | 0.00 | 0.04 | 0.04 | 0.07 | 0.11 | 0.16 | 0.10 |
| SEQID-03487 | P32344 | — | 1 | 0.57 | 0.16 | 0.06 | 0.03 | 0.03 | 0.02 | 0.00 | 0.00 | 0.10 | 0.01 | 0.01 | 0.06 | 0.03 | 0.14 |
| SEQID-03488 | P32570 | — | 1 | 0.53 | 0.15 | 0.03 | 0.09 | 0.01 | 0.04 | 0.04 | 0.05 | 0.03 | 0.05 | 0.03 | 0.06 | 0.07 | 0.17 |
| SEQID-03489 | P32760 | — | 1 | 0.52 | 0.24 | 0.03 | 0.17 | 0.04 | 0.01 | 0.01 | 0.03 | 0.04 | 0.04 | 0.01 | 0.01 | 0.11 | 0.12 |
| SEQID-03490 | P33309 | — | 1 | 0.50 | 0.09 | 0.04 | 0.05 | 0.05 | 0.06 | 0.00 | 0.04 | 0.12 | 0.00 | 0.01 | 0.01 | 0.05 | 0.20 |
| SEQID-03491 | P36047 | — | 1 | 0.54 | 0.23 | 0.07 | 0.04 | 0.04 | 0.03 | 0.01 | 0.07 | 0.09 | 0.04 | 0.01 | 0.02 | 0.11 | 0.13 |
| SEQID-03492 | P36071 | — | 1 | 0.52 | 0.28 | 0.03 | 0.01 | 0.01 | 0.09 | 0.00 | 0.09 | 0.09 | 0.02 | 0.01 | 0.07 | 0.17 | 0.07 |
| SEQID-03493 | P36493 | — | 1 | 0.63 | 0.23 | 0.01 | 0.03 | 0.03 | 0.07 | 0.00 | 0.03 | 0.10 | 0.01 | 0.02 | 0.08 | 0.05 | 0.24 |
| SEQID-03494 | — | — | 1 | 0.60 | 0.15 | 0.04 | 0.12 | 0.05 | 0.00 | 0.00 | 0.02 | 0.00 | 0.02 | 0.00 | 0.05 | 0.11 | 0.16 |

TABLE 1-continued

| SEQID | ID | | | | | | | | | | | | | |
|---|---|---|---|---|---|---|---|---|---|---|---|---|---|---|
| SEQID-03494 | P36835 | — | 1 | 0.54 | 0.25 | 0.03 | 0.04 | 0.06 | 0.05 | 0.02 | 0.04 | 0.09 | 0.01 | 0.02 | 0.03 | 0.18 | 0.10 |
| SEQID-03495 | P37360 | — | 0 | 0.24 | 0.01 | 0.05 | 0.00 | 0.00 | 0.03 | 0.30 | 0.02 | 0.17 | 0.06 | 0.00 | 0.00 | 0.00 | 0.15 |
| SEQID-03496 | P38202 | — | 1 | 0.51 | 0.13 | 0.04 | 0.11 | 0.02 | 0.07 | 0.00 | 0.05 | 0.09 | 0.02 | 0.03 | 0.03 | 0.07 | 0.23 |
| SEQID-03497 | P38828 | — | 1 | 0.54 | 0.25 | 0.01 | 0.05 | 0.05 | 0.05 | 0.00 | 0.09 | 0.03 | 0.03 | 0.01 | 0.09 | 0.07 | 0.14 |
| SEQID-03498 | P40060 | — | 0 | 0.45 | 0.24 | 0.02 | 0.05 | 0.03 | 0.10 | 0.00 | 0.03 | 0.14 | 0.01 | 0.01 | 0.08 | 0.11 | 0.09 |
| SEQID-03499 | P40062 | — | 0 | 0.58 | 0.24 | 0.02 | 0.01 | 0.04 | 0.03 | 0.02 | 0.00 | 0.04 | 0.01 | 0.04 | 0.05 | 0.15 | 0.13 |
| SEQID-03500 | P40509 | — | 1 | 0.43 | 0.24 | 0.04 | 0.01 | 0.03 | 0.07 | 0.01 | 0.07 | 0.10 | 0.02 | 0.02 | 0.05 | 0.15 | 0.08 |
| SEQID-03501 | P40619 | — | 1 | 0.41 | 0.07 | 0.03 | 0.04 | 0.05 | 0.11 | 0.00 | 0.05 | 0.11 | 0.03 | 0.01 | 0.01 | 0.03 | 0.23 |
| SEQID-03502 | P40620 | — | 1 | 0.40 | 0.08 | 0.06 | 0.03 | 0.04 | 0.10 | 0.00 | 0.02 | 0.18 | 0.04 | 0.01 | 0.07 | 0.03 | 0.23 |
| SEQID-03503 | P41648 | — | 1 | 0.47 | 0.28 | 0.00 | 0.15 | 0.03 | 0.06 | 0.00 | 0.09 | 0.01 | 0.03 | 0.03 | 0.05 | 0.18 | 0.09 |
| SEQID-03504 | P43389 | — | 0 | 0.35 | 0.14 | 0.03 | 0.00 | 0.05 | 0.12 | 0.16 | 0.02 | 0.06 | 0.05 | 0.00 | 0.05 | 0.00 | 0.12 |
| SEQID-03505 | P46963 | — | 1 | 0.50 | 0.19 | 0.02 | 0.06 | 0.05 | 0.09 | 0.01 | 0.05 | 0.06 | 0.00 | 0.04 | 0.05 | 0.11 | 0.09 |
| SEQID-03506 | P46988 | — | 1 | 0.51 | 0.22 | 0.03 | 0.06 | 0.05 | 0.06 | 0.01 | 0.03 | 0.09 | 0.00 | 0.01 | 0.04 | 0.13 | 0.14 |
| SEQID-03507 | P47005 | — | 1 | 0.50 | 0.24 | 0.02 | 0.05 | 0.09 | 0.07 | 0.01 | 0.04 | 0.06 | 0.00 | 0.03 | 0.09 | 0.12 | 0.09 |
| SEQID-03508 | P47815 | — | 1 | 0.41 | 0.19 | 0.03 | 0.10 | 0.04 | 0.13 | 0.01 | 0.03 | 0.10 | 0.03 | 0.02 | 0.06 | 0.07 | 0.13 |
| SEQID-03509 | P50291 | — | 1 | 0.37 | 0.15 | 0.04 | 0.07 | 0.05 | 0.05 | 0.02 | 0.03 | 0.10 | 0.03 | 0.00 | 0.06 | 0.03 | 0.09 |
| SEQID-03510 | P53079 | — | 1 | 0.51 | 0.25 | 0.01 | 0.04 | 0.02 | 0.09 | 0.00 | 0.07 | 0.05 | 0.00 | 0.03 | 0.05 | 0.15 | 0.07 |
| SEQID-03511 | P53335 | — | 1 | 0.53 | 0.13 | 0.03 | 0.08 | 0.03 | 0.10 | 0.01 | 0.02 | 0.08 | 0.03 | 0.04 | 0.06 | 0.07 | 0.23 |
| SEQID-03512 | P53910 | — | 0 | 0.61 | 0.26 | 0.03 | 0.10 | 0.03 | 0.02 | 0.02 | 0.04 | 0.05 | 0.04 | 0.00 | 0.04 | 0.09 | 0.14 |
| SEQID-03513 | P53970 | — | 1 | 0.54 | 0.26 | 0.03 | 0.10 | 0.01 | 0.06 | 0.00 | 0.03 | 0.10 | 0.06 | 0.06 | 0.10 | 0.15 | 0.30 |
| SEQID-03514 | P55944 | — | 0 | 0.24 | 0.01 | 0.05 | 0.00 | 0.01 | 0.03 | 0.30 | 0.02 | 0.17 | 0.06 | 0.00 | 0.05 | 0.00 | 0.09 |
| SEQID-03515 | P60577 | — | 1 | 0.58 | 0.18 | 0.03 | 0.10 | 0.05 | 0.01 | 0.00 | 0.00 | 0.09 | 0.02 | 0.08 | 0.03 | 0.04 | 0.09 |
| SEQID-03516 | P60750 | — | 1 | 0.53 | 0.17 | 0.06 | 0.01 | 0.03 | 0.07 | 0.00 | 0.09 | 0.05 | 0.03 | 0.00 | 0.05 | 0.07 | 0.10 |
| SEQID-03517 | P61848 | — | 0 | 0.60 | 0.14 | 0.02 | 0.10 | 0.04 | 0.07 | 0.00 | 0.09 | 0.00 | 0.03 | 0.01 | 0.05 | 0.05 | 0.07 |
| SEQID-03518 | P63080 | — | 1 | 0.58 | 0.21 | 0.06 | 0.04 | 0.02 | 0.05 | 0.00 | 0.02 | 0.10 | 0.04 | 0.06 | 0.06 | 0.12 | 0.08 |
| SEQID-03519 | P71479 | — | 1 | 0.49 | 0.29 | 0.06 | 0.11 | 0.03 | 0.10 | 0.00 | 0.04 | 0.07 | 0.04 | 0.05 | 0.05 | 0.11 | 0.13 |
| SEQID-03520 | P80272 | — | 0 | 0.36 | 0.03 | 0.12 | 0.07 | 0.06 | 0.13 | 0.00 | 0.04 | 0.09 | 0.06 | 0.09 | 0.09 | 0.01 | 0.07 |
| SEQID-03521 | P81558 | — | 0 | 0.46 | 0.21 | 0.09 | 0.10 | 0.01 | 0.02 | 0.00 | 0.04 | 0.12 | 0.03 | 0.00 | 0.02 | 0.05 | 0.09 |
| SEQID-03522 | P82010 | — | 0 | 0.38 | 0.09 | 0.06 | 0.15 | 0.01 | 0.06 | 0.01 | 0.03 | 0.01 | 0.03 | 0.03 | 0.00 | 0.06 | 0.09 |
| SEQID-03523 | P82920 | — | 0 | 0.33 | 0.04 | 0.04 | 0.09 | 0.07 | 0.04 | 0.16 | 0.05 | 0.05 | 0.02 | 0.07 | 0.00 | 0.02 | 0.10 |
| SEQID-03524 | P83487 | — | 1 | 0.39 | 0.14 | 0.03 | 0.22 | 0.05 | 0.03 | 0.03 | 0.01 | 0.09 | 0.01 | 0.01 | 0.06 | 0.05 | 0.07 |
| SEQID-03525 | P84997 | — | 1 | 0.39 | 0.11 | 0.04 | 0.17 | 0.01 | 0.06 | 0.00 | 0.05 | 0.01 | 0.07 | 0.07 | 0.02 | 0.05 | 0.08 |
| SEQID-03526 | Q02368 | — | 1 | 0.59 | 0.20 | 0.07 | 0.02 | 0.03 | 0.05 | 0.00 | 0.03 | 0.11 | 0.04 | 0.10 | 0.04 | 0.11 | 0.13 |
| SEQID-03527 | Q034H8 | — | 1 | 0.37 | 0.13 | 0.05 | 0.16 | 0.01 | 0.07 | 0.03 | 0.05 | 0.11 | 0.02 | 0.04 | 0.01 | 0.09 | 0.07 |
| SEQID-03528 | Q034Z7 | — | 1 | 0.53 | 0.28 | 0.05 | 0.06 | 0.01 | 0.08 | 0.00 | 0.05 | 0.09 | 0.05 | 0.05 | 0.08 | 0.13 | 0.09 |
| SEQID-03529 | Q03525 | — | 1 | 0.49 | 0.28 | 0.04 | 0.11 | 0.05 | 0.07 | 0.00 | 0.01 | 0.07 | 0.04 | 0.01 | 0.11 | 0.09 | 0.11 |
| SEQID-03530 | Q03810 | — | 1 | 0.50 | 0.11 | 0.03 | 0.03 | 0.04 | 0.19 | 0.00 | 0.05 | 0.09 | 0.01 | 0.03 | 0.05 | 0.05 | 0.27 |
| SEQID-03531 | Q03919 | — | 0 | 0.56 | 0.20 | 0.05 | 0.18 | 0.05 | 0.06 | 0.00 | 0.00 | 0.00 | 0.06 | 0.06 | 0.10 | 0.08 | 0.15 |
| SEQID-03532 | Q03AJ7 | — | 1 | 0.58 | 0.31 | 0.01 | 0.04 | 0.01 | 0.07 | 0.00 | 0.02 | 0.07 | 0.05 | 0.05 | 0.06 | 0.16 | 0.12 |
| SEQID-03533 | Q03AZ8 | — | 1 | 0.46 | 0.20 | 0.05 | 0.14 | 0.07 | 0.20 | 0.00 | 0.07 | 0.12 | 0.04 | 0.08 | 0.04 | 0.11 | 0.13 |
| SEQID-03534 | Q042Y3 | — | 1 | 0.37 | 0.17 | 0.04 | 0.00 | 0.06 | 0.05 | 0.01 | 0.04 | 0.14 | 0.03 | 0.04 | 0.04 | 0.11 | 0.03 |
| SEQID-03535 | Q043Y8 | — | 1 | 0.54 | 0.28 | 0.03 | 0.06 | 0.04 | 0.17 | 0.00 | 0.05 | 0.03 | 0.02 | 0.01 | 0.04 | 0.09 | 0.12 |
| SEQID-03536 | Q045P3 | — | 0 | 0.52 | 0.29 | 0.04 | 0.04 | 0.03 | 0.08 | 0.01 | 0.04 | 0.07 | 0.03 | 0.02 | 0.09 | 0.14 | 0.11 |
| SEQID-03537 | Q046A4 | — | 1 | 0.37 | 0.19 | 0.04 | 0.03 | 0.06 | 0.06 | 0.00 | 0.07 | 0.11 | 0.03 | 0.02 | 0.07 | 0.14 | 0.02 |
| SEQID-03538 | Q04869 | — | 0 | 0.54 | 0.27 | 0.03 | 0.09 | 0.03 | 0.19 | 0.00 | 0.05 | 0.00 | 0.02 | 0.01 | 0.04 | 0.09 | 0.09 |
| SEQID-03539 | Q048Z6 | — | 1 | 0.51 | 0.23 | 0.05 | 0.03 | 0.05 | 0.06 | 0.01 | 0.02 | 0.09 | 0.03 | 0.06 | 0.10 | 0.05 | 0.11 |
| SEQID-03540 | Q04935 | — | 1 | 0.37 | 0.19 | 0.05 | 0.03 | 0.03 | 0.07 | 0.00 | 0.07 | 0.07 | 0.04 | 0.05 | 0.06 | 0.08 | 0.12 |
| SEQID-03541 | Q049N0 | — | 1 | 0.47 | 0.14 | 0.04 | 0.03 | 0.04 | 0.20 | 0.00 | 0.04 | 0.15 | 0.04 | 0.08 | 0.04 | 0.16 | 0.13 |
| SEQID-03542 | Q04C52 | — | 1 | 0.49 | 0.29 | 0.04 | 0.05 | 0.03 | 0.09 | 0.01 | 0.11 | 0.06 | 0.04 | 0.04 | 0.04 | 0.11 | 0.01 |
| SEQID-03543 | Q05462 | — | 1 | 0.34 | 0.14 | 0.06 | 0.06 | 0.04 | 0.25 | 0.01 | 0.03 | 0.08 | 0.02 | 0.04 | 0.09 | 0.14 | 0.11 |
| SEQID-03544 | Q05566 | — | 1 | 0.62 | 0.21 | 0.03 | 0.07 | 0.02 | 0.06 | 0.00 | 0.02 | 0.14 | 0.04 | 0.03 | 0.04 | 0.06 | 0.10 |
| SEQID-03545 | Q06071 | — | 1 | 0.50 | 0.09 | 0.03 | 0.11 | 0.05 | 0.00 | 0.01 | 0.06 | 0.03 | 0.02 | 0.02 | 0.03 | 0.09 | 0.04 |
| SEQID-03546 | Q06071 | — | 1 | 0.49 | 0.23 | 0.01 | 0.03 | 0.09 | 0.05 | 0.01 | 0.04 | 0.10 | 0.00 | 0.03 | 0.07 | 0.12 | 0.10 |

TABLE 1-continued

| | | | | | | | | | | | | | | | |
|---|---|---|---|---|---|---|---|---|---|---|---|---|---|---|---|
| SEQID-03547 | Q06162 | — | 1 | 0.43 | 0.26 | 0.03 | 0.07 | 0.04 | 0.05 | 0.00 | 0.12 | 0.11 | 0.01 | 0.02 | 0.07 | 0.18 | 0.03 |
| SEQID-03548 | Q06835 | — | 1 | 0.44 | 0.19 | 0.01 | 0.10 | 0.07 | 0.07 | 0.11 | 0.04 | 0.04 | 0.04 | 0.05 | 0.05 | 0.08 | 0.14 |
| SEQID-03549 | Q06831 | — | 1 | 0.44 | 0.26 | 0.02 | 0.12 | 0.03 | 0.08 | 0.03 | 0.06 | 0.06 | 0.00 | 0.01 | 0.07 | 0.15 | 0.04 |
| SEQID-03550 | Q03273 | — | 1 | 0.44 | 0.14 | 0.06 | 0.07 | 0.07 | 0.08 | 0.07 | 0.06 | 0.07 | 0.04 | 0.04 | 0.06 | 0.02 | 0.07 |
| SEQID-03551 | Q03423 | — | 0 | 0.48 | 0.16 | 0.01 | 0.36 | 0.01 | 0.01 | 0.00 | 0.02 | 0.00 | 0.09 | 0.24 | 0.01 | 0.13 | 0.03 |
| SEQID-03552 | Q09MB5 | — | 0 | 0.56 | 0.25 | 0.00 | 0.06 | 0.06 | 0.02 | 0.01 | 0.05 | 0.12 | 0.02 | 0.05 | 0.04 | 0.21 | 0.07 |
| SEQID-03553 | Q09ME2 | — | 1 | 0.47 | 0.27 | 0.03 | 0.20 | 0.07 | 0.04 | 0.00 | 0.00 | 0.06 | 0.01 | 0.01 | 0.14 | 0.09 | 0.07 |
| SEQID-03554 | Q09MF5 | — | 1 | 0.43 | 0.24 | 0.04 | 0.25 | 0.02 | 0.02 | 0.01 | 0.04 | 0.01 | 0.02 | 0.02 | 0.11 | 0.09 | 0.06 |
| SEQID-03555 | Q0II65 | — | 1 | 0.50 | 0.13 | 0.04 | 0.12 | 0.05 | 0.03 | 0.09 | 0.02 | 0.20 | 0.04 | 0.02 | 0.02 | 0.07 | 0.11 |
| SEQID-03556 | Q0P5B3 | — | 1 | 0.44 | 0.18 | 0.04 | 0.08 | 0.05 | 0.09 | 0.09 | 0.06 | 0.04 | 0.04 | 0.02 | 0.03 | 0.11 | 0.09 |
| SEQID-03557 | Q0VCD4 | — | 1 | 0.50 | 0.23 | 0.04 | 0.10 | 0.04 | 0.06 | 0.01 | 0.03 | 0.03 | 0.03 | 0.05 | 0.04 | 0.12 | 0.04 |
| SEQID-03558 | Q0VD26 | — | 1 | 0.44 | 0.14 | 0.03 | 0.11 | 0.06 | 0.04 | 0.08 | 0.06 | 0.08 | 0.09 | 0.05 | 0.04 | 0.03 | 0.06 |
| SEQID-03559 | Q12028 | — | 1 | 0.51 | 0.28 | 0.03 | 0.04 | 0.07 | 0.09 | 0.01 | 0.04 | 0.10 | 0.02 | 0.03 | 0.09 | 0.15 | 0.09 |
| SEQID-03560 | Q14FD4 | — | 1 | 0.43 | 0.23 | 0.05 | 0.24 | 0.07 | 0.06 | 0.01 | 0.03 | 0.07 | 0.01 | 0.02 | 0.10 | 0.11 | 0.05 |
| SEQID-03561 | Q17Q91 | — | 1 | 0.37 | 0.12 | 0.03 | 0.13 | 0.07 | 0.03 | 0.04 | 0.03 | 0.01 | 0.02 | 0.01 | 0.06 | 0.06 | 0.09 |
| SEQID-03562 | Q1G940 | — | 0 | 0.46 | 0.24 | 0.06 | 0.04 | 0.04 | 0.06 | 0.03 | 0.03 | 0.02 | 0.05 | 0.02 | 0.10 | 0.10 | 0.09 |
| SEQID-03563 | Q1G9J5 | — | 1 | 0.61 | 0.18 | 0.02 | 0.11 | 0.07 | 0.05 | 0.00 | 0.04 | 0.10 | 0.00 | 0.00 | 0.06 | 0.07 | 0.11 |
| SEQID-03564 | Q1GBQ3 | — | 1 | 0.33 | 0.14 | 0.04 | 0.06 | 0.05 | 0.02 | 0.00 | 0.02 | 0.00 | 0.03 | 0.02 | 0.02 | 0.07 | 0.19 |
| SEQID-03565 | Q2KI95 | — | 1 | 0.40 | 0.12 | 0.03 | 0.11 | 0.02 | 0.06 | 0.00 | 0.03 | 0.14 | 0.02 | 0.03 | 0.04 | 0.06 | 0.04 |
| SEQID-03566 | Q2KIA3 | — | 1 | 0.44 | 0.12 | 0.03 | 0.05 | 0.03 | 0.01 | 0.11 | 0.05 | 0.03 | 0.03 | 0.04 | 0.04 | 0.06 | 0.09 |
| SEQID-03567 | Q2K1T5 | — | 1 | 0.34 | 0.19 | 0.04 | 0.08 | 0.04 | 0.06 | 0.09 | 0.04 | 0.05 | 0.02 | 0.03 | 0.03 | 0.12 | 0.10 |
| SEQID-03568 | Q2L927 | — | 1 | 0.44 | 0.13 | 0.04 | 0.06 | 0.03 | 0.04 | 0.10 | 0.05 | 0.13 | 0.05 | 0.01 | 0.01 | 0.03 | 0.05 |
| SEQID-03569 | Q2M2S7 | — | 1 | 0.57 | 0.23 | 0.04 | 0.26 | 0.05 | 0.02 | 0.01 | 0.04 | 0.01 | 0.02 | 0.03 | 0.11 | 0.09 | 0.09 |
| SEQID-03570 | Q2MI60 | — | 1 | 0.33 | 0.11 | 0.05 | 0.10 | 0.05 | 0.05 | 0.08 | 0.03 | 0.08 | 0.03 | 0.04 | 0.12 | 0.05 | 0.06 |
| SEQID-03571 | Q2MJS5 | — | 1 | 0.59 | 0.21 | 0.04 | 0.09 | 0.07 | 0.03 | 0.00 | 0.06 | 0.05 | 0.03 | 0.07 | 0.13 | 0.08 | 0.12 |
| SEQID-03572 | Q2T9Q2 | — | 0 | 0.24 | 0.01 | 0.05 | 0.00 | 0.00 | 0.05 | 0.28 | 0.00 | 0.00 | 0.05 | 0.00 | 0.01 | 0.00 | 0.15 |
| SEQID-03573 | Q2TBR9 | — | 1 | 0.44 | 0.25 | 0.03 | 0.10 | 0.01 | 0.01 | 0.01 | 0.08 | 0.15 | 0.02 | 0.02 | 0.09 | 0.17 | 0.07 |
| SEQID-03574 | Q2YDK0 | — | 0 | 0.55 | 0.15 | 0.03 | 0.11 | 0.02 | 0.04 | 0.01 | 0.04 | 0.13 | 0.00 | 0.00 | 0.00 | 0.07 | 0.24 |
| SEQID-03575 | Q32L75 | — | 1 | 0.44 | 0.12 | 0.04 | 0.05 | 0.03 | 0.06 | 0.11 | 0.06 | 0.07 | 0.03 | 0.04 | 0.04 | 0.05 | 0.11 |
| SEQID-03576 | Q32PJ6 | — | 1 | 0.50 | 0.17 | 0.02 | 0.10 | 0.04 | 0.04 | 0.00 | 0.02 | 0.02 | 0.05 | 0.05 | 0.02 | 0.12 | 0.08 |
| SEQID-03577 | Q332T6 | — | 1 | 0.42 | 0.18 | 0.05 | 0.07 | 0.03 | 0.03 | 0.05 | 0.12 | 0.10 | 0.03 | 0.04 | 0.02 | 0.08 | 0.04 |
| SEQID-03578 | Q332U3 | — | 0 | 0.57 | 0.22 | 0.04 | 0.10 | 0.09 | 0.02 | 0.00 | 0.04 | 0.09 | 0.00 | 0.07 | 0.12 | 0.08 | 0.12 |
| SEQID-03579 | Q3E731 | — | 0 | 0.37 | 0.19 | 0.02 | 0.35 | 0.03 | 0.02 | 0.07 | 0.00 | 0.05 | 0.06 | 0.07 | 0.13 | 0.03 | 0.11 |
| SEQID-03580 | Q3E732 | — | 1 | 0.37 | 0.13 | 0.03 | 0.07 | 0.07 | 0.09 | 0.04 | 0.05 | 0.03 | 0.03 | 0.04 | 0.01 | 0.11 | 0.07 |
| SEQID-03581 | Q3E747 | — | 1 | 0.55 | 0.24 | 0.03 | 0.10 | 0.05 | 0.05 | 0.00 | 0.00 | 0.07 | 0.00 | 0.00 | 0.09 | 0.10 | 0.14 |
| SEQID-03582 | Q3E794 | — | 0 | 0.60 | 0.19 | 0.03 | 0.10 | 0.04 | 0.01 | 0.00 | 0.05 | 0.00 | 0.00 | 0.03 | 0.00 | 0.15 | 0.30 |
| SEQID-03583 | Q3E813 | — | 1 | 0.54 | 0.23 | 0.02 | 0.18 | 0.04 | 0.06 | 0.00 | 0.02 | 0.09 | 0.00 | 0.09 | 0.11 | 0.09 | 0.06 |
| SEQID-03584 | Q3E843 | — | 1 | 0.42 | 0.15 | 0.02 | 0.23 | 0.02 | 0.02 | 0.05 | 0.08 | 0.00 | 0.00 | 0.02 | 0.02 | 0.13 | 0.00 |
| SEQID-03585 | Q3SZ70 | — | 1 | 0.53 | 0.19 | 0.01 | 0.03 | 0.05 | 0.09 | 0.02 | 0.04 | 0.06 | 0.04 | 0.02 | 0.04 | 0.09 | 0.07 |
| SEQID-03586 | Q3T0Q6 | — | 0 | 0.25 | 0.08 | 0.07 | 0.20 | 0.02 | 0.06 | 0.04 | 0.06 | 0.07 | 0.01 | 0.03 | 0.01 | 0.13 | 0.00 |
| SEQID-03587 | Q3T0V7 | — | 1 | 0.30 | 0.08 | 0.04 | 0.13 | 0.03 | 0.06 | 0.12 | 0.03 | 0.14 | 0.06 | 0.03 | 0.03 | 0.05 | 0.08 |
| SEQID-03588 | Q3T0Z3 | — | 1 | 0.46 | 0.19 | 0.07 | 0.10 | 0.03 | 0.02 | 0.00 | 0.09 | 0.10 | 0.07 | 0.06 | 0.07 | 0.12 | 0.16 |
| SEQID-03589 | Q3T0ZB | — | 1 | 0.56 | 0.24 | 0.02 | 0.05 | 0.05 | 0.09 | 0.02 | 0.03 | 0.05 | 0.04 | 0.04 | 0.09 | 0.08 | 0.13 |
| SEQID-03590 | Q3V4Z3 | — | 1 | 0.45 | 0.23 | 0.01 | 0.05 | 0.07 | 0.04 | 0.01 | 0.01 | 0.15 | 0.06 | 0.01 | 0.11 | 0.03 | 0.07 |
| SEQID-03591 | Q3ZBK6 | — | 1 | 0.58 | 0.21 | 0.03 | 0.10 | 0.04 | 0.06 | 0.00 | 0.08 | 0.09 | 0.03 | 0.09 | 0.11 | 0.13 | 0.11 |
| SEQID-03592 | Q48585 | — | 1 | 0.42 | 0.18 | 0.02 | 0.18 | 0.05 | 0.02 | 0.00 | 0.04 | 0.00 | 0.09 | 0.02 | 0.06 | 0.09 | 0.00 |
| SEQID-03593 | Q4VZK1 | — | 1 | 0.52 | 0.19 | 0.04 | 0.23 | 0.04 | 0.09 | 0.00 | 0.04 | 0.06 | 0.02 | 0.02 | 0.04 | 0.13 | 0.19 |
| SEQID-03594 | Q5BCS7 | — | 1 | 0.39 | 0.19 | 0.02 | 0.03 | 0.07 | 0.02 | 0.07 | 0.06 | 0.07 | 0.01 | 0.03 | 0.15 | 0.13 | 0.07 |
| SEQID-03595 | Q5BDW3 | — | 1 | 0.46 | 0.20 | 0.02 | 0.34 | 0.03 | 0.05 | 0.00 | 0.05 | 0.14 | 0.02 | 0.01 | 0.05 | 0.05 | 0.11 |
| SEQID-03596 | Q5BIS3 | — | 1 | 0.47 | 0.11 | 0.07 | 0.13 | 0.01 | 0.06 | 0.01 | 0.04 | 0.10 | 0.03 | 0.04 | 0.03 | 0.03 | 0.12 |
| SEQID-03597 | Q5E9Z8 | — | 0 | 0.46 | 0.13 | 0.11 | 0.14 | 0.05 | 0.02 | 0.00 | 0.04 | 0.03 | 0.06 | 0.05 | 0.03 | 0.06 | 0.22 |
| SEQID-03598 | Q5EA80 | — | 1 | 0.48 | 0.29 | 0.02 | 0.09 | 0.02 | 0.05 | 0.03 | 0.07 | 0.07 | 0.03 | 0.03 | 0.02 | 0.05 | 0.09 |
| SEQID-03599 | Q5F4C4 | — | 1 | 0.44 | 0.24 | 0.04 | 0.09 | 0.04 | 0.04 | 0.02 | 0.03 | 0.10 | 0.02 | 0.03 | 0.02 | 0.13 | 0.08 |
| | | | | 0.51 | 0.27 | 0.02 | 0.06 | 0.09 | 0.04 | 0.01 | 0.03 | 0.09 | 0.03 | 0.02 | 0.05 | 0.18 | 0.10 |

TABLE 1-continued

| | | | | | | | | | | | | | |
|---|---|---|---|---|---|---|---|---|---|---|---|---|---|
| SEQID-03600 | Q5FHT1 | — | 1 | 0.52 | 0.20 | 0.04 | 0.01 | 0.06 | 0.09 | 0.01 | 0.04 | 0.08 | 0.03 | 0.03 | 0.10 | 0.06 | 0.13 |
| SEQID-03601 | Q5FJI3 | — | 1 | 0.58 | 0.18 | 0.03 | 0.13 | 0.03 | 0.03 | 0.00 | 0.02 | 0.00 | 0.04 | 0.02 | 0.02 | 0.06 | 0.30 |
| SEQID-03602 | Q5FK48 | — | 1 | 0.51 | 0.23 | 0.03 | 0.03 | 0.06 | 0.09 | 0.03 | 0.01 | 0.10 | 0.05 | 0.05 | 0.08 | 0.10 | 0.07 |
| SEQID-03603 | Q5FKL2 | — | 0 | 0.53 | 0.29 | 0.03 | 0.03 | 0.05 | 0.06 | 0.00 | 0.07 | 0.09 | 0.02 | 0.02 | 0.08 | 0.14 | 0.12 |
| SEQID-03604 | Q5FLW3 | — | 1 | 0.37 | 0.19 | 0.04 | 0.03 | 0.05 | 0.21 | 0.03 | 0.06 | 0.09 | 0.03 | 0.02 | 0.04 | 0.09 | 0.02 |
| SEQID-03605 | Q5FM69 | — | 0 | 0.54 | 0.27 | 0.03 | 0.09 | 0.08 | 0.07 | 0.00 | 0.03 | 0.08 | 0.06 | 0.03 | 0.05 | 0.09 | 0.09 |
| SEQID-03606 | Q5FM79 | — | 0 | 0.60 | 0.34 | 0.03 | 0.03 | 0.06 | 0.04 | 0.02 | 0.03 | 0.06 | 0.02 | 0.03 | 0.04 | 0.01 | 0.26 |
| SEQID-03607 | Q5FME7 | — | 1 | 0.32 | 0.14 | 0.04 | 0.05 | 0.03 | 0.24 | 0.00 | 0.02 | 0.12 | 0.04 | 0.05 | 0.06 | 0.06 | 0.05 |
| SEQID-03608 | Q5QHW1 | — | 1 | 0.51 | 0.22 | 0.04 | 0.06 | 0.03 | 0.07 | 0.02 | 0.01 | 0.10 | 0.03 | 0.01 | 0.02 | 0.10 | 0.09 |
| SEQID-03609 | Q5ZHK9 | — | 1 | 0.53 | 0.16 | 0.05 | 0.12 | 0.03 | 0.05 | 0.01 | 0.05 | 0.08 | 0.04 | 0.03 | 0.03 | 0.10 | 0.24 |
| SEQID-03610 | Q5ZI72 | — | 1 | 0.35 | 0.11 | 0.01 | 0.06 | 0.05 | 0.06 | 0.00 | 0.08 | 0.09 | 0.03 | 0.00 | 0.03 | 0.04 | 0.10 |
| SEQID-03611 | Q5ZIR5 | — | 0 | 0.37 | 0.03 | 0.08 | 0.07 | 0.04 | 0.03 | 0.02 | 0.04 | 0.17 | 0.09 | 0.09 | 0.01 | 0.01 | 0.26 |
| SEQID-03612 | Q5ZJI6 | — | 1 | 0.45 | 0.23 | 0.05 | 0.10 | 0.02 | 0.05 | 0.02 | 0.07 | 0.08 | 0.04 | 0.03 | 0.04 | 0.12 | 0.07 |
| SEQID-03613 | Q5ZK81 | — | 1 | 0.45 | 0.15 | 0.02 | 0.16 | 0.01 | 0.04 | 0.02 | 0.07 | 0.07 | 0.06 | 0.05 | 0.05 | 0.05 | 0.07 |
| SEQID-03614 | Q6PV25 | — | 1 | 0.38 | 0.19 | 0.05 | 0.10 | 0.04 | 0.04 | 0.00 | 0.05 | 0.09 | 0.09 | 0.01 | 0.10 | 0.10 | 0.06 |
| SEQID-03615 | Q6Q3I1 | — | 1 | 0.51 | 0.19 | 0.07 | 0.07 | 0.03 | 0.08 | 0.00 | 0.02 | 0.04 | 0.10 | 0.01 | 0.04 | 0.10 | 0.25 |
| SEQID-03616 | Q6Q546 | — | 0 | 0.53 | 0.31 | 0.01 | 0.04 | 0.04 | 0.08 | 0.01 | 0.06 | 0.03 | 0.04 | 0.03 | 0.03 | 0.10 | 0.13 |
| SEQID-03617 | Q6XXM1 | — | 1 | 0.31 | 0.19 | 0.07 | 0.27 | 0.00 | 0.02 | 0.00 | 0.06 | 0.05 | 0.03 | 0.02 | 0.05 | 0.14 | 0.02 |
| SEQID-03618 | Q74IM0 | — | 1 | 0.52 | 0.28 | 0.05 | 0.05 | 0.05 | 0.03 | 0.00 | 0.03 | 0.08 | 0.02 | 0.04 | 0.01 | 0.14 | 0.11 |
| SEQID-03619 | Q74IV9 | — | 1 | 0.52 | 0.29 | 0.05 | 0.04 | 0.07 | 0.06 | 0.00 | 0.03 | 0.07 | 0.04 | 0.10 | 0.03 | 0.10 | 0.11 |
| SEQID-03620 | Q74J20 | — | 1 | 0.54 | 0.28 | 0.04 | 0.06 | 0.04 | 0.08 | 0.00 | 0.04 | 0.03 | 0.03 | 0.02 | 0.07 | 0.14 | 0.12 |
| SEQID-03621 | Q74LG3 | — | 1 | 0.35 | 0.16 | 0.03 | 0.05 | 0.05 | 0.23 | 0.01 | 0.04 | 0.13 | 0.02 | 0.03 | 0.09 | 0.07 | 0.04 |
| SEQID-03622 | Q7Y1H8 | — | 1 | 0.35 | 0.14 | 0.10 | 0.11 | 0.01 | 0.05 | 0.00 | 0.04 | 0.05 | 0.09 | 0.03 | 0.05 | 0.07 | 0.09 |
| SEQID-03623 | Q85WU8 | — | 1 | 0.49 | 0.29 | 0.00 | 0.16 | 0.04 | 0.09 | 0.02 | 0.05 | 0.00 | 0.10 | 0.01 | 0.02 | 0.18 | 0.09 |
| SEQID-03624 | Q88V14 | — | 0 | 0.39 | 0.20 | 0.04 | 0.01 | 0.07 | 0.19 | 0.00 | 0.04 | 0.01 | 0.05 | 0.06 | 0.07 | 0.09 | 0.01 |
| SEQID-03625 | Q88V75 | — | 1 | 0.47 | 0.13 | 0.03 | 0.10 | 0.01 | 0.07 | 0.02 | 0.06 | 0.10 | 0.06 | 0.01 | 0.06 | 0.09 | 0.05 |
| SEQID-03626 | Q88WJ7 | — | 1 | 0.41 | 0.21 | 0.03 | 0.05 | 0.06 | 0.03 | 0.00 | 0.07 | 0.10 | 0.04 | 0.04 | 0.08 | 0.09 | 0.05 |
| SEQID-03627 | Q88WK6 | — | 0 | 0.57 | 0.18 | 0.04 | 0.05 | 0.05 | 0.06 | 0.00 | 0.07 | 0.12 | 0.01 | 0.06 | 0.02 | 0.06 | 0.07 |
| SEQID-03628 | Q5EX0S | — | 1 | 0.54 | 0.19 | 0.04 | 0.16 | 0.02 | 0.03 | 0.00 | 0.03 | 0.00 | 0.03 | 0.01 | 0.04 | 0.10 | 0.16 |
| SEQID-03629 | Q88XW8 | — | 0 | 0.56 | 0.31 | 0.06 | 0.01 | 0.03 | 0.06 | 0.00 | 0.03 | 0.03 | 0.03 | 0.06 | 0.12 | 0.10 | 0.18 |
| SEQID-03630 | Q88Z77 | — | 1 | 0.33 | 0.16 | 0.04 | 0.13 | 0.02 | 0.28 | 0.00 | 0.04 | 0.04 | 0.03 | 0.02 | 0.05 | 0.10 | 0.12 |
| SEQID-03631 | Q3H7U1 | — | 1 | 0.43 | 0.17 | 0.04 | 0.03 | 0.03 | 0.08 | 0.00 | 0.04 | 0.10 | 0.03 | 0.05 | 0.05 | 0.09 | 0.05 |
| SEQID-03632 | Q3HZ03 | — | 1 | 0.45 | 0.26 | 0.05 | 0.07 | 0.05 | 0.07 | 0.02 | 0.02 | 0.09 | 0.04 | 0.03 | 0.03 | 0.03 | 0.04 |
| SEQID-03633 | Q8LJS2 | — | 1 | 0.42 | 0.14 | 0.05 | 0.10 | 0.03 | 0.05 | 0.05 | 0.04 | 0.08 | 0.04 | 0.02 | 0.06 | 0.18 | 0.07 |
| SEQID-03634 | Q8SPJ1 | — | 1 | 0.45 | 0.24 | 0.06 | 0.01 | 0.03 | 0.12 | 0.01 | 0.04 | 0.11 | 0.15 | 0.03 | 0.03 | 0.06 | 0.15 |
| SEQID-03635 | Q3TGQ5 | — | 0 | 0.40 | 0.08 | 0.06 | 0.17 | 0.05 | 0.05 | 0.02 | 0.00 | 0.07 | 0.03 | 0.04 | 0.05 | 0.13 | 0.05 |
| SEQID-03636 | Q3TGU5 | — | 1 | 0.65 | 0.24 | 0.06 | 0.07 | 0.06 | 0.06 | 0.09 | 0.02 | 0.00 | 0.04 | 0.02 | 0.04 | 0.04 | 0.09 |
| SEQID-03637 | Q90370 | — | 0 | 0.43 | 0.13 | 0.02 | 0.09 | 0.05 | 0.00 | 0.09 | 0.09 | 0.02 | 0.03 | 0.09 | 0.05 | 0.10 | 0.14 |
| SEQID-03638 | Q90888 | — | 0 | 0.43 | 0.13 | 0.03 | 0.25 | 0.04 | 0.06 | 0.07 | 0.00 | 0.00 | 0.03 | 0.12 | 0.02 | 0.08 | 0.05 |
| SEQID-03639 | Q9SKV7 | — | 0 | 0.51 | 0.19 | 0.18 | 0.19 | 0.08 | 0.03 | 0.01 | 0.09 | 0.08 | 0.02 | 0.12 | 0.10 | 0.09 | 0.05 |
| SEQID-03640 | Q9M4U5 | — | 1 | 0.47 | 0.14 | 0.07 | 0.09 | 0.00 | 0.02 | 0.00 | 0.03 | 0.00 | 0.02 | 0.01 | 0.05 | 0.09 | 0.05 |
| SEQID-03641 | W5P481 | — | 1 | 0.42 | 0.13 | 0.04 | 0.15 | 0.02 | 0.03 | 0.00 | 0.03 | 0.09 | 0.04 | 0.03 | 0.10 | 0.06 | 0.16 |
| SEQID-03642 | W5PVF9 | — | 1 | 0.24 | 0.10 | 0.05 | 0.00 | 0.05 | 0.09 | 0.00 | 0.03 | 0.13 | 0.04 | 0.01 | 0.02 | 0.04 | 0.05 |
| SEQID-03643 | A1A080 | — | 0 | 0.37 | 0.15 | 0.07 | 0.09 | 0.01 | 0.09 | 0.00 | 0.05 | 0.06 | 0.15 | 0.04 | 0.03 | 0.07 | 0.06 |
| SEQID-03644 | A1A092 | — | 0 | 0.51 | 0.26 | 0.04 | 0.13 | 0.05 | 0.06 | 0.02 | 0.00 | 0.08 | 0.03 | 0.04 | 0.04 | 0.04 | 0.17 |
| SEQID-03645 | A1A093 | — | 1 | 0.42 | 0.21 | 0.05 | 0.25 | 0.01 | 0.00 | 0.00 | 0.07 | 0.03 | 0.04 | 0.02 | 0.07 | 0.00 | 0.09 |
| SEQID-03646 | A1A1E3 | — | 0 | 0.43 | 0.20 | 0.00 | 0.19 | 0.04 | 0.06 | 0.01 | 0.01 | 0.00 | 0.06 | 0.09 | 0.08 | 0.07 | 0.09 |
| SEQID-03647 | A1A2C3 | — | 0 | 0.46 | 0.19 | 0.05 | 0.09 | 0.08 | 0.03 | 0.01 | 0.00 | 0.08 | 0.01 | 0.12 | 0.10 | 0.06 | 0.12 |
| SEQID-03648 | A1A4Q4 | — | 0 | 0.51 | 0.14 | 0.18 | 0.15 | 0.05 | 0.02 | 0.00 | 0.02 | 0.00 | 0.03 | 0.12 | 0.05 | 0.10 | 0.19 |
| SEQID-03649 | A2QCV8 | — | 1 | 0.52 | 0.08 | 0.07 | 0.02 | 0.00 | 0.03 | 0.00 | 0.09 | 0.04 | 0.04 | 0.01 | 0.03 | 0.10 | 0.18 |
| SEQID-03650 | A2QEJ9 | — | 0 | 0.49 | 0.19 | 0.06 | 0.05 | 0.06 | 0.03 | 0.03 | 0.02 | 0.04 | 0.04 | 0.06 | 0.00 | 0.06 | 0.36 |
| SEQID-03651 | A2WNH1 | — | 0 | 0.44 | 0.18 | 0.04 | 0.02 | 0.07 | 0.09 | 0.02 | 0.09 | 0.05 | 0.06 | 0.00 | 0.02 | 0.10 | 0.10 |
| SEQID-03651 | A2WNH1 | — | 0 | 0.46 | 0.17 | 0.03 | 0.05 | 0.02 | 0.01 | 0.14 | 0.05 | 0.05 | 0.07 | 0.02 | 0.09 | 0.05 | 0.06 |
| SEQID-03652 | A2Y1D7 | — | 0 | 0.38 | 0.09 | 0.04 | 0.00 | 0.03 | 0.08 | 0.15 | 0.02 | 0.11 | 0.07 | 0.04 | 0.02 | 0.00 | 0.15 |

TABLE 1-continued

| | | | | | | | | | | | | | | |
|---|---|---|---|---|---|---|---|---|---|---|---|---|---|---|
| SEQID-03653 | A2Y7Z0 | — | 0 | 0.39 | 0.05 | 0.16 | 0.04 | 0.01 | 0.08 | 0.00 | 0.09 | 0.11 | 0.05 | 0.03 | 0.01 | 0.02 | 0.16 |
| SEQID-03654 | A3B0Y1 | — | 0 | 0.36 | 0.09 | 0.04 | 0.00 | 0.05 | 0.06 | 0.15 | 0.02 | 0.11 | 0.07 | 0.02 | 0.02 | 0.00 | 0.15 |
| SEQID-03655 | A4GG84 | — | 1 | 0.54 | 0.25 | 0.03 | 0.08 | 0.05 | 0.02 | 0.01 | 0.07 | 0.07 | 0.04 | 0.00 | 0.15 | 0.05 | 0.13 |
| SEQID-03656 | A4GGF4 | — | 0 | 0.61 | 0.14 | 0.05 | 0.09 | 0.06 | 0.00 | 0.02 | 0.02 | 0.00 | 0.02 | 0.03 | 0.06 | 0.07 | 0.23 |
| SEQID-03657 | A4GGF3 | — | 0 | 0.50 | 0.22 | 0.00 | 0.12 | 0.04 | 0.03 | 0.00 | 0.11 | 0.08 | 0.03 | 0.03 | 0.09 | 0.11 | 0.13 |
| SEQID-03658 | A5D962 | — | 1 | 0.35 | 0.12 | 0.05 | 0.10 | 0.04 | 0.07 | 0.02 | 0.03 | 0.11 | 0.04 | 0.01 | 0.03 | 0.07 | 0.09 |
| SEQID-03659 | A5VJC3 | — | 0 | 0.46 | 0.14 | 0.03 | 0.11 | 0.04 | 0.04 | 0.00 | 0.04 | 0.07 | 0.02 | 0.07 | 0.02 | 0.09 | 0.13 |
| SEQID-03660 | A5VKX3 | — | 0 | 0.55 | 0.07 | 0.04 | 0.16 | 0.06 | 0.02 | 0.00 | 0.03 | 0.00 | 0.04 | 0.04 | 0.00 | 0.06 | 0.32 |
| SEQID-03661 | A5VLI2 | — | 0 | 0.53 | 0.16 | 0.02 | 0.14 | 0.05 | 0.00 | 0.07 | 0.06 | 0.03 | 0.06 | 0.05 | 0.05 | 0.00 | 0.23 |
| SEQID-03662 | A5VLK1 | — | 1 | 0.56 | 0.15 | 0.03 | 0.03 | 0.01 | 0.06 | 0.00 | 0.02 | 0.06 | 0.10 | 0.03 | 0.03 | 0.04 | 0.16 |
| SEQID-03663 | A6QQ14 | — | 0 | 0.35 | 0.18 | 0.15 | 0.10 | 0.01 | 0.08 | 0.02 | 0.05 | 0.05 | 0.10 | 0.04 | 0.04 | 0.10 | 0.05 |
| SEQID-03664 | A6QQ66 | — | 0 | 0.34 | 0.12 | 0.03 | 0.01 | 0.06 | 0.13 | 0.02 | 0.02 | 0.01 | 0.04 | 0.01 | 0.04 | 0.08 | 0.07 |
| SEQID-03665 | A7Y3K4 | — | 0 | 0.56 | 0.24 | 0.01 | 0.10 | 0.05 | 0.02 | 0.02 | 0.06 | 0.25 | 0.07 | 0.04 | 0.03 | 0.13 | 0.18 |
| SEQID-03666 | B0IEU3 | — | 1 | 0.35 | 0.16 | 0.03 | 0.12 | 0.06 | 0.04 | 0.02 | 0.02 | 0.08 | 0.04 | 0.02 | 0.07 | 0.07 | 0.06 |
| SEQID-03667 | B1A991 | — | 0 | 0.50 | 0.22 | 0.00 | 0.14 | 0.06 | 0.03 | 0.02 | 0.13 | 0.11 | 0.02 | 0.04 | 0.12 | 0.12 | 0.15 |
| SEQID-03668 | B2G5T7 | — | 0 | 0.49 | 0.24 | 0.14 | 0.00 | 0.02 | 0.13 | 0.00 | 0.06 | 0.07 | 0.02 | 0.00 | 0.07 | 0.08 | 0.16 |
| SEQID-03669 | B2G6N9 | — | 0 | 0.44 | 0.16 | 0.05 | 0.04 | 0.07 | 0.06 | 0.00 | 0.00 | 0.11 | 0.04 | 0.00 | 0.03 | 0.08 | 0.09 |
| SEQID-03670 | B2G7V3 | — | 0 | 0.48 | 0.15 | 0.06 | 0.15 | 0.02 | 0.03 | 0.00 | 0.06 | 0.14 | 0.03 | 0.02 | 0.04 | 0.09 | 0.18 |
| SEQID-03671 | B2G8D6 | — | 0 | 0.43 | 0.16 | 0.04 | 0.03 | 0.05 | 0.09 | 0.00 | 0.17 | 0.05 | 0.03 | 0.07 | 0.01 | 0.07 | 0.10 |
| SEQID-03672 | B3Y1Y0 | — | 0 | 0.62 | 0.14 | 0.02 | 0.08 | 0.03 | 0.06 | 0.05 | 0.03 | 0.08 | 0.04 | 0.01 | 0.04 | 0.07 | 0.10 |
| SEQID-03673 | B2Y203 | — | 0 | 0.51 | 0.20 | 0.00 | 0.13 | 0.07 | 0.04 | 0.01 | 0.09 | 0.00 | 0.02 | 0.03 | 0.03 | 0.06 | 0.21 |
| SEQID-03674 | B3DQC5 | — | 0 | 0.51 | 0.25 | 0.05 | 0.12 | 0.02 | 0.05 | 0.00 | 0.07 | 0.07 | 0.05 | 0.02 | 0.05 | 0.12 | 0.15 |
| SEQID-03675 | B3DQT3 | — | 0 | 0.53 | 0.15 | 0.18 | 0.13 | 0.02 | 0.03 | 0.00 | 0.00 | 0.04 | 0.05 | 0.02 | 0.07 | 0.04 | 0.16 |
| SEQID-03676 | B3DRN7 | — | 0 | 0.29 | 0.13 | 0.07 | 0.13 | 0.03 | 0.13 | 0.00 | 0.19 | 0.05 | 0.04 | 0.04 | 0.02 | 0.10 | 0.30 |
| SEQID-03677 | B3OS06 | — | 0 | 0.40 | 0.25 | 0.11 | 0.00 | 0.02 | 0.08 | 0.00 | 0.04 | 0.04 | 0.14 | 0.02 | 0.00 | 0.06 | 0.02 |
| SEQID-03678 | B3DSB0 | — | 0 | 0.57 | 0.14 | 0.05 | 0.07 | 0.00 | 0.03 | 0.00 | 0.04 | 0.17 | 0.15 | 0.03 | 0.06 | 0.10 | 0.00 |
| SEQID-03679 | B3DSB0 | — | 0 | 0.41 | 0.17 | 0.09 | 0.16 | 0.02 | 0.02 | 0.01 | 0.04 | 0.00 | 0.02 | 0.03 | 0.05 | 0.10 | 0.20 |
| SEQID-03680 | B3LMP9 | — | 1 | 0.37 | 0.09 | 0.15 | 0.14 | 0.07 | 0.07 | 0.00 | 0.07 | 0.04 | 0.04 | 0.02 | 0.07 | 0.05 | 0.15 |
| SEQID-03681 | B3W9ZI | — | 1 | 0.53 | 0.27 | 0.05 | 0.33 | 0.06 | 0.02 | 0.00 | 0.04 | 0.00 | 0.04 | 0.03 | 0.02 | 0.04 | 0.10 |
| SEQID-03682 | B3WF72 | — | 0 | 0.41 | 0.17 | 0.04 | 0.13 | 0.01 | 0.05 | 0.00 | 0.06 | 0.00 | 0.05 | 0.05 | 0.07 | 0.04 | 0.17 |
| SEQID-03683 | B7GRY8 | — | 0 | 0.43 | 0.17 | 0.06 | 0.03 | 0.04 | 0.01 | 0.00 | 0.04 | 0.06 | 0.02 | 0.01 | 0.06 | 0.06 | 0.09 |
| SEQID-03684 | B7GUP0 | — | 1 | 0.52 | 0.16 | 0.04 | 0.04 | 0.00 | 0.06 | 0.02 | 0.14 | 0.04 | 0.01 | 0.01 | 0.03 | 0.03 | 0.07 |
| SEQID-03685 | B8DSI4 | — | 1 | 0.44 | 0.20 | 0.05 | 0.01 | 0.06 | 0.10 | 0.05 | 0.05 | 0.04 | 0.07 | 0.00 | 0.03 | 0.06 | 0.23 |
| SEQID-03686 | B8DSQ1 | — | 1 | 0.34 | 0.07 | 0.07 | 0.01 | 0.06 | 0.05 | 0.00 | 0.04 | 0.07 | 0.05 | 0.05 | 0.05 | 0.04 | 0.13 |
| SEQID-03687 | B8DUL7 | — | 1 | 0.49 | 0.17 | 0.03 | 0.05 | 0.10 | 0.04 | 0.00 | 0.07 | 0.06 | 0.03 | 0.03 | 0.04 | 0.04 | 0.09 |
| SEQID-03688 | B8DV05 | — | 1 | 0.38 | 0.14 | 0.07 | 0.10 | 0.02 | 0.02 | 0.00 | 0.00 | 0.04 | 0.07 | 0.03 | 0.05 | 0.07 | 0.17 |
| SEQID-03689 | B8DW24 | — | 1 | 0.48 | 0.12 | 0.04 | 0.04 | 0.05 | 0.04 | 0.01 | 0.00 | 0.10 | 0.15 | 0.01 | 0.03 | 0.07 | 0.07 |
| SEQID-03690 | D5DEH5 | — | 0 | 0.42 | 0.23 | 0.04 | 0.04 | 0.05 | 0.02 | 0.00 | 0.06 | 0.07 | 0.07 | 0.00 | 0.03 | 0.07 | 0.19 |
| SEQID-03691 | E1UMM6 | — | 0 | 0.47 | 0.07 | 0.03 | 0.05 | 0.04 | 0.16 | 0.02 | 0.00 | 0.04 | 0.25 | 0.01 | 0.01 | 0.04 | 0.17 |
| SEQID-03692 | E1UQB7 | — | 0 | 0.43 | 0.17 | 0.00 | 0.40 | 0.00 | 0.00 | 0.00 | 0.04 | 0.00 | 0.00 | 0.00 | 0.00 | 0.06 | 0.09 |
| SEQID-03693 | E1UV85 | — | 1 | 0.37 | 0.17 | 0.02 | 0.10 | 0.01 | 0.09 | 0.05 | 0.05 | 0.02 | 0.24 | 0.05 | 0.06 | 0.03 | 0.25 |
| SEQID-03694 | E7Q903 | — | 1 | 0.52 | 0.16 | 0.05 | 0.02 | 0.00 | 0.12 | 0.05 | 0.04 | 0.05 | 0.15 | 0.06 | 0.04 | 0.09 | 0.06 |
| SEQID-03695 | I1LP26 | — | 1 | 0.44 | 0.20 | 0.05 | 0.02 | 0.06 | 0.10 | 0.00 | 0.00 | 0.04 | 0.07 | 0.05 | 0.04 | 0.13 | 0.05 |
| SEQID-03696 | K1WSX8 | — | 1 | 0.34 | 0.09 | 0.07 | 0.06 | 0.01 | 0.05 | 0.00 | 0.14 | 0.07 | 0.12 | 0.02 | 0.03 | 0.06 | 0.11 |
| SEQID-03697 | K7K247 | — | 1 | 0.49 | 0.17 | 0.03 | 0.06 | 0.04 | 0.04 | 0.00 | 0.04 | 0.05 | 0.14 | 0.01 | 0.05 | 0.04 | 0.11 |
| SEQID-03698 | O13555 | — | 0 | 0.38 | 0.14 | 0.07 | 0.06 | 0.04 | 0.02 | 0.00 | 0.07 | 0.05 | 0.16 | 0.01 | 0.03 | 0.18 | 0.11 |
| SEQID-03699 | O49224 | — | 0 | 0.42 | 0.12 | 0.04 | 0.06 | 0.04 | 0.04 | 0.01 | 0.00 | 0.05 | 0.14 | 0.02 | 0.03 | 0.18 | 0.11 |
| SEQID-03700 | P00126 | — | 0 | 0.47 | 0.23 | 0.03 | 0.05 | 0.00 | 0.04 | 0.02 | 0.00 | 0.05 | 0.00 | 0.01 | 0.00 | 0.02 | 0.00 |
| SEQID-03701 | P00227 | — | 0 | 0.37 | 0.07 | 0.00 | 0.00 | 0.01 | 0.00 | 0.11 | 0.11 | 0.00 | 0.00 | 0.00 | 0.00 | 0.02 | 0.11 |
| SEQID-03702 | P01249 | — | 0 | 0.49 | 0.19 | 0.06 | 0.02 | 0.00 | 0.02 | 0.05 | 0.05 | 0.00 | 0.00 | 0.00 | 0.00 | 0.02 | 0.00 |
| SEQID-03703 | P01250 | — | 0 | 0.47 | 0.27 | 0.04 | 0.06 | 0.04 | 0.06 | 0.05 | 0.02 | 0.00 | 0.00 | 0.02 | 0.00 | 0.02 | 0.00 |
| SEQID-03704 | P01251 | — | 0 | 0.49 | 0.27 | 0.04 | 0.06 | 0.04 | 0.04 | 0.00 | 0.00 | 0.00 | 0.00 | 0.02 | 0.02 | 0.02 | 0.00 |
| SEQID-03705 | P02318 | — | 0 | 0.17 | 0.06 | 0.01 | 0.60 | 0.00 | 0.00 | 0.11 | 0.11 | 0.00 | 0.00 | 0.00 | 0.00 | 0.02 | 0.00 |
| SEQID-03706 | P02405 | — | 0 | 0.56 | 0.12 | 0.03 | 0.10 | 0.01 | 0.01 | 0.04 | 0.09 | 0.03 | 0.03 | 0.04 | 0.00 | 0.06 | 0.24 |

TABLE 1-continued

| | | | | | | | | | | | | | | |
|---|---|---|---|---|---|---|---|---|---|---|---|---|---|---|
| SEQID-03706 | P02633 | — | 0 | 0.49 | 0.21 | 0.02 | 0.00 | 0.03 | 0.05 | 0.00 | 0.06 | 0.19 | 0.03 | 0.00 | 0.03 | 0.15 | 0.16 |
| SEQID-03707 | P02777 | — | 0 | 0.45 | 0.22 | 0.03 | 0.05 | 0.01 | 0.07 | 0.04 | 0.05 | 0.09 | 0.04 | 0.03 | 0.06 | 0.13 | 0.11 |
| SEQID-03708 | P04464 | — | 0 | 0.45 | 0.17 | 0.03 | 0.04 | 0.02 | 0.01 | 0.13 | 0.05 | 0.05 | 0.10 | 0.08 | 0.07 | 0.05 | 0.08 |
| SEQID-03709 | P04568 | — | 0 | 0.27 | 0.09 | 0.04 | 0.16 | 0.11 | 0.06 | 0.00 | 0.09 | 0.16 | 0.00 | 0.00 | 0.02 | 0.05 | 0.08 |
| SEQID-03710 | P04650 | — | 0 | 0.46 | 0.11 | 0.06 | 0.22 | 0.07 | 0.00 | 0.00 | 0.08 | 0.00 | 0.00 | 0.00 | 0.07 | 0.04 | 0.16 |
| SEQID-03711 | P05747 | — | 0 | 0.56 | 0.08 | 0.10 | 0.09 | 0.07 | 0.02 | 0.00 | 0.02 | 0.00 | 0.03 | 0.12 | 0.08 | 0.05 | 0.25 |
| SEQID-03712 | P05936 | — | 0 | 0.46 | 0.18 | 0.04 | 0.04 | 0.02 | 0.00 | 0.13 | 0.03 | 0.06 | 0.02 | 0.09 | 0.06 | 0.03 | 0.07 |
| SEQID-03713 | P07249 | — | 0 | 0.42 | 0.16 | 0.03 | 0.09 | 0.04 | 0.09 | 0.01 | 0.03 | 0.09 | 0.01 | 0.04 | 0.06 | 0.05 | 0.09 |
| SEQID-03714 | P07269 | — | 1 | 0.40 | 0.16 | 0.03 | 0.06 | 0.06 | 0.10 | 0.00 | 0.07 | 0.05 | 0.04 | 0.03 | 0.06 | 0.03 | 0.05 |
| SEQID-03715 | P09441 | — | 0 | 0.29 | 0.04 | 0.07 | 0.11 | 0.14 | 0.09 | 0.00 | 0.06 | 0.03 | 0.01 | 0.02 | 0.06 | 0.01 | 0.07 |
| SEQID-03716 | P0C225 | — | 0 | 0.26 | 0.16 | 0.06 | 0.03 | 0.02 | 0.10 | 0.04 | 0.02 | 0.12 | 0.04 | 0.04 | 0.01 | 0.10 | 0.02 |
| SEQID-03717 | P0C5A4 | — | 0 | 0.38 | 0.05 | 0.16 | 0.04 | 0.01 | 0.09 | 0.00 | 0.02 | 0.11 | 0.04 | 0.02 | 0.04 | 0.05 | 0.16 |
| SEQID-03718 | P0C5Q9 | — | 0 | 0.42 | 0.09 | 0.07 | 0.12 | 0.06 | 0.00 | 0.00 | 0.09 | 0.07 | 0.03 | 0.03 | 0.01 | 0.06 | 0.10 |
| SEQID-03719 | P0CSR4 | — | 1 | 0.56 | 0.25 | 0.01 | 0.11 | 0.04 | 0.06 | 0.02 | 0.07 | 0.02 | 0.01 | 0.00 | 0.03 | 0.09 | 0.07 |
| SEQID-03720 | P0CG92 | — | 0 | 0.29 | 0.13 | 0.11 | 0.00 | 0.03 | 0.00 | 0.00 | 0.05 | 0.14 | 0.02 | 0.05 | 0.10 | 0.06 | 0.02 |
| SEQID-03721 | P10961 | — | 0 | 0.39 | 0.15 | 0.03 | 0.11 | 0.15 | 0.13 | 0.02 | 0.19 | 0.06 | 0.01 | 0.00 | 0.03 | 0.06 | 0.06 |
| SEQID-03722 | P12230 | — | 1 | 0.40 | 0.23 | 0.02 | 0.28 | 0.03 | 0.09 | 0.00 | 0.04 | 0.03 | 0.02 | 0.03 | 0.05 | 0.07 | 0.06 |
| SEQID-03723 | P14164 | — | 0 | 0.39 | 0.16 | 0.03 | 0.04 | 0.15 | 0.00 | 0.07 | 0.06 | 0.03 | 0.03 | 0.07 | 0.15 | 0.03 | 0.12 |
| SEQID-03724 | P14724 | — | 0 | 0.38 | 0.15 | 0.03 | 0.04 | 0.14 | 0.12 | 0.00 | 0.04 | 0.02 | 0.02 | 0.06 | 0.05 | 0.06 | 0.08 |
| SEQID-03725 | P14936 | — | 0 | 0.39 | 0.19 | 0.05 | 0.01 | 0.14 | 0.14 | 0.04 | 0.06 | 0.07 | 0.01 | 0.06 | 0.05 | 0.09 | 0.05 |
| SEQID-03726 | P14937 | — | 0 | 0.41 | 0.19 | 0.05 | 0.01 | 0.01 | 0.11 | 0.05 | 0.07 | 0.12 | 0.04 | 0.05 | 0.04 | 0.07 | 0.07 |
| SEQID-03727 | P15341 | — | 0 | 0.10 | 0.06 | 0.01 | 0.63 | 0.00 | 0.09 | 0.11 | 0.06 | 0.14 | 0.04 | 0.04 | 0.04 | 0.06 | 0.06 |
| SEQID-03728 | P17639 | — | 0 | 0.34 | 0.10 | 0.04 | 0.05 | 0.02 | 0.00 | 0.11 | 0.04 | 0.00 | 0.10 | 0.00 | 0.02 | 0.02 | 0.00 |
| SEQID-03729 | P17803 | — | 0 | 0.50 | 0.19 | 0.02 | 0.11 | 0.03 | 0.05 | 0.00 | 0.10 | 0.16 | 0.00 | 0.03 | 0.06 | 0.06 | 0.12 |
| SEQID-03730 | P19515 | — | 1 | 0.45 | 0.22 | 0.04 | 0.06 | 0.05 | 0.05 | 0.02 | 0.09 | 0.05 | 0.02 | 0.00 | 0.09 | 0.09 | 0.11 |
| SEQID-03731 | P19757 | — | 0 | 0.16 | 0.06 | 0.01 | 0.48 | 0.04 | 0.06 | 0.04 | 0.03 | 0.06 | 0.04 | 0.03 | 0.07 | 0.09 | 0.03 |
| SEQID-03732 | P19782 | — | 0 | 0.19 | 0.05 | 0.03 | 0.38 | 0.01 | 0.07 | 0.00 | 0.09 | 0.07 | 0.02 | 0.07 | 0.01 | 0.02 | 0.00 |
| SEQID-03733 | P20422 | — | 0 | 0.46 | 0.18 | 0.06 | 0.00 | 0.00 | 0.02 | 0.04 | 0.03 | 0.05 | 0.05 | 0.03 | 0.03 | 0.02 | 0.01 |
| SEQID-03734 | P22613 | — | 0 | 0.39 | 0.07 | 0.01 | 0.27 | 0.03 | 0.08 | 0.01 | 0.01 | 0.11 | 0.07 | 0.03 | 0.03 | 0.04 | 0.09 |
| SEQID-03735 | P22701 | — | 0 | 0.30 | 0.09 | 0.04 | 0.13 | 0.05 | 0.04 | 0.03 | 0.02 | 0.00 | 0.04 | 0.00 | 0.00 | 0.05 | 0.20 |
| SEQID-03736 | P26351 | — | 0 | 0.49 | 0.11 | 0.03 | 0.00 | 0.01 | 0.05 | 0.00 | 0.06 | 0.18 | 0.10 | 0.00 | 0.02 | 0.05 | 0.10 |
| SEQID-03737 | P26377 | — | 0 | 0.32 | 0.06 | 0.01 | 0.22 | 0.05 | 0.05 | 0.05 | 0.08 | 0.19 | 0.00 | 0.00 | 0.01 | 0.07 | 0.21 |
| SEQID-03738 | P27013 | — | 0 | 0.37 | 0.10 | 0.03 | 0.14 | 0.04 | 0.04 | 0.03 | 0.09 | 0.01 | 0.02 | 0.12 | 0.02 | 0.02 | 0.09 |
| SEQID-03739 | P28318 | — | 0 | 0.52 | 0.22 | 0.02 | 0.04 | 0.04 | 0.07 | 0.01 | 0.14 | 0.06 | 0.02 | 0.03 | 0.06 | 0.10 | 0.09 |
| SEQID-03740 | P28804 | — | 0 | 0.59 | 0.17 | 0.05 | 0.09 | 0.01 | 0.00 | 0.00 | 0.02 | 0.07 | 0.02 | 0.12 | 0.12 | 0.07 | 0.23 |
| SEQID-03741 | P31395 | — | 0 | 0.42 | 0.14 | 0.07 | 0.08 | 0.05 | 0.03 | 0.03 | 0.05 | 0.23 | 0.02 | 0.00 | 0.07 | 0.09 | 0.17 |
| SEQID-03742 | P32389 | — | 1 | 0.41 | 0.16 | 0.03 | 0.05 | 0.05 | 0.03 | 0.00 | 0.04 | 0.07 | 0.01 | 0.03 | 0.03 | 0.09 | 0.09 |
| SEQID-03743 | P32450 | — | 0 | 0.38 | 0.14 | 0.01 | 0.21 | 0.03 | 0.08 | 0.04 | 0.11 | 0.01 | 0.00 | 0.05 | 0.06 | 0.06 | 0.03 |
| SEQID-03744 | P37219 | — | 1 | 0.60 | 0.12 | 0.09 | 0.00 | 0.00 | 0.04 | 0.00 | 0.02 | 0.17 | 0.04 | 0.13 | 0.06 | 0.04 | 0.18 |
| SEQID-03745 | P37210 | — | 0 | 0.56 | 0.11 | 0.10 | 0.16 | 0.00 | 0.02 | 0.04 | 0.04 | 0.14 | 0.04 | 0.25 | 0.03 | 0.04 | 0.22 |
| SEQID-03746 | P38236 | — | 1 | 0.41 | 0.15 | 0.05 | 0.11 | 0.04 | 0.04 | 0.01 | 0.04 | 0.11 | 0.04 | 0.19 | 0.03 | 0.09 | 0.09 |
| SEQID-03747 | P38243 | — | 0 | 0.45 | 0.14 | 0.03 | 0.04 | 0.07 | 0.04 | 0.00 | 0.06 | 0.07 | 0.01 | 0.04 | 0.03 | 0.10 | 0.10 |
| SEQID-03748 | P38284 | — | 0 | 0.41 | 0.13 | 0.02 | 0.07 | 0.05 | 0.08 | 0.03 | 0.04 | 0.08 | 0.03 | 0.04 | 0.04 | 0.06 | 0.10 |
| SEQID-03749 | P39549 | — | 1 | 0.41 | 0.11 | 0.02 | 0.09 | 0.06 | 0.04 | 0.01 | 0.04 | 0.14 | 0.02 | 0.03 | 0.05 | 0.06 | 0.04 |
| SEQID-03750 | P39973 | — | 0 | 0.56 | 0.16 | 0.02 | 0.07 | 0.06 | 0.04 | 0.03 | 0.01 | 0.04 | 0.00 | 0.06 | 0.04 | 0.09 | 0.14 |
| SEQID-03751 | P41651 | — | 0 | 0.47 | 0.16 | 0.06 | 0.05 | 0.05 | 0.04 | 0.02 | 0.00 | 0.02 | 0.02 | 0.02 | 0.07 | 0.04 | 0.20 |
| SEQID-03752 | P42755 | — | 0 | 0.31 | 0.14 | 0.04 | 0.10 | 0.03 | 0.07 | 0.04 | 0.05 | 0.22 | 0.10 | 0.01 | 0.09 | 0.06 | 0.08 |
| SEQID-03753 | P46298 | — | 1 | 0.54 | 0.24 | 0.04 | 0.16 | 0.00 | 0.04 | 0.02 | 0.02 | 0.05 | 0.03 | 0.05 | 0.03 | 0.11 | 0.15 |
| SEQID-03754 | P46517 | — | 0 | 0.32 | 0.10 | 0.04 | 0.11 | 0.00 | 0.04 | 0.01 | 0.04 | 0.17 | 0.10 | 0.01 | 0.01 | 0.05 | 0.09 |
| SEQID-03755 | P46520 | — | 0 | 0.26 | 0.09 | 0.04 | 0.15 | 0.00 | 0.05 | 0.00 | 0.08 | 0.17 | 0.11 | 0.00 | 0.02 | 0.04 | 0.22 |
| SEQID-03756 | P50415 | — | 0 | 0.32 | 0.21 | 0.03 | 0.19 | 0.03 | 0.04 | 0.02 | 0.10 | 0.07 | 0.02 | 0.00 | 0.02 | 0.14 | 0.04 |
| SEQID-03757 | P51426 | — | 0 | 0.53 | 0.10 | 0.02 | 0.24 | 0.05 | 0.02 | 0.00 | 0.07 | 0.00 | 0.01 | 0.04 | 0.07 | 0.03 | 0.16 |
| SEQID-03758 | P52193 | — | 1 | 0.42 | 0.14 | 0.03 | 0.03 | 0.04 | 0.13 | 0.01 | 0.04 | 0.15 | 0.03 | 0.02 | 0.05 | 0.06 | 0.11 |

TABLE 1-continued

| | | | | | | | | | | | | | | | |
|---|---|---|---|---|---|---|---|---|---|---|---|---|---|---|---|
| SEQID-03759 | P53222 | — | 0 | 0.40 | 0.14 | 0.04 | 0.09 | 0.04 | 0.01 | 0.03 | 0.06 | 0.00 | 0.02 | 0.06 | 0.05 | 0.09 |
| SEQID-03760 | P53334 | — | 1 | 0.39 | 0.18 | 0.10 | 0.06 | 0.06 | 0.00 | 0.05 | 0.05 | 0.03 | 0.01 | 0.05 | 0.05 | 0.06 |
| SEQID-03761 | P53869 | — | 1 | 0.48 | 0.12 | 0.01 | 0.16 | 0.05 | 0.00 | 0.04 | 0.05 | 0.02 | 0.01 | 0.02 | 0.07 | 0.11 |
| SEQID-03762 | P60741 | — | 0 | 0.59 | 0.22 | 0.04 | 0.02 | 0.04 | 0.12 | 0.02 | 0.08 | 0.05 | 0.03 | 0.07 | 0.01 | 0.26 |
| SEQID-03763 | P62144 | — | 0 | 0.44 | 0.16 | 0.04 | 0.04 | 0.01 | 0.00 | 0.06 | 0.05 | 0.06 | 0.06 | 0.08 | 0.05 | 0.07 |
| SEQID-03764 | P62326 | — | 0 | 0.46 | 0.09 | 0.03 | 0.00 | 0.07 | 0.03 | 0.08 | 0.20 | 0.01 | 0.00 | 0.04 | 0.04 | 0.23 |
| SEQID-03765 | P63212 | — | 0 | 0.45 | 0.18 | 0.12 | 0.06 | 0.04 | 0.00 | 0.03 | 0.10 | 0.00 | 0.02 | 0.06 | 0.09 | 0.11 |
| SEQID-03766 | P63314 | — | 0 | 0.50 | 0.11 | 0.04 | 0.02 | 0.07 | 0.11 | 0.05 | 0.18 | 0.02 | 0.00 | 0.07 | 0.05 | 0.20 |
| SEQID-03767 | P67833 | — | 1 | 0.17 | 0.06 | 0.01 | 0.00 | 0.00 | 0.11 | 0.02 | 0.11 | 0.01 | 0.02 | 0.00 | 0.02 | 0.00 |
| SEQID-03768 | P69328 | — | 0 | 0.42 | 0.17 | 0.07 | 0.04 | 0.08 | 0.01 | 0.03 | 0.05 | 0.04 | 0.01 | 0.04 | 0.07 | 0.02 |
| SEQID-03769 | P79105 | — | 0 | 0.59 | 0.26 | 0.02 | 0.03 | 0.03 | 0.00 | 0.06 | 0.08 | 0.02 | 0.06 | 0.08 | 0.11 | 0.12 |
| SEQID-03770 | P81451 | — | 0 | 0.56 | 0.20 | 0.06 | 0.00 | 0.05 | 0.04 | 0.03 | 0.07 | 0.04 | 0.05 | 0.06 | 0.11 | 0.17 |
| SEQID-03771 | P83005 | — | 0 | 0.28 | 0.15 | 0.05 | 0.11 | 0.02 | 0.00 | 0.02 | 0.11 | 0.03 | 0.05 | 0.02 | 0.10 | 0.00 |
| SEQID-03772 | P83489 | — | 0 | 0.28 | 0.16 | 0.05 | 0.08 | 0.02 | 0.04 | 0.02 | 0.12 | 0.04 | 0.05 | 0.03 | 0.10 | 0.02 |
| SEQID-03773 | P83704 | — | 0 | 0.46 | 0.21 | 0.07 | 0.02 | 0.02 | 0.04 | 0.12 | 0.10 | 0.01 | 0.02 | 0.03 | 0.14 | 0.10 |
| SEQID-03774 | P84083 | — | 0 | 0.38 | 0.11 | 0.06 | 0.08 | 0.04 | 0.01 | 0.07 | 0.23 | 0.04 | 0.01 | 0.02 | 0.07 | 0.17 |
| SEQID-03775 | P86315 | — | 0 | 0.30 | 0.14 | 0.05 | 0.08 | 0.00 | 0.04 | 0.05 | 0.12 | 0.04 | 0.00 | 0.00 | 0.10 | 0.02 |
| SEQID-03776 | P94522 | — | 1 | 0.43 | 0.17 | 0.04 | 0.02 | 0.02 | 0.01 | 0.10 | 0.03 | 0.06 | 0.01 | 0.06 | 0.09 | 0.07 |
| SEQID-03777 | Q00747 | — | 0 | 0.50 | 0.13 | 0.07 | 0.08 | 0.05 | 0.01 | 0.06 | 0.11 | 0.03 | 0.09 | 0.00 | 0.01 | 0.17 |
| SEQID-03778 | Q03323 | — | 0 | 0.46 | 0.03 | 0.14 | 0.62 | 0.02 | 0.11 | 0.02 | 0.05 | 0.06 | 0.00 | 0.04 | 0.01 | 0.17 |
| SEQID-03779 | Q033K5 | — | 0 | 0.39 | 0.18 | 0.03 | 0.04 | 0.05 | 0.01 | 0.06 | 0.08 | 0.02 | 0.03 | 0.05 | 0.07 | 0.08 |
| SEQID-03780 | Q035G1 | — | 0 | 0.53 | 0.09 | 0.04 | 0.00 | 0.13 | 0.00 | 0.02 | 0.11 | 0.03 | 0.05 | 0.00 | 0.04 | 0.19 |
| SEQID-03781 | Q035T6 | — | 0 | 0.47 | 0.17 | 0.07 | 0.28 | 0.02 | 0.00 | 0.05 | 0.05 | 0.03 | 0.05 | 0.03 | 0.09 | 0.16 |
| SEQID-03782 | Q037X5 | — | 0 | 0.52 | 0.15 | 0.04 | 0.15 | 0.01 | 0.05 | 0.04 | 0.07 | 0.02 | 0.02 | 0.00 | 0.06 | 0.16 |
| SEQID-03783 | Q038A1 | — | 0 | 0.46 | 0.18 | 0.11 | 0.11 | 0.04 | 0.00 | 0.00 | 0.10 | 0.02 | 0.03 | 0.06 | 0.09 | 0.11 |
| SEQID-03784 | Q038J5 | — | 0 | 0.55 | 0.09 | 0.01 | 0.01 | 0.03 | 0.07 | 0.10 | 0.23 | 0.02 | 0.00 | 0.06 | 0.09 | 0.20 |
| SEQID-03785 | Q038L1 | — | 1 | 0.38 | 0.17 | 0.05 | 0.18 | 0.00 | 0.02 | 0.01 | 0.07 | 0.04 | 0.09 | 0.01 | 0.11 | 0.06 |
| SEQID-03786 | Q033F0 | — | 0 | 0.50 | 0.13 | 0.06 | 0.07 | 0.05 | 0.08 | 0.04 | 0.05 | 0.06 | 0.03 | 0.03 | 0.08 | 0.09 |
| SEQID-03787 | Q045U8 | — | 0 | 0.35 | 0.11 | 0.07 | 0.09 | 0.01 | 0.00 | 0.07 | 0.11 | 0.03 | 0.09 | 0.00 | 0.01 | 0.09 |
| SEQID-03788 | Q046B4 | — | 0 | 0.46 | 0.16 | 0.05 | 0.07 | 0.06 | 0.11 | 0.07 | 0.05 | 0.02 | 0.04 | 0.01 | 0.08 | 0.04 |
| SEQID-03789 | Q046C1 | — | 1 | 0.58 | 0.22 | 0.05 | 0.04 | 0.04 | 0.00 | 0.13 | 0.11 | 0.05 | 0.00 | 0.05 | 0.07 | 0.12 |
| SEQID-03790 | Q04C04 | — | 0 | 0.57 | 0.18 | 0.04 | 0.09 | 0.00 | 0.00 | 0.04 | 0.02 | 0.04 | 0.03 | 0.06 | 0.01 | 0.26 |
| SEQID-03791 | Q04C49 | — | 0 | 0.57 | 0.24 | 0.07 | 0.02 | 0.10 | 0.00 | 0.03 | 0.06 | 0.04 | 0.00 | 0.06 | 0.03 | 0.14 |
| SEQID-03792 | Q06648 | — | 0 | 0.49 | 0.11 | 0.05 | 0.05 | 0.05 | 0.01 | 0.03 | 0.08 | 0.06 | 0.03 | 0.05 | 0.01 | 0.22 |
| SEQID-03793 | Q08655 | — | 1 | 0.41 | 0.15 | 0.03 | 0.07 | 0.09 | 0.00 | 0.05 | 0.06 | 0.04 | 0.03 | 0.04 | 0.02 | 0.14 |
| SEQID-03794 | Q08745 | — | 1 | 0.59 | 0.13 | 0.08 | 0.01 | 0.00 | 0.00 | 0.04 | 0.01 | 0.01 | 0.04 | 0.07 | 0.08 | 0.03 |
| SEQID-03795 | Q09MC8 | — | 1 | 0.43 | 0.18 | 0.02 | 0.07 | 0.04 | 0.00 | 0.03 | 0.18 | 0.03 | 0.19 | 0.04 | 0.06 | 0.20 |
| SEQID-03796 | Q0C9R4 | — | 0 | 0.38 | 0.15 | 0.07 | 0.08 | 0.04 | 0.00 | 0.00 | 0.10 | 0.05 | 0.03 | 0.04 | 0.08 | 0.09 |
| SEQID-03797 | Q0IU2 | — | 0 | 0.62 | 0.15 | 0.07 | 0.08 | 0.06 | 0.02 | 0.09 | 0.07 | 0.02 | 0.00 | 0.04 | 0.10 | 0.24 |
| SEQID-03798 | Q0INL7 | — | 0 | 0.59 | 0.16 | 0.05 | 0.10 | 0.06 | 0.00 | 0.00 | 0.04 | 0.04 | 0.00 | 0.06 | 0.07 | 0.27 |
| SEQID-03799 | Q0MUU2 | — | 0 | 0.56 | 0.11 | 0.09 | 0.05 | 0.02 | 0.00 | 0.02 | 0.00 | 0.04 | 0.01 | 0.03 | 0.02 | 0.34 |
| SEQID-03800 | Q0VBZ8 | — | 1 | 0.37 | 0.17 | 0.03 | 0.02 | 0.06 | 0.13 | 0.03 | 0.05 | 0.04 | 0.08 | 0.04 | 0.05 | 0.08 |
| SEQID-03801 | Q12034 | — | 0 | 0.33 | 0.15 | 0.06 | 0.07 | 0.02 | 0.01 | 0.05 | 0.05 | 0.04 | 0.00 | 0.04 | 0.11 | 0.12 |
| SEQID-03802 | Q12087 | — | 0 | 0.38 | 0.13 | 0.05 | 0.16 | 0.06 | 0.07 | 0.07 | 0.12 | 0.03 | 0.00 | 0.07 | 0.05 | 0.04 |
| SEQID-03803 | Q12515 | — | 0 | 0.49 | 0.18 | 0.03 | 0.05 | 0.02 | 0.01 | 0.01 | 0.07 | 0.05 | 0.02 | 0.02 | 0.09 | 0.10 |
| SEQID-03804 | Q148C4 | — | 0 | 0.42 | 0.16 | 0.04 | 0.04 | 0.04 | 0.00 | 0.04 | 0.07 | 0.05 | 0.01 | 0.06 | 0.06 | 0.20 |
| SEQID-03805 | Q14FC3 | — | 0 | 0.36 | 0.06 | 0.04 | 0.06 | 0.03 | 0.00 | 0.03 | 0.04 | 0.04 | 0.02 | 0.04 | 0.10 | 0.12 |
| SEQID-03806 | Q1G9G5 | — | 0 | 0.38 | 0.20 | 0.03 | 0.07 | 0.05 | 0.00 | 0.13 | 0.11 | 0.05 | 0.00 | 0.06 | 0.07 | 0.15 |
| SEQID-03807 | Q1GAQ4 | — | 0 | 0.55 | 0.23 | 0.04 | 0.32 | 0.03 | 0.15 | 0.15 | 0.03 | 0.06 | 0.03 | 0.15 | 0.02 | 0.12 |
| SEQID-03808 | Q1GBK7 | — | 0 | 0.46 | 0.17 | 0.04 | 0.01 | 0.03 | 0.15 | 0.03 | 0.06 | 0.06 | 0.04 | 0.04 | 0.03 | 0.19 |
| SEQID-03809 | Q1GBL4 | — | 0 | 0.56 | 0.24 | 0.15 | 0.10 | 0.03 | 0.15 | 0.01 | 0.09 | 0.06 | 0.01 | 0.05 | 0.08 | 0.19 |
| SEQID-03810 | Q1UQB5 | — | 1 | 0.57 | 0.17 | 0.07 | 0.02 | 0.01 | 0.03 | 0.00 | 0.05 | 0.06 | 0.02 | 0.06 | 0.01 | 0.20 |
| SEQID-03811 | Q29S17 | — | 0 | 0.33 | 0.16 | 0.05 | 0.09 | 0.05 | 0.00 | 0.04 | 0.09 | 0.03 | 0.05 | 0.03 | 0.04 | 0.15 |
| SEQID-03812 | — | — | 0 | 0.36 | 0.20 | 0.04 | 0.10 | 0.00 | 0.03 | 0.02 | 0.07 | 0.01 | 0.05 | 0.02 | 0.08 | 0.05 |

TABLE 1-continued

| | | | | | | | | | | | | | | | |
|---|---|---|---|---|---|---|---|---|---|---|---|---|---|---|---|
| SEQID-03812 | Q2KU9 | — | 0 | 0.33 | 0.12 | 0.02 | 0.02 | 0.02 | 0.01 | 0.04 | 0.23 | 0.02 | 0.02 | 0.02 | 0.07 | 0.08 |
| SEQID-03813 | Q2KJD8 | — | 0 | 0.36 | 0.22 | 0.11 | 0.03 | 0.10 | 0.00 | 0.03 | 0.06 | 0.06 | 0.04 | 0.01 | 0.14 | 0.00 |
| SEQID-03814 | Q2L961 | — | 0 | 0.58 | 0.16 | 0.06 | 0.06 | 0.02 | 0.00 | 0.02 | 0.02 | 0.02 | 0.04 | 0.07 | 0.07 | 0.23 |
| SEQID-03815 | Q2MID0 | — | 0 | 0.55 | 0.24 | 0.01 | 0.05 | 0.02 | 0.02 | 0.06 | 0.07 | 0.02 | 0.04 | 0.00 | 0.12 | 0.16 |
| SEQID-03816 | Q2PMN0 | — | 0 | 0.60 | 0.12 | 0.03 | 0.05 | 0.00 | 0.00 | 0.02 | 0.00 | 0.02 | 0.00 | 0.05 | 0.05 | 0.23 |
| SEQID-03817 | Q2PMN9 | — | 0 | 0.48 | 0.22 | 0.00 | 0.03 | 0.04 | 0.02 | 0.07 | 0.06 | 0.06 | 0.02 | 0.09 | 0.09 | 0.14 |
| SEQID-03818 | Q2PMP7 | — | 1 | 0.48 | 0.25 | 0.03 | 0.06 | 0.03 | 0.00 | 0.08 | 0.06 | 0.05 | 0.01 | 0.10 | 0.05 | 0.12 |
| SEQID-03819 | Q2TBJ3 | — | 1 | 0.51 | 0.20 | 0.03 | 0.06 | 0.06 | 0.01 | 0.00 | 0.06 | 0.01 | 0.02 | 0.07 | 0.08 | 0.07 |
| SEQID-03820 | Q2V2P1 | — | 0 | 0.48 | 0.13 | 0.05 | 0.08 | 0.10 | 0.01 | 0.11 | 0.14 | 0.00 | 0.02 | 0.05 | 0.06 | 0.07 |
| SEQID-03821 | Q32KM6 | — | 1 | 0.41 | 0.11 | 0.02 | 0.05 | 0.07 | 0.00 | 0.06 | 0.13 | 0.07 | 0.02 | 0.05 | 0.04 | 0.12 |
| SEQID-03822 | Q32KN2 | — | 1 | 0.44 | 0.17 | 0.02 | 0.07 | 0.04 | 0.00 | 0.00 | 0.08 | 0.03 | 0.04 | 0.04 | 0.10 | 0.08 |
| SEQID-03823 | Q32LI5 | — | 1 | 0.45 | 0.13 | 0.03 | 0.04 | 0.05 | 0.00 | 0.04 | 0.09 | 0.04 | 0.04 | 0.04 | 0.02 | 0.08 |
| SEQID-03824 | Q32II0 | — | 0 | 0.39 | 0.11 | 0.05 | 0.10 | 0.06 | 0.01 | 0.07 | 0.10 | 0.03 | 0.01 | 0.03 | 0.04 | 0.14 |
| SEQID-03825 | Q32PA2 | — | 0 | 0.36 | 0.12 | 0.04 | 0.03 | 0.05 | 0.02 | 0.16 | 0.15 | 0.06 | 0.00 | 0.03 | 0.04 | 0.15 |
| SEQID-03826 | Q32PA4 | — | 1 | 0.28 | 0.17 | 0.06 | 0.04 | 0.10 | 0.00 | 0.09 | 0.30 | 0.05 | 0.03 | 0.00 | 0.08 | 0.06 |
| SEQID-03827 | Q32PD7 | — | 0 | 0.38 | 0.17 | 0.06 | 0.06 | 0.05 | 0.00 | 0.05 | 0.06 | 0.05 | 0.04 | 0.07 | 0.02 | 0.09 |
| SEQID-03828 | Q332T8 | — | 1 | 0.42 | 0.16 | 0.08 | 0.00 | 0.04 | 0.00 | 0.02 | 0.10 | 0.05 | 0.04 | 0.02 | 0.02 | 0.04 |
| SEQID-03829 | Q3E742 | — | 1 | 0.49 | 0.24 | 0.03 | 0.03 | 0.05 | 0.01 | 0.08 | 0.08 | 0.04 | 0.02 | 0.07 | 0.09 | 0.10 |
| SEQID-03830 | Q3E764 | — | 1 | 0.54 | 0.12 | 0.04 | 0.04 | 0.07 | 0.03 | 0.05 | 0.08 | 0.03 | 0.02 | 0.15 | 0.06 | 0.30 |
| SEQID-03831 | Q3E807 | — | 0 | 0.52 | 0.11 | 0.02 | 0.02 | 0.02 | 0.00 | 0.00 | 0.03 | 0.03 | 0.05 | 0.01 | 0.06 | 0.31 |
| SEQID-03832 | Q3I5G7 | — | 1 | 0.56 | 0.17 | 0.07 | 0.06 | 0.07 | 0.00 | 0.11 | 0.04 | 0.06 | 0.00 | 0.03 | 0.07 | 0.12 |
| SEQID-03833 | Q3MIC0 | — | 0 | 0.44 | 0.17 | 0.01 | 0.05 | 0.03 | 0.02 | 0.03 | 0.04 | 0.01 | 0.05 | 0.08 | 0.08 | 0.13 |
| SEQID-03834 | Q3VZL1 | — | 1 | 0.49 | 0.26 | 0.09 | 0.02 | 0.05 | 0.00 | 0.05 | 0.17 | 0.07 | 0.03 | 0.02 | 0.03 | 0.19 |
| SEQID-03835 | Q35WY1 | — | 1 | 0.39 | 0.16 | 0.06 | 0.00 | 0.01 | 0.04 | 0.02 | 0.03 | 0.05 | 0.03 | 0.06 | 0.03 | 0.09 |
| SEQID-03836 | Q3T051 | — | 0 | 0.54 | 0.16 | 0.06 | 0.00 | 0.03 | 0.02 | 0.04 | 0.09 | 0.05 | 0.05 | 0.01 | 0.11 | 0.16 |
| SEQID-03837 | Q3T0F2 | — | 1 | 0.55 | 0.12 | 0.01 | 0.03 | 0.02 | 0.00 | 0.02 | 0.00 | 0.02 | 0.04 | 0.07 | 0.05 | 0.18 |
| SEQID-03838 | Q3V4Y6 | — | 1 | 0.55 | 0.18 | 0.04 | 0.05 | 0.05 | 0.00 | 0.06 | 0.06 | 0.04 | 0.07 | 0.04 | 0.08 | 0.07 |
| SEQID-03839 | Q3V500 | — | 0 | 0.57 | 0.13 | 0.05 | 0.04 | 0.10 | 0.00 | 0.08 | 0.07 | 0.06 | 0.00 | 0.03 | 0.03 | 0.24 |
| SEQID-03840 | Q3ZBD4 | — | 0 | 0.42 | 0.22 | 0.02 | 0.05 | 0.28 | 0.07 | 0.04 | 0.11 | 0.03 | 0.12 | 0.15 | 0.03 | 0.14 |
| SEQID-03841 | Q41784 | — | 0 | 0.35 | 0.16 | 0.06 | 0.06 | 0.07 | 0.01 | 0.06 | 0.00 | 0.03 | 0.03 | 0.09 | 0.04 | 0.12 |
| SEQID-03842 | Q4VZK0 | — | 1 | 0.43 | 0.17 | 0.04 | 0.04 | 0.05 | 0.02 | 0.05 | 0.12 | 0.04 | 0.00 | 0.04 | 0.08 | 0.04 |
| SEQID-03843 | Q4VZL1 | — | 0 | 0.49 | 0.26 | 0.02 | 0.02 | 0.17 | 0.01 | 0.18 | 0.10 | 0.04 | 0.02 | 0.15 | 0.08 | 0.07 |
| SEQID-03844 | Q4VZN0 | — | 1 | 0.49 | 0.22 | 0.00 | 0.00 | 0.12 | 0.00 | 0.01 | 0.05 | 0.02 | 0.03 | 0.02 | 0.12 | 0.16 |
| SEQID-03845 | Q5E9A0 | — | 1 | 0.48 | 0.25 | 0.03 | 0.02 | 0.08 | 0.04 | 0.05 | 0.08 | 0.03 | 0.03 | 0.14 | 0.06 | 0.09 |
| SEQID-03846 | Q5EAE6 | — | 0 | 0.37 | 0.15 | 0.05 | 0.03 | 0.02 | 0.03 | 0.08 | 0.07 | 0.05 | 0.04 | 0.06 | 0.07 | 0.18 |
| SEQID-03847 | Q5F3Z5 | — | 1 | 0.41 | 0.10 | 0.06 | 0.00 | 0.06 | 0.00 | 0.04 | 0.08 | 0.04 | 0.09 | 0.02 | 0.01 | 0.11 |
| SEQID-03848 | Q5FIW8 | — | 1 | 0.40 | 0.10 | 0.04 | 0.04 | 0.08 | 0.00 | 0.06 | 0.07 | 0.06 | 0.02 | 0.05 | 0.05 | 0.09 |
| SEQID-03849 | Q5FKE7 | — | 0 | 0.58 | 0.07 | 0.05 | 0.05 | 0.10 | 0.01 | 0.07 | 0.11 | 0.03 | 0.12 | 0.01 | 0.03 | 0.18 |
| SEQID-03850 | Q5FM68 | — | 1 | 0.32 | 0.10 | 0.02 | 0.01 | 0.20 | 0.01 | 0.00 | 0.00 | 0.00 | 0.01 | 0.01 | 0.03 | 0.04 |
| SEQID-03851 | Q5FM86 | — | 0 | 0.52 | 0.16 | 0.05 | 0.02 | 0.07 | 0.00 | 0.05 | 0.11 | 0.03 | 0.09 | 0.05 | 0.07 | 0.17 |
| SEQID-03852 | Q5SMI4 | — | 1 | 0.55 | 0.17 | 0.02 | 0.05 | 0.14 | 0.07 | 0.06 | 0.03 | 0.00 | 0.05 | 0.05 | 0.00 | 0.13 |
| SEQID-03853 | Q5ZMM5 | — | 0 | 0.53 | 0.10 | 0.05 | 0.02 | 0.07 | 0.22 | 0.04 | 0.02 | 0.01 | 0.04 | 0.07 | 0.04 | 0.16 |
| SEQID-03854 | Q5ZMN0 | — | 0 | 0.46 | 0.09 | 0.08 | 0.04 | 0.22 | 0.04 | 0.04 | 0.00 | 0.03 | 0.05 | 0.03 | 0.03 | 0.16 |
| SEQID-03855 | Q6SMX0 | — | 1 | 0.34 | 0.20 | 0.01 | 0.02 | 0.04 | 0.05 | 0.18 | 0.05 | 0.23 | 0.01 | 0.03 | 0.14 | 0.19 |
| SEQID-03856 | Q66QC7 | — | 0 | 0.46 | 0.16 | 0.05 | 0.14 | 0.05 | 0.06 | 0.01 | 0.23 | 0.06 | 0.03 | 0.04 | 0.12 | 0.06 |
| SEQID-03857 | Q6RFL5 | — | 1 | 0.09 | 0.06 | 0.00 | 0.08 | 0.65 | 0.00 | 0.05 | 0.06 | 0.06 | 0.00 | 0.00 | 0.06 | 0.07 |
| SEQID-03858 | Q74IL4 | — | 0 | 0.44 | 0.18 | 0.05 | 0.02 | 0.09 | 0.00 | 0.04 | 0.10 | 0.00 | 0.09 | 0.03 | 0.02 | 0.00 |
| SEQID-03859 | Q74L00 | — | 1 | 0.59 | 0.21 | 0.03 | 0.03 | 0.01 | 0.00 | 0.02 | 0.10 | 0.02 | 0.04 | 0.05 | 0.12 | 0.06 |
| SEQID-03860 | Q74LZ9 | — | 0 | 0.49 | 0.16 | 0.07 | 0.05 | 0.03 | 0.09 | 0.04 | 0.10 | 0.04 | 0.05 | 0.05 | 0.02 | 0.22 |
| SEQID-03861 | Q7DMN9 | — | 1 | 0.53 | 0.17 | 0.06 | 0.06 | 0.05 | 0.13 | 0.04 | 0.18 | 0.05 | 0.06 | 0.05 | 0.07 | 0.14 |
| SEQID-03862 | Q7M2P1 | — | 0 | 0.45 | 0.10 | 0.03 | 0.03 | 0.21 | 0.01 | 0.05 | 0.05 | 0.06 | 0.08 | 0.07 | 0.04 | 0.29 |
| SEQID-03863 | Q7XC27 | — | 1 | 0.49 | 0.21 | 0.02 | 0.01 | 0.08 | 0.00 | 0.06 | 0.03 | 0.07 | 0.02 | 0.04 | 0.04 | 0.08 |
| SEQID-03864 | Q7YQJ3 | — | 0 | 0.50 | 0.13 | 0.03 | 0.05 | 0.03 | 0.13 | 0.02 | 0.10 | 0.01 | 0.01 | 0.07 | 0.01 | 0.22 |
| | Q88VD4 | — | 0 | 0.27 | 0.13 | 0.06 | 0.06 | 0.08 | 0.01 | 0.05 | 0.15 | 0.02 | 0.00 | 0.04 | 0.09 | 0.07 |
| | | | 0 | 0.44 | 0.14 | 0.15 | 0.08 | 0.12 | 0.00 | 0.01 | 0.03 | 0.01 | 0.05 | 0.05 | 0.04 | 0.03 |
| | | | | | | | | | | | | | | | | 0.17 |

TABLE 1-continued

| SEQID | | M | F | P | S | T | W | Y | V | SolveScore (pH 7) | AggScore | NetChg (pH 7) | pI | Allergen Homology | Allergenicity | Toxicity | Antinutricity |
|---|---|---|---|---|---|---|---|---|---|---|---|---|---|---|---|---|---|
| SEQID-03865 | Q88WD3 | — | | | 0.50 | 0.12 | | 0.06 | 0.04 | 0.01 | | | 0.10 | 0.04 | 0.00 | 0.04 | 0.27 |
| SEQID-03866 | Q88WM6 | — | | 0 | 0.40 | 0.18 | | 0.06 | 0.04 | 0.07 | 0.00 | 0.05 | 0.17 | 0.03 | 0.01 | 0.12 | 0.06 |
| SEQID-03867 | Q88WN5 | — | | 0 | 0.55 | 0.19 | | 0.06 | 0.04 | 0.07 | 0.00 | 0.07 | 0.05 | 0.06 | 0.02 | 0.01 | 0.16 |
| SEQID-03868 | Q88WU7 | — | | 0 | 0.59 | 0.12 | | 0.07 | 0.13 | 0.00 | 0.07 | 0.00 | 0.07 | 0.02 | 0.06 | 0.05 | 0.05 | 0.24 |
| SEQID-03869 | Q88XY2 | — | | 0 | 0.57 | 0.17 | | 0.03 | 0.08 | 0.03 | 0.10 | 0.02 | 0.02 | 0.01 | 0.07 | 0.05 | 0.04 | 0.15 |
| SEQID-03870 | Q88YP9 | — | | 0 | 0.52 | 0.14 | 0.01 | 0.06 | 0.01 | 0.00 | 0.00 | 0.07 | 0.01 | 0.04 | 0.02 | 0.05 | 0.11 |
| SEQID-03871 | Q8G435 | — | | 1 | 0.47 | 0.12 | 0.01 | 0.03 | 0.19 | 0.04 | 0.10 | 0.06 | 0.11 | 0.03 | 0.02 | 0.09 | 0.05 | 0.12 |
| SEQID-03872 | Q8GC82 | — | | 0 | 0.44 | 0.20 | 0.03 | 0.03 | 0.00 | 0.12 | 0.03 | 0.00 | 0.02 | 0.08 | 0.03 | 0.04 | 0.05 | 0.08 |
| SEQID-03873 | Q8HY9 | — | | 0 | 0.26 | 0.16 | | 0.06 | 0.11 | 0.05 | 0.06 | 0.04 | 0.01 | 0.04 | 0.12 | 0.05 | 0.10 | 0.00 |
| SEQID-03874 | Q8TGT3 | — | | 0 | 0.62 | 0.22 | 0.01 | 0.00 | 0.12 | 0.02 | 0.10 | 0.03 | 0.03 | 0.06 | 0.05 | 0.06 | 0.11 | 0.16 |
| SEQID-03875 | Q8TGU1 | — | | 0 | 0.43 | 0.17 | 0.03 | 0.00 | 0.06 | 0.09 | 0.03 | 0.04 | 0.02 | 0.15 | 0.05 | 0.04 | 0.11 | 0.14 |
| SEQID-03876 | Q8TGV0 | — | | 0 | 0.26 | 0.14 | | 0.00 | 0.28 | 0.03 | 0.00 | 0.04 | 0.04 | 0.00 | 0.03 | 0.05 | 0.10 | 0.04 |
| SEQID-03877 | Q90953 | — | | 1 | 0.45 | 0.18 | | 0.04 | 0.04 | 0.03 | 0.06 | 0.01 | 0.03 | 0.12 | 0.03 | 0.05 | 0.06 | 0.06 |
| SEQID-03878 | Q96386 | — | | 0 | 0.39 | 0.09 | | 0.05 | 0.00 | 0.05 | 0.10 | 0.15 | 0.02 | 0.06 | 0.04 | 0.00 | 0.00 | 0.11 |
| SEQID-03879 | Q98TFS | — | | 0 | 0.56 | 0.12 | 0.01 | 0.01 | 0.20 | 0.05 | 0.00 | 0.00 | 0.06 | 0.00 | 0.04 | 0.07 | 0.05 | 0.20 |
| SEQID-03880 | Q9DET5 | — | | 0 | 0.52 | 0.12 | | 0.03 | 0.00 | 0.09 | 0.00 | 0.04 | 0.04 | 0.20 | 0.04 | 0.04 | 0.06 | 0.27 |
| SEQID-03881 | Q9N250 | — | | 0 | 0.49 | 0.20 | | 0.09 | 0.00 | 0.03 | 0.03 | 0.07 | 0.06 | 0.19 | 0.00 | 0.02 | 0.01 | 0.15 |
| SEQID-03882 | Q9P305 | — | | 0 | 0.39 | 0.18 | 0.04 | 0.04 | 0.10 | 0.06 | 0.08 | 0.00 | 0.04 | 0.04 | 0.00 | 0.05 | 0.09 | 0.11 |
| SEQID-03883 | Q9SP22 | — | | 1 | 0.44 | 0.14 | 0.01 | 0.05 | 0.02 | 0.03 | 0.14 | 0.00 | 0.03 | 0.12 | 0.03 | 0.03 | 0.05 | 0.14 |
| SEQID-03884 | Q9URQ5 | — | | 0 | 0.42 | 0.19 | | 0.02 | 0.10 | 0.14 | 0.01 | 0.00 | 0.06 | 0.13 | 0.00 | 0.01 | 0.12 | 0.08 |
| SEQID-03885 | Q9XSK7 | — | | 1 | 0.34 | 0.09 | | 0.05 | 0.06 | 0.03 | 0.05 | 0.01 | 0.02 | 0.23 | 0.05 | 0.02 | 0.06 | 0.13 |
| SEQID-03886 | Q9ZT46 | — | | 0 | 0.50 | 0.20 | 0.01 | 0.03 | 0.04 | 0.04 | 0.08 | 0.00 | 0.05 | 0.07 | 0.06 | 0.04 | 0.07 | 0.10 |
| SEQID-03887 | Q9ZT47 | — | | 0 | 0.51 | 0.18 | | 0.02 | 0.03 | 0.04 | 0.04 | 0.00 | 0.02 | 0.08 | 0.07 | 0.06 | 0.07 | 0.12 |
| SEQID-03888 | Q9ZZV8 | — | | 0 | 0.39 | 0.07 | | 0.02 | 0.16 | 0.08 | 0.02 | 0.01 | 0.01 | 0.02 | 0.04 | 0.06 | 0.02 | 0.13 |
| SEQID-03889 | W5PEW5 | — | | 1 | 0.42 | 0.20 | | 0.03 | 0.06 | 0.04 | 0.00 | 0.00 | 0.10 | 0.18 | 0.01 | 0.02 | 0.13 | 0.11 |
| SEQID-03890 | Q2YDE5 | 6:66 | | 0 | 0.45 | 0.23 | | 0.00 | 0.09 | 0.08 | 0.02 | 0.06 | 0.04 | 0.02 | 0.22 | 0.16 | 0.00 | 0.02 |
| SEQID-03891 | Q06698 | 151:201 | | 0 | 0.57 | 0.16 | | 0.00 | 0.07 | 0.00 | 0.00 | 0.13 | 0.10 | 0.02 | 0.13 | 0.14 | 0.06 | 0.01 | 0.07 |
| SEQID-03892 | P53061 | 251:301 | | 0 | 0.57 | 0.14 | | 0.00 | 0.00 | 0.00 | 0.04 | 0.05 | 0.05 | 0.05 | 0.07 | 0.14 | 0.02 | 0.01 | 0.11 |
| SEQID-03893 | P53061 | 251:306 | | 0 | 0.56 | 0.14 | | 0.00 | 0.07 | 0.00 | 0.02 | 0.05 | 0.04 | 0.09 | 0.08 | 0.24 | 0.02 | 0.01 | 0.10 |
| SEQID-03894 | P53061 | 251:311 | | 0 | 0.56 | 0.16 | | 0.00 | 0.06 | 0.00 | 0.02 | 0.08 | 0.04 | 0.00 | 0.10 | 0.23 | 0.02 | 0.01 | 0.10 |
| SEQID-03895 | P53061 | 251:316 | | 0 | 0.57 | 0.17 | | 0.00 | 0.06 | 0.00 | 0.02 | 0.08 | 0.04 | 0.04 | 0.11 | 0.22 | 0.02 | 0.01 | 0.09 |
| SEQID-03896 | Q90980 | 381:431 | | 0 | 0.58 | 0.26 | | 0.00 | 0.06 | 0.05 | 0.04 | 0.07 | 0.04 | 0.01 | 0.11 | 0.16 | 0.06 | 0.01 | 0.02 |
| SEQID-03897 | Q00194 | 426:476 | | 0 | 0.60 | 0.24 | | 0.00 | 0.03 | 0.04 | 0.00 | 0.09 | 0.10 | 0.07 | 0.11 | 0.16 | 0.02 | 0.03 | 0.02 |
| SEQID-03898 | Q00194 | 426:481 | | 0 | 0.59 | 0.24 | | 0.00 | 0.03 | 0.07 | 0.00 | 0.10 | 0.09 | 0.05 | 0.10 | 0.18 | 0.02 | 0.03 | 0.04 |
| SEQID-03899 | Q90805 | 466:521 | | 0 | 0.67 | 0.24 | | 0.00 | 0.07 | 0.02 | 0.00 | 0.00 | 0.05 | 0.07 | 0.12 | 0.17 | 0.02 | 0.02 | 0.07 |
| SEQID-03900 | Q3SZ12 | 86:136 | | 0 | 0.57 | 0.21 | | 0.00 | 0.06 | 0.04 | 0.04 | 0.04 | 0.00 | 0.03 | 0.05 | 0.21 | 0.04 | 0.03 | 0.11 |
| SEQID-03901 | P04467 | 121:171 | | 0 | 0.56 | 0.25 | | 0.00 | 0.08 | 0.02 | 0.04 | 0.12 | 0.10 | 0.09 | 0.23 | 0.15 | 0.04 | 0.03 | 0.10 |
| SEQID-03902 | Q0P584 | 166:216 | | 0 | 0.51 | 0.23 | | 0.01 | 0.02 | 0.03 | 0.02 | 0.06 | 0.00 | 0.00 | 0.22 | 0.14 | 0.04 | 0.04 | 0.05 |
| SEQID-03903 | Q2NL14 | 211:261 | | 0 | 0.52 | 0.24 | | 0.00 | 0.04 | 0.04 | 0.04 | 0.00 | 0.00 | 0.00 | 0.22 | 0.17 | 0.04 | 0.02 | 0.02 |
| SEQID-03904 | Q10MN8 | 211:276 | | 0 | 0.32 | 0.25 | 0.01 | 0.03 | 0.01 | 0.05 | 0.04 | 0.06 | 0.20 | 0.01 | 0.22 | 0.00 | 0.00 | 0.09 | 0.02 |
| SEQID-03905 | P58797 | 266:316 | | 0 | 0.47 | 0.31 | | 0.02 | 0.06 | 0.08 | 0.00 | 0.06 | 0.20 | 0.00 | 0.26 | 0.16 | 0.02 | 0.05 | 0.00 |
| SEQID-03906 | A7A1V1 | 41:91 | | 0 | 0.49 | 0.33 | | 0.02 | 0.06 | 0.03 | 0.02 | 0.08 | 0.08 | 0.07 | 0.24 | 0.08 | 0.00 | 0.00 | 0.00 |
| SEQID-03907 | P50275 | 491:546 | | 0 | 0.47 | 0.27 | | 0.00 | 0.03 | 0.04 | 0.04 | 0.09 | 0.13 | 0.03 | 0.22 | 0.08 | 0.00 | 0.01 | 0.07 |
| SEQID-03908 | Q60CZ8 | 591:646 | | 0 | 0.42 | 0.29 | 0.01 | 0.00 | 0.03 | 0.00 | 0.16 | 0.05 | 0.04 | 0.22 | 0.04 | 0.02 | 0.03 | 0.00 |
| SEQID-03909 | Q9AWA5 | 821:876 | | 0 | 0.45 | 0.30 | 0.03 | 0.01 | 0.05 | 0.01 | 0.02 | 0.09 | 0.14 | 0.02 | 0.22 | 0.06 | 0.00 | 0.03 | 0.02 |

| SEQID | | M | F | P | S | T | W | Y | V | SolveScore (pH 7) | AggScore | NetChg (pH 7) | pI | Allergen Homology | Allergenicity | Toxicity | Antinutricity |
|---|---|---|---|---|---|---|---|---|---|---|---|---|---|---|---|---|---|
| SEQID-00001 | | 0.05 | 0.07 | 0.03 | 0.50 | 0.04 | 0.01 | 0.04 | 0.07 | −18.29 | 0.50 | −0.03 | 4.96 | 1.00 | 1.00 | 0.20 | 0.42 |
| SEQID-00002 | | 0.02 | 0.06 | 0.05 | 0.40 | 0.03 | 0.01 | 0.03 | 0.05 | −18.75 | 0.40 | −0.01 | 5.25 | 1.00 | 1.00 | 0.19 | 0.21 |
| SEQID-00003 | | 0.03 | 0.03 | 0.04 | 0.55 | 0.05 | 0.03 | 0.03 | 0.04 | −20.98 | 0.56 | −0.04 | 4.66 | 1.00 | 1.00 | 0.00 | 0.24 |

TABLE 1-continued

| | | | | | | | | | | | | | | | |
|---|---|---|---|---|---|---|---|---|---|---|---|---|---|---|---|
| SEQID-00004 | 0.03 | 0.05 | 0.07 | 0.06 | 0.02 | 0.02 | 0.07 | 0.05 | 0.32 | -21.19 | -0.05 | 4.70 | 1.00 | 1.00 | 0.23 | 0.23 |
| SEQID-00005 | 0.04 | 0.05 | 0.14 | 0.06 | 0.04 | 0.01 | 0.03 | 0.08 | 0.50 | -15.50 | -0.03 | 5.06 | 1.00 | 1.00 | 0.24 | 0.12 |
| SEQID-00006 | 0.02 | 0.05 | 0.01 | 0.05 | 0.05 | 0.05 | 0.04 | 0.05 | 0.44 | -20.52 | -0.04 | 4.73 | 1.00 | 1.00 | 0.26 | 0.25 |
| SEQID-00007 | 0.00 | 0.02 | 0.01 | 0.03 | 0.00 | 0.00 | 0.15 | 0.03 | 0.31 | -28.17 | 0.00 | 6.98 | 0.29 | 0.19 | 0.37 | 0.33 |
| SEQID-00008 | 0.05 | 0.08 | 0.01 | 0.04 | 0.05 | 0.00 | 0.02 | 0.05 | 0.22 | -30.62 | -0.21 | 3.67 | 0.95 | 0.93 | 0.23 | 0.00 |
| SEQID-00009 | 0.02 | 0.02 | 0.03 | 0.03 | 0.03 | 0.00 | 0.00 | 0.03 | 0.69 | -38.14 | -0.23 | 3.59 | 0.23 | 0.41 | 0.23 | 0.25 |
| SEQID-00010 | 0.03 | 0.05 | 0.07 | 0.06 | 0.05 | 0.00 | 0.04 | 0.06 | 0.36 | -5.26 | 0.01 | 9.42 | 0.28 | 0.39 | 0.25 | 0.00 |
| SEQID-00011 | 0.03 | 0.07 | 0.04 | 0.03 | 0.00 | 0.01 | 0.07 | 0.06 | 0.11 | -21.57 | -0.02 | 5.81 | 0.25 | 0.32 | 0.24 | 0.00 |
| SEQID-00012 | 0.00 | 0.02 | 0.01 | 0.03 | 0.00 | 0.00 | 0.15 | 0.03 | 0.11 | -28.17 | 0.00 | 6.98 | 0.29 | 0.19 | 0.37 | 0.33 |
| SEQID-00013 | 0.00 | 0.02 | 0.02 | 0.03 | 0.00 | 0.00 | 0.16 | 0.03 | 0.12 | -27.17 | 0.00 | 7.00 | 0.30 | 0.19 | 0.38 | 0.34 |
| SEQID-00014 | 0.00 | 0.02 | 0.02 | 0.02 | 0.00 | 0.00 | 0.13 | 0.03 | 0.11 | -28.08 | 0.02 | 7.69 | 0.31 | 0.20 | 0.38 | 0.31 |
| SEQID-00015 | 0.00 | 0.03 | 0.02 | 0.03 | 0.00 | 0.00 | 0.14 | 0.04 | 0.12 | -27.01 | 0.02 | 7.75 | 0.31 | 0.20 | 0.38 | 0.28 |
| SEQID-00016 | 0.05 | 0.03 | 0.04 | 0.04 | 0.04 | 0.02 | 0.03 | 0.02 | 0.65 | -20.72 | -0.13 | 3.73 | 0.40 | 0.13 | 0.26 | 0.25 |
| SEQID-00017 | 0.05 | 0.10 | 0.04 | 0.05 | 0.02 | 0.02 | 0.06 | 0.04 | 0.63 | -19.76 | -0.12 | 3.86 | 0.48 | 0.44 | 0.00 | 0.30 |
| SEQID-00018 | 0.04 | 0.06 | 0.00 | 0.05 | 0.02 | 0.05 | 0.08 | 0.02 | 0.50 | -20.08 | 0.25 | 12.35 | 0.22 | 0.51 | 0.00 | 0.24 |
| SEQID-00019 | 0.00 | 0.10 | 0.00 | 0.00 | 0.05 | 0.02 | 0.00 | 0.06 | 0.34 | -27.12 | 0.37 | 13.67 | 0.26 | 0.24 | 0.00 | 0.26 |
| SEQID-00020 | 0.03 | 0.10 | 0.03 | 0.05 | 0.03 | 0.00 | 0.04 | 0.05 | 0.39 | -19.74 | 0.13 | 1065 | 0.42 | 0.23 | 0.25 | 0.25 |
| SEQID-00021 | 0.02 | 0.00 | 0.05 | 0.06 | 0.03 | 0.03 | 0.12 | 0.07 | 0.43 | -17.96 | 0.12 | 10.56 | 0.26 | 0.47 | 0.25 | 0.26 |
| SEQID-00022 | 0.03 | 0.05 | 0.08 | 0.05 | 0.04 | 0.00 | 0.05 | 0.06 | 0.72 | -4.43 | 0.01 | 8.97 | 0.29 | 0.30 | 0.25 | 0.00 |
| SEQID-00023 | 0.01 | 0.01 | 0.06 | 0.06 | 0.00 | 0.00 | 0.03 | 0.05 | 0.79 | -6.27 | 0.02 | 9.33 | 0.36 | 0.39 | 0.00 | 0.00 |
| SEQID-00024 | 0.00 | 0.07 | 0.04 | 0.02 | 0.06 | 0.00 | 0.00 | 0.10 | 0.80 | -15.79 | -0.03 | 4.45 | 0.28 | 0.31 | 0.00 | 1.00 |
| SEQID-00025 | 0.00 | 0.05 | 0.03 | 0.06 | 0.04 | 0.02 | 0.00 | 0.03 | 0.84 | -16.50 | 0.08 | 3.94 | 0.25 | 0.29 | 0.00 | 1.00 |
| SEQID-00026 | 0.00 | 0.05 | 0.00 | 0.00 | 0.00 | 0.00 | 0.00 | 0.03 | 2.04 | -9.16 | -0.04 | 4.15 | 0.28 | 0.32 | 0.00 | 0.26 |
| SEQID-00027 | 0.02 | 0.02 | 0.00 | 0.04 | 0.03 | 0.07 | 0.12 | 0.09 | 0.80 | -16.31 | -0.05 | 4.39 | 0.23 | 0.32 | 0.00 | 0.00 |
| SEQID-00028 | 0.00 | 0.03 | 0.03 | 0.08 | 0.05 | 0.00 | 0.03 | 0.15 | 1.00 | -21.97 | -0.25 | 3.10 | 0.28 | 0.30 | 0.00 | 0.25 |
| SEQID-00029 | 0.03 | 0.01 | 0.01 | 0.04 | 0.02 | 0.00 | 0.13 | 0.06 | 0.41 | -24.09 | -0.12 | 3.93 | 0.00 | 0.31 | 0.00 | 0.00 |
| SEQID-00030 | 0.00 | 0.00 | 0.00 | 0.00 | 0.03 | 0.00 | 0.05 | 0.05 | 0.16 | -28.44 | -0.04 | 4.97 | 0.33 | 0.36 | 0.00 | 0.00 |
| SEQID-00031 | 0.00 | 0.00 | 0.00 | 0.02 | 0.04 | 0.00 | 0.01 | 0.04 | 0.16 | -36.33 | -0.04 | 4.90 | 0.32 | 0.33 | 0.00 | 0.00 |
| SEQID-00032 | 0.02 | 0.00 | 0.00 | 0.03 | 0.06 | 0.02 | 0.01 | 0.03 | 0.22 | -36.17 | -0.12 | 4.27 | 0.30 | 0.35 | 0.25 | 0.27 |
| SEQID-00033 | 0.02 | 0.00 | 0.01 | 0.04 | 0.06 | 0.01 | 0.01 | 0.07 | 0.49 | -27.36 | 0.01 | 8.97 | 0.34 | 0.34 | 0.00 | 0.30 |
| SEQID-00034 | 0.04 | 0.00 | 0.03 | 0.05 | 0.05 | 0.03 | 0.03 | 0.04 | 0.58 | -20.74 | 0.00 | 6.54 | 0.84 | 0.94 | 0.29 | 0.28 |
| SEQID-00035 | 0.02 | 0.01 | 0.04 | 0.05 | 0.06 | 0.00 | 0.00 | 0.09 | 0.64 | -18.18 | 0.05 | 10.26 | 0.26 | 0.30 | 0.00 | 0.00 |
| SEQID-00036 | 0.02 | 0.08 | 0.01 | 0.03 | 0.04 | 0.06 | 0.06 | 0.06 | 0.73 | -17.32 | 0.03 | 8.48 | 0.51 | 0.60 | 0.26 | 0.24 |
| SEQID-00037 | 0.06 | 0.07 | 0.00 | 0.00 | 0.10 | 0.05 | 0.00 | 0.09 | 1.56 | -14.15 | 0.19 | 11.98 | 0.14 | 0.26 | 0.23 | 0.24 |
| SEQID-00038 | 0.01 | 0.06 | 0.03 | 0.06 | 0.08 | 0.00 | 0.01 | 0.07 | 0.72 | -19.01 | 0.00 | 7.29 | 0.26 | 0.33 | 0.25 | 0.27 |
| SEQID-00039 | 0.02 | 0.03 | 0.02 | 0.03 | 0.03 | 0.02 | 0.05 | 0.06 | 0.51 | -24.37 | 0.05 | 9.49 | 0.27 | 0.30 | 0.24 | 0.26 |
| SEQID-00040 | 0.00 | 0.08 | 0.04 | 0.04 | 0.02 | 0.03 | 0.03 | 0.11 | 0.77 | -17.17 | -0.03 | 4.50 | 0.27 | 0.31 | 0.00 | 1.00 |
| SEQID-00041 | 0.03 | 0.06 | 0.01 | 0.05 | 0.03 | 0.05 | 0.08 | 0.02 | 0.47 | -21.00 | 0.22 | 12.17 | 0.19 | 0.25 | 0.00 | 0.00 |
| SEQID-00042 | 0.01 | 0.04 | 0.12 | 0.11 | 0.06 | 0.00 | 0.06 | 0.04 | 0.16 | -24.24 | -0.21 | 3.55 | 0.29 | 0.32 | 0.26 | 0.30 |
| SEQID-00043 | 0.00 | 0.00 | 0.04 | 0.00 | 0.05 | 0.00 | 0.00 | 0.11 | 0.99 | -17.59 | -0.02 | 4.77 | 0.32 | 0.20 | 0.00 | 1.00 |
| SEQID-00044 | 0.00 | 0.05 | 0.03 | 0.00 | 0.00 | 0.00 | 0.00 | 0.11 | 1.04 | -17.59 | -0.12 | 4.77 | 0.32 | 0.20 | 0.00 | 1.00 |
| SEQID-00045 | 0.00 | 0.03 | 0.03 | 0.02 | 0.05 | 0.05 | 0.00 | 0.10 | 0.93 | -18.20 | -0.04 | 4.46 | 0.32 | 0.21 | 0.00 | 1.00 |
| SEQID-00046 | 0.00 | 0.03 | 0.03 | 0.02 | 0.00 | 0.00 | 0.00 | 0.10 | 0.92 | -18.55 | -0.04 | 4.46 | 0.33 | 0.21 | 0.33 | 1.00 |
| SEQID-00047 | 0.00 | 0.03 | 0.04 | 0.02 | 0.06 | 0.00 | 0.00 | 0.11 | 1.04 | -16.30 | -0.04 | 4.39 | 0.35 | 0.22 | 0.00 | 1.00 |
| SEQID-00048 | 0.00 | 0.00 | 0.00 | 0.04 | 0.00 | 0.05 | 0.00 | 0.00 | 0.00 | -4.65 | 0.64 | 13.78 | 0.38 | 0.15 | 0.44 | 0.39 |
| SEQID-00049 | 0.02 | 0.06 | 0.05 | 0.02 | 0.07 | 0.05 | 0.05 | 0.06 | 0.30 | -21.74 | -0.01 | 6.61 | 0.23 | 0.31 | 0.23 | 0.00 |
| SEQID-00050 | 0.02 | 0.10 | 0.09 | 0.00 | 0.02 | 0.01 | 0.00 | 0.09 | 0.92 | -16.62 | 0.05 | 9.51 | 1.00 | 0.63 | 0.00 | 0.34 |
| SEQID-00051 | 0.00 | 0.00 | 0.09 | 0.00 | 0.02 | 0.00 | 0.00 | 0.09 | 0.90 | -17.98 | 0.07 | 10.22 | 1.00 | 0.63 | 0.00 | 0.00 |
| SEQID-00052 | 0.00 | 0.10 | 0.09 | 0.00 | 0.02 | 0.00 | 0.00 | 0.11 | 0.95 | -16.59 | 0.05 | 9.51 | 1.00 | 0.63 | 0.00 | 0.32 |
| SEQID-00053 | 0.00 | 0.10 | 0.09 | 0.00 | 0.02 | 0.00 | 0.00 | 0.11 | 0.87 | -16.79 | 0.05 | 9.51 | 1.00 | 0.63 | 0.00 | 0.33 |
| SEQID-00054 | 0.00 | 0.10 | 0.09 | 0.00 | 0.02 | 0.00 | 0.00 | 0.11 | 0.77 | -18.37 | 0.03 | 8.55 | 1.00 | 0.63 | 0.00 | 0.30 |
| SEQID-00055 | 0.00 | 0.10 | 0.09 | 0.00 | 0.02 | 0.00 | 0.00 | 0.11 | 0.71 | -18.37 | 0.03 | 8.55 | 1.00 | 0.63 | 0.00 | 0.32 |
| SEQID-00056 | 0.00 | 0.00 | 0.05 | 0.09 | 0.00 | 0.00 | 0.08 | 0.08 | 0.21 | -26.42 | -0.04 | 4.99 | 1.00 | 0.63 | 0.26 | 0.00 |

TABLE 1-continued

| | | | | | | | | | | | | | | | | |
|---|---|---|---|---|---|---|---|---|---|---|---|---|---|---|---|---|
| SEQID-00057 | 0.00 | 0.00 | 0.07 | 0.09 | 0.00 | 0.00 | 0.08 | 0.08 | 0.25 | -24.84 | -0.03 | 5.78 | 1.00 | 0.63 | 0.26 | 0.00 |
| SEQID-00058 | 0.00 | 0.00 | 0.07 | 0.07 | 0.00 | 0.00 | 0.08 | 0.08 | 0.20 | -24.93 | -0.02 | 5.78 | 1.00 | 0.63 | 0.26 | 0.00 |
| SEQID-00059 | 0.00 | 0.00 | 0.07 | 0.04 | 0.00 | 0.00 | 0.08 | 0.08 | 0.22 | -26.10 | 0.00 | 7.53 | 1.00 | 0.63 | 0.26 | 0.00 |
| SEQID-00060 | 0.02 | 0.06 | 0.03 | 0.03 | 0.06 | 0.01 | 0.05 | 0.06 | 0.29 | -24.08 | -0.11 | 4.40 | 0.22 | 0.31 | 0.23 | 0.30 |
| SEQID-00061 | 0.02 | 0.06 | 0.03 | 0.03 | 0.05 | 0.01 | 0.05 | 0.06 | 0.25 | -25.02 | 0.16 | 11.10 | 0.32 | 0.30 | 0.23 | 0.00 |
| SEQID-00062 | 0.01 | 0.07 | 0.02 | 0.04 | 0.04 | 0.01 | 0.01 | 0.11 | 1.44 | -10.77 | 0.03 | 8.52 | 0.25 | 0.29 | 0.27 | 0.28 |
| SEQID-00063 | 0.04 | 0.05 | 0.04 | 0.07 | 0.05 | 0.00 | 0.08 | 0.09 | 1.81 | -5.74 | -0.03 | 4.13 | 0.37 | 0.30 | 0.24 | 0.23 |
| SEQID-00064 | 0.02 | 0.06 | 0.03 | 0.07 | 0.04 | 0.01 | 0.10 | 0.06 | 1.66 | -6.82 | -0.04 | 3.88 | 0.23 | 0.28 | 0.22 | 0.23 |
| SEQID-00065 | 0.03 | 0.03 | 0.04 | 0.06 | 0.05 | 0.02 | 0.01 | 0.08 | 1.50 | -5.87 | 0.02 | 10.29 | 0.22 | 0.31 | 0.24 | 0.25 |
| SEQID-00066 | 0.01 | 0.16 | 0.03 | 0.03 | 0.03 | 0.00 | 0.07 | 0.10 | 1.56 | -10.37 | 0.03 | 9.86 | 0.25 | 0.31 | 0.22 | 0.24 |
| SEQID-00067 | 0.02 | 0.05 | 0.03 | 0.05 | 0.05 | 0.01 | 0.07 | 0.09 | 1.69 | -7.86 | 0.03 | 9.42 | 0.23 | 0.29 | 0.22 | 0.24 |
| SEQID-00068 | 0.01 | 0.00 | 0.00 | 0.06 | 0.02 | 0.01 | 0.06 | 0.10 | 0.87 | -21.10 | -0.05 | 4.70 | 0.76 | 0.43 | 0.00 | 0.20 |
| SEQID-00069 | 0.01 | 0.01 | 0.03 | 0.06 | 0.04 | 0.00 | 0.00 | 0.12 | 1.17 | -14.66 | -0.03 | 3.87 | 0.26 | 0.29 | 0.00 | 0.83 |
| SEQID-00070 | 0.01 | 0.03 | 0.03 | 0.06 | 0.04 | 0.00 | 0.03 | 0.09 | 0.91 | -16.34 | -0.08 | 3.94 | 0.23 | 0.28 | 0.00 | 0.95 |
| SEQID-00071 | 0.00 | 0.05 | 0.02 | 0.00 | 0.05 | 0.00 | 0.00 | 0.14 | 1.19 | -17.59 | -0.02 | 4.77 | 0.32 | 0.20 | 0.00 | 0.94 |
| SEQID-00072 | 0.08 | 0.07 | 0.01 | 0.02 | 0.04 | 0.00 | 0.03 | 0.04 | 0.32 | -31.39 | -0.18 | 3.79 | 0.32 | 0.43 | 0.21 | 0.22 |
| SEQID-00073 | 0.03 | 0.05 | 0.00 | 0.02 | 0.03 | 0.01 | 0.01 | 0.05 | 0.32 | -32.67 | -0.10 | 4.22 | 0.39 | 0.54 | 0.26 | 0.25 |
| SEQID-00074 | 0.08 | 0.08 | 0.01 | 0.03 | 0.05 | 0.02 | 0.02 | 0.04 | 0.26 | -30.64 | -0.18 | 3.81 | 0.38 | 0.45 | 0.25 | 0.22 |
| SEQID-00075 | 0.08 | 0.07 | 0.01 | 0.02 | 0.04 | 0.00 | 0.03 | 0.04 | 0.32 | -31.40 | -0.18 | 3.79 | 0.37 | 0.43 | 0.21 | 0.22 |
| SEQID-00076 | 0.08 | 0.07 | 0.01 | 0.04 | 0.04 | 0.00 | 0.03 | 0.04 | 0.32 | -31 40 | -0.18 | 3.79 | 0.37 | 0.43 | 0.21 | 0.22 |
| SEQID-00077 | 0.05 | 0.09 | 0.01 | 0.04 | 0.06 | 0.00 | 0.01 | 0.04 | 0.32 | -29.63 | -0.21 | 3.61 | 1.00 | 1.00 | 0.25 | 0.00 |
| SEQID-00078 | 0.03 | 0.07 | 0.01 | 0.01 | 0.04 | 0.03 | 0.03 | 0.04 | 0.32 | -31.05 | -0.19 | 3.74 | 0.37 | 0.41 | 0.21 | 0.20 |
| SEQID-00079 | 0.04 | 0.07 | 0.08 | 0.03 | 0.02 | 0.03 | 0.03 | 0.06 | 1.21 | -13.19 | 0.09 | 10.26 | 0.32 | 0.21 | 0.27 | 0.28 |
| SEQID-00080 | 0.02 | 0.14 | 0.04 | 0.07 | 0.05 | 0.03 | 0.06 | 0.04 | 1.15 | -9.71 | -0.02 | 5.52 | 0.21 | 0.31 | 0.23 | 0.24 |
| SEQID-00081 | 0.05 | 0.09 | 0.01 | 0.01 | 0.01 | 0.05 | 0.06 | 0.04 | 1.02 | -12.67 | 0.04 | 8.87 | 0.26 | 0.27 | 0.29 | 0.00 |
| SEQID-00082 | 0.02 | 0.03 | 0.04 | 0.05 | 0.04 | 0.03 | 0.02 | 0.08 | 0.85 | -14.94 | 0.03 | 8.78 | 0.00 | 0.33 | 0.23 | 0.23 |
| SEQID-00083 | 0.05 | 0.04 | 0.09 | 0.06 | 0.05 | 0.02 | 0.02 | 0.04 | 0.76 | -15.80 | 0.08 | 10.61 | 0.28 | 0.24 | 0.30 | 0.30 |
| SEQID-00084 | 0.04 | 0.02 | 0.01 | 0.01 | 0.02 | 0.03 | 0.05 | 0.02 | 0.24 | -24.13 | -0.21 | 3.63 | 0.68 | 0.52 | 0.32 | 0.31 |
| SEQID-00085 | 0.05 | 0.07 | 0.02 | 0.07 | 0.05 | 0.00 | 0.04 | 0.08 | 0.38 | -23.50 | -0.09 | 4.29 | 0.37 | 0.46 | 0.00 | 0.18 |
| SEQID-00086 | 0.07 | 0.07 | 0.02 | 0.02 | 0.05 | 0.00 | 0.03 | 0.07 | 0.32 | -23.76 | -0.08 | 4.24 | 0.36 | 0.45 | 0.22 | 0.23 |
| SEQID-00087 | 0.05 | 0.09 | 0.02 | 0.03 | 0.05 | 0.00 | 0.01 | 0.05 | 0.35 | -23.80 | -0.08 | 4.24 | 0.37 | 0.49 | 0.23 | 0.27 |
| SEQID-00088 | 0.05 | 0.06 | 0.07 | 0.08 | 0.02 | 0.02 | 0.08 | 0.02 | 0.39 | -15.45 | -0.08 | 3.93 | 0.29 | 0.32 | 0.00 | 0.34 |
| SEQID-00089 | 0.03 | 0.05 | 0.02 | 0.05 | 0.05 | 0.02 | 0.04 | 0.06 | 0.28 | -23.87 | -0.07 | 4.43 | 0.43 | 0.63 | 0.00 | 0.21 |
| SEQID-00090 | 0.05 | 0.07 | 0.03 | 0.03 | 0.02 | 0.02 | 0.05 | 0.06 | 0.34 | -19.97 | -0.06 | 4.45 | 0.40 | 0.54 | 0.00 | 0.21 |
| SEQID-00091 | 0.03 | 0.06 | 0.04 | 0.05 | 0.06 | 0.02 | 0.05 | 0.07 | 0.44 | -19.21 | -0.05 | 4.51 | 0.92 | 0.99 | 0.00 | 0.00 |
| SEQID-00092 | 0.08 | 0.08 | 0.01 | 0.03 | 0.03 | 0.00 | 0.02 | 0.04 | 0.27 | -30.84 | -0.18 | 3.91 | 0.45 | 0.45 | 0.25 | 0.23 |
| SEQID-00093 | 0.08 | 0.09 | 0.01 | 0.05 | 0.04 | 0.00 | 0.02 | 0.03 | 0.28 | -30.31 | -0.18 | 3.91 | 0.37 | 0.47 | 0.25 | 0.24 |
| SEQID-00094 | 0.09 | 0.09 | 0.01 | 0.03 | 0.04 | 0.00 | 0.02 | 0.03 | 0.30 | -30.14 | -0.18 | 3.81 | 0.38 | 0.47 | 0.25 | 0.23 |
| SEQID-00095 | 0.03 | 0.02 | 0.04 | 0.03 | 0.03 | 0.00 | 0.02 | 0.07 | 0.62 | -21.15 | -0.06 | 3.81 | 0.37 | 0.74 | 0.00 | 0.23 |
| SEQID-00096 | 0.02 | 0.05 | 0.01 | 0.05 | 0.05 | 0.05 | 0.04 | 0.05 | 0.44 | -21.02 | -0.05 | 4.42 | 0.65 | 1.00 | 0.26 | 0.30 |
| SEQID-00097 | 0.03 | 0.00 | 0.00 | 0.05 | 0.02 | 0.00 | 0.00 | 0.02 | 0.12 | -36.52 | -0.10 | 4.61 | 0.99 | 0.70 | 0.25 | 0.26 |
| SEQID-00098 | 0.03 | 0.07 | 0.03 | 0.02 | 0.05 | 0.00 | 0.00 | 0.11 | 0.40 | -33.16 | -0.25 | 4.38 | 0.58 | 0.24 | 0.34 | 0.21 |
| SEQID-00099 | 0.03 | 0.05 | 0.04 | 0.02 | 0.05 | 0.00 | 0.02 | 0.11 | 0.41 | -27.07 | -0.19 | 3.57 | 0.27 | 0.30 | 0.41 | 0.00 |
| SEQID-00100 | 0.03 | 0.08 | 0.01 | 0.05 | 0.03 | 0.00 | 0.02 | 0.04 | 0.29 | -29.97 | -0.21 | 3.67 | 0.31 | 0.35 | 0.42 | 0.24 |
| SEQID-00101 | 0.03 | 0.05 | 0.00 | 0.03 | 0.03 | 0.02 | 0.00 | 0.10 | 0.37 | -29.38 | -0.15 | 3.67 | 0.35 | 0.29 | 0.38 | 0.30 |
| SEQID-00102 | 0.04 | 0.08 | 0.01 | 0.01 | 0.04 | 0.00 | 0.02 | 0.04 | 0.24 | -30.86 | -0.20 | 3.90 | 0.23 | 0.30 | 0.38 | 0.23 |
| SEQID-00103 | 0.08 | 0.07 | 0.01 | 0.01 | 0.02 | 0.00 | 0.01 | 0.05 | 0.34 | -27.55 | -0.16 | 3.75 | 0.30 | 0.29 | 0.22 | 0.00 |
| SEQID-00104 | 0.07 | 0.07 | 0.00 | 0.04 | 0.03 | 0.00 | 0.02 | 0.05 | 0.24 | -28.96 | -0.15 | 3.79 | 0.39 | 0.46 | 0.22 | 0.24 |
| SEQID-00105 | 0.04 | 0.07 | 0.01 | 0.05 | 0.03 | 0.00 | 0.00 | 0.04 | 0.21 | -23.64 | -0.06 | 3.88 | 0.43 | 0.49 | 0.22 | 0.21 |
| SEQID-00106 | 0.07 | 0.08 | 0.01 | 0.10 | 0.05 | 0.00 | 0.01 | 0.04 | 0.35 | -29.02 | -0.13 | 3.92 | 0.39 | 0.46 | 0.25 | 0.26 |
| SEQID-00107 | 0.01 | 0.01 | 0.01 | 0.03 | 0.03 | 0.00 | 0.01 | 0.05 | 0.23 | -30.63 | -0.15 | 3.87 | 0.44 | 0.51 | 0.23 | 0.21 |
| SEQID-00108 | 0.01 | 0.04 | 0.05 | 0.04 | 0.04 | 0.04 | 0.05 | 0.03 | 0.26 | -31.29 | -0.13 | 4.06 | 0.32 | 0.49 | 0.00 | 0.22 |
| SEQID-00109 | 0.00 | 0.03 | 0.03 | 0.03 | 0.03 | 0.05 | 0.06 | 0.03 | 0.25 | -21.85 | -0.10 | 4.28 | 0.34 | 0.55 | 0.00 | 0.22 |
| SEQID-00110 | | | | | | | | | 0.87 | | -0.26 | 2.83 | 0.31 | 0.21 | 0.27 | 0.35 |

TABLE 1-continued

| | | | | | | | | | | | | | | | |
|---|---|---|---|---|---|---|---|---|---|---|---|---|---|---|---|
| SEQID-00110 | 0.00 | 0.03 | 0.02 | 0.05 | 0.04 | 0.06 | 0.03 | 0.02 | 0.46 | −25.30 | −0.18 | 3.78 | 0.36 | 0.22 | 0.33 | 0.34 |
| SEQID-00111 | 0.02 | 0.00 | 0.05 | 0.01 | 0.02 | 0.03 | 0.05 | 0.03 | 0.25 | −27.81 | −0.10 | 4.35 | 0.33 | 0.21 | 0.34 | 0.29 |
| SEQID-00112 | 0.06 | 0.07 | 0.03 | 0.00 | 0.02 | 0.03 | 0.05 | 0.03 | 0.43 | −22.49 | −0.13 | 3.90 | 0.33 | 0.21 | 0.31 | 0.35 |
| SEQID-00113 | 0.04 | 0.11 | 0.01 | 0.02 | 0.01 | 0.03 | 0.02 | 0.03 | 0.51 | −22.06 | −0.13 | 4.12 | 0.29 | 0.21 | 0.28 | 0.27 |
| SEQID-00114 | 0.05 | 0.05 | 0.05 | 0.02 | 0.05 | 0.03 | 0.00 | 0.03 | 0.42 | −28.91 | −0.16 | 4.04 | 0.37 | 0.20 | 0.28 | 0.37 |
| SEQID-00115 | 0.02 | 0.01 | 0.03 | 0.04 | 0.11 | 0.03 | 0.03 | 0.12 | 0.23 | −38.34 | −0.32 | 3.45 | 0.31 | 0.35 | 0.26 | 0.33 |
| SEQID-00116 | 0.02 | 0.01 | 0.03 | 0.04 | 0.11 | 0.00 | 0.05 | 0.03 | 0.23 | −37.93 | −0.31 | 3.46 | 0.31 | 0.31 | 0.26 | 0.33 |
| SEQID-00117 | 0.03 | 0.10 | 0.02 | 0.02 | 0.03 | 0.03 | 0.00 | 0.04 | 0.41 | −21.01 | −0.10 | 4.21 | 0.24 | 0.28 | 0.00 | 0.28 |
| SEQID-00118 | 0.03 | 0.12 | 0.02 | 0.04 | 0.03 | 0.02 | 0.03 | 0.05 | 0.43 | −23.16 | −0.10 | 4.17 | 0.23 | 0.29 | 0.00 | 0.00 |
| SEQID-00119 | 0.04 | 0.05 | 0.03 | 0.03 | 0.05 | 0.03 | 0.01 | 0.03 | 0.44 | −23.37 | −0.12 | 4.07 | 0.23 | 0.28 | 0.25 | 0.24 |
| SEQID-00120 | 0.02 | 0.06 | 0.06 | 0.03 | 0.02 | 0.03 | 0.05 | 0.10 | 0.36 | −25.42 | −0.12 | 4.08 | 0.28 | 0.30 | 0.00 | 0.26 |
| SEQID-00121 | 0.02 | 0.03 | 0.08 | 0.04 | 0.05 | 0.00 | 0.02 | 0.09 | 0.12 | −25.73 | −0.21 | 3.49 | 0.25 | 0.39 | 0.00 | 0.27 |
| SEQID-00122 | 0.01 | 0.03 | 0.06 | 0.05 | 0.07 | 0.00 | 0.12 | 0.05 | 0.08 | −27.56 | −02.2 | 3.50 | 0.00 | 0.31 | 0.24 | 0.24 |
| SEQID-00123 | 0.01 | 0.05 | 0.01 | 0.06 | 0.07 | 0.02 | 0.13 | 0.06 | 0.34 | −26.58 | −0.13 | 4.03 | 0.48 | 0.59 | 0.00 | 0.22 |
| SEQID-00124 | 0.02 | 0.05 | 0.02 | 0.05 | 0.08 | 0.02 | 0.03 | 0.06 | 0.29 | −27.93 | −0.12 | 4.12 | 0.50 | 0.61 | 0.00 | 0.25 |
| SEQID-00125 | 0.02 | 0.03 | 0.02 | 0.10 | 0.08 | 0.06 | 0.06 | 0.09 | 0.63 | −17.21 | −0.10 | 3.73 | 0.24 | 0.32 | 0.00 | 0.22 |
| SEQID-00126 | 0.01 | 0.05 | 0.07 | 0.11 | 0.04 | 0.01 | 0.03 | 0.03 | 0.15 | −25.09 | −0.18 | 3.64 | 0.23 | 0.33 | 0.00 | 0.26 |
| SEQID-00127 | 0.03 | 0.02 | 0.04 | 0.04 | 0.05 | 0.01 | 0.05 | 0.07 | 0.62 | −26.58 | −0.06 | 4.42 | 0.65 | 0.74 | 0.00 | 0.23 |
| SEQID-00128 | 0.03 | 0.07 | 0.04 | 0.06 | 0.06 | 0.01 | 0.02 | 0.07 | 0.57 | −16.81 | 0.04 | 9.31 | 0.25 | 0.30 | 0.23 | 0.25 |
| SEQID-00129 | 0.03 | 0.06 | 0.04 | 0.03 | 0.04 | 0.02 | 0.04 | 0.11 | 0.61 | −16.17 | −0.01 | 6.63 | 0.24 | 0.30 | 0.00 | 0.28 |
| SEQID-00130 | 0.02 | 0.07 | 0.03 | 0.03 | 0.05 | 0.05 | 0.02 | 0.07 | 0.56 | −17.34 | 0.03 | 8.89 | 0.23 | 0.34 | 0.00 | 0.23 |
| SEQID-00131 | 0.03 | 0.03 | 0.04 | 0.03 | 0.04 | 0.02 | 0.03 | 0.05 | 0.47 | −21.19 | −0.03 | 5.04 | 0.96 | 0.99 | 0.22 | 0.24 |
| SEQID-00132 | 0.00 | 0.05 | 0.02 | 0.03 | 0.03 | 0.03 | 0.00 | 0.09 | 1.17 | −15.02 | 0.02 | 9.22 | 0.35 | 0.22 | 0.34 | 0.35 |
| SEQID-00133 | 0.04 | 0.02 | 0.00 | 0.01 | 0.02 | 0.06 | 0.05 | 0.05 | 1.02 | −23.93 | 0.04 | 9.95 | 0.33 | 0.39 | 0.00 | 0.35 |
| SEQID-00134 | 0.02 | 0.03 | 0.03 | 0.14 | 0.05 | 0.00 | 0.00 | 0.07 | 1.38 | −10.60 | −0.03 | 4.49 | 0.32 | 0.33 | 0.00 | 0.34 |
| SEQID-00135 | 0.00 | 0.03 | 0.04 | 0.06 | 0.04 | 0.03 | 0.05 | 0.09 | 0.70 | −15.04 | −0.02 | 6.67 | 0.31 | 0.32 | 0.00 | 0.31 |
| SEQID-00136 | 0.00 | 0.03 | 0.04 | 0.08 | 0.04 | 0.00 | 0.00 | 0.09 | 0.65 | −16.20 | 0.00 | 7.09 | 0.90 | 0.20 | 0.00 | 0.29 |
| SEQID-00137 | 0.02 | 0.03 | 0.04 | 0.03 | 0.09 | 0.00 | 0.03 | 0.09 | 0.89 | −18.91 | −0.03 | 4.79 | 0.32 | 0.21 | 0.00 | 0.32 |
| SEQID-00138 | 0.02 | 0.03 | 0.00 | 0.06 | 0.09 | 0.05 | 0.03 | 0.04 | 0.74 | −14.32 | −0.02 | 6.22 | 0.24 | 0.22 | 0.00 | 0.28 |
| SEQID-00139 | 0.00 | 0.00 | 0.04 | 0.03 | 0.03 | 0.02 | 0.00 | 0.07 | 0.29 | −31.57 | −0.03 | 5.00 | 0.31 | 0.21 | 0.00 | 0.31 |
| SEQID-00140 | 0.02 | 0.10 | 0.00 | 0.08 | 0.07 | 0.03 | 0.00 | 0.09 | 0.77 | −17.13 | −0.01 | 7.52 | 0.33 | 0.20 | 0.31 | 0.28 |
| SEQID-00141 | 0.02 | 0.05 | 0.03 | 0.05 | 0.05 | 0.03 | 0.05 | 0.05 | 0.76 | −16.98 | 0.01 | 7.61 | 0.30 | 0.19 | 0.25 | 0.17 |
| SEQID-00142 | 0.02 | 0.02 | 0.00 | 0.01 | 0.01 | 0.06 | 0.03 | 0.03 | 0.24 | −20.09 | 0.08 | 10.05 | 0.32 | 0.21 | 0.29 | 0.30 |
| SEQID-00143 | 0.02 | 0.07 | 0.05 | 0.03 | 0.08 | 0.03 | 0.05 | 0.11 | 0.52 | −19.93 | 0.02 | 8.49 | 0.33 | 0.22 | 0.32 | 0.32 |
| SEQID-00144 | 0.04 | 0.15 | 0.01 | 0.07 | 0.05 | 0.03 | 0.05 | 0.07 | 0.58 | −17.29 | 0.00 | 7.25 | 0.31 | 0.20 | 0.39 | 0.32 |
| SEQID-00145 | 0.02 | 0.03 | 0.02 | 0.05 | 0.02 | 0.05 | 0.02 | 0.13 | 0.79 | −16.57 | −0.04 | 4.79 | 0.90 | 0.58 | 0.33 | 0.24 |
| SEQID-00146 | 0.03 | 0.08 | 0.03 | 0.03 | 0.09 | 0.03 | 0.03 | 0.07 | 0.65 | −16.05 | −0.01 | 6.50 | 0.32 | 0.20 | 0.28 | 0.31 |
| SEQID-00147 | 0.03 | 0.02 | 0.05 | 0.02 | 0.04 | 0.03 | 0.11 | 0.06 | 0.73 | −16.21 | −0.03 | 4.70 | 0.24 | 0.23 | 0.00 | 0.23 |
| SEQID-00148 | 0.02 | 0.05 | 0.03 | 0.03 | 0.03 | 0.02 | 0.06 | 0.12 | 0.83 | −17.15 | 0.04 | 10.46 | 0.31 | 0.44 | 0.30 | 0.00 |
| SEQID-00149 | 0.00 | 0.01 | 0.05 | 0.04 | 0.05 | 0.05 | 0.06 | 0.11 | 0.65 | −17.64 | −0.02 | 9.98 | 0.00 | 0.30 | 0.00 | 0.00 |
| SEQID-00150 | 0.04 | 0.01 | 0.04 | 0.03 | 0.06 | 0.00 | 0.04 | 0.09 | 0.55 | −21.64 | 0.04 | 6.24 | 0.27 | 0.30 | 0.00 | 0.24 |
| SEQID-00151 | 0.02 | 0.13 | 0.00 | 0.02 | 0.03 | 0.02 | 0.05 | 0.06 | 0.54 | −24.45 | −0.01 | 10.51 | 0.25 | 0.26 | 0.26 | 0.26 |
| SEQID-00152 | 0.02 | 0.04 | 0.01 | 0.04 | 0.02 | 0.05 | 0.05 | 0.07 | 0.37 | −23.71 | 0.09 | 9.12 | 0.29 | 0.32 | 0.24 | 0.25 |
| SEQID-00153 | 0.02 | 0.06 | 0.02 | 0.05 | 0.02 | 0.02 | 0.05 | 0.06 | 0.52 | −22.23 | 0.03 | 4.38 | 0.26 | 0.30 | 0.27 | 0.29 |
| SEQID-00154 | 0.03 | 0.03 | 0.03 | 0.05 | 0.05 | 0.03 | 0.03 | 0.06 | 0.58 | −18.41 | −0.06 | 7.51 | 0.72 | 0.74 | 0.00 | 0.13 |
| SEQID-00155 | 0.03 | 0.08 | 0.05 | 0.01 | 0.02 | 0.05 | 0.11 | 0.09 | 0.58 | −17.59 | 0.01 | 7.40 | 0.26 | 0.29 | 0.29 | 0.25 |
| SEQID-00156 | 0.02 | 0.02 | 0.02 | 0.04 | 0.04 | 0.03 | 0.06 | 0.07 | 0.51 | −22.73 | 0.00 | 9.19 | 0.58 | 0.60 | 0.00 | 0.23 |
| SEQID-00157 | 0.04 | 0.05 | 0.03 | 0.05 | 0.03 | 0.01 | 0.06 | 0.06 | 0.39 | −19.38 | 0.04 | 5.62 | 0.23 | 0.29 | 0.26 | 0.26 |
| SEQID-00158 | 0.04 | 0.04 | 0.02 | 0.05 | 0.05 | 0.01 | 0.06 | 0.07 | 0.57 | −19.98 | −0.02 | 5.35 | 0.31 | 0.44 | 0.00 | 0.21 |
| SEQID-00159 | 0.03 | 0.07 | 0.02 | 0.04 | 0.05 | 0.02 | 0.04 | 0.08 | 0.48 | −17.02 | −0.02 | 4.70 | 0.00 | 0.31 | 0.00 | 0.24 |
| SEQID-00160 | 0.04 | 0.07 | 0.05 | 0.05 | 0.06 | 0.01 | 0.03 | 0.07 | 0.57 | −19.43 | −0.04 | 5.68 | 0.47 | 0.53 | 0.00 | 0.22 |
| SEQID-00161 | 0.03 | 0.09 | 0.01 | 0.06 | 0.09 | 0.02 | 0.04 | 0.10 | 0.48 | −15.61 | 0.04 | 9.92 | 0.18 | 0.31 | 0.22 | 0.26 |
| SEQID-00162 | 0.05 | 0.00 | 0.10 | 0.06 | 0.02 | 0.00 | 0.03 | 0.05 | 1.39 | −6.47 | −0.02 | 5.45 | 0.29 | 0.38 | 0.00 | 0.22 |

TABLE 1-continued

| | | | | | | | | | | | | | | |
|---|---|---|---|---|---|---|---|---|---|---|---|---|---|---|
| SEQID-00163 | 0.01 | 0.13 | 0.03 | 0.04 | 0.02 | 0.02 | 0.07 | 0.04 | −11.56 | 1.34 | 0.03 | 9.43 | 0.22 | 0.27 | 0.00 | 0.23 |
| SEQID-00164 | 0.04 | 0.07 | 0.01 | 0.03 | 0.03 | 0.03 | 0.05 | 0.22 | −5.03 | 1.99 | 0.02 | 9.17 | 0.29 | 0.22 | 0.00 | 0.34 |
| SEQID-00165 | 0.02 | 0.00 | 0.03 | 0.07 | 0.08 | 0.06 | 0.03 | 0.17 | −4.16 | 1.81 | 0.00 | 6.41 | 0.30 | 0.23 | 0.27 | 0.00 |
| SEQID-00166 | 0.03 | 0.05 | 0.07 | 0.02 | 0.08 | 0.00 | 0.03 | 0.08 | −5.92 | 1.63 | 0.00 | 7.70 | 0.25 | 0.30 | 0.00 | 0.27 |
| SEQID-00167 | 0.04 | 0.05 | 0.07 | 0.05 | 0.10 | 0.03 | 0.02 | 0.02 | −6.50 | 1.19 | 0.02 | 10.10 | 0.21 | 0.33 | 0.00 | 0.24 |
| SEQID-00168 | 0.05 | 0.04 | 0.06 | 0.05 | 0.10 | 0.03 | 0.03 | 0.03 | −6.42 | 1.26 | 0.01 | 9.66 | 0.21 | 0.33 | 0.00 | 0.00 |
| SEQID-00169 | 0.04 | 0.09 | 0.14 | 0.04 | 0.02 | 0.00 | 0.03 | 0.05 | −5.08 | 1.18 | −0.03 | 4.18 | 0.29 | 0.20 | 0.32 | 0.33 |
| SEQID-00170 | 0.05 | 0.04 | 0.00 | 0.06 | 0.09 | 0.03 | 0.03 | 0.02 | −6.50 | 1.19 | 0.02 | 9.72 | 0.21 | 0.33 | 0.00 | 0.00 |
| SEQID-00171 | 0.04 | 0.06 | 0.07 | 0.03 | 0.09 | 0.04 | 0.03 | 0.05 | −5.71 | 1.32 | 0.02 | 10.04 | 0.23 | 0.31 | 0.00 | 0.22 |
| SEQID-00172 | 0.09 | 0.06 | 0.01 | 0.05 | 0.07 | 0.03 | 0.05 | 0.07 | −5.77 | 1.52 | −0.01 | 6.20 | 0.26 | 0.28 | 0.00 | 0.24 |
| SEQID-00173 | 0.05 | 0.07 | 0.07 | 0.03 | 0.09 | 0.04 | 0.03 | 0.05 | −6.03 | 1.24 | 0.01 | 9.63 | 0.21 | 0.33 | 0.00 | 0.20 |
| SEQID-00174 | 0.04 | 0.08 | 0.08 | 0.03 | 0.10 | 0.06 | 0.01 | 0.04 | −7.89 | 1.02 | 0.02 | 10.42 | 0.23 | 0.32 | 0.00 | 0.26 |
| SEQID-00175 | 0.04 | 0.11 | 0.02 | 0.00 | 0.05 | 0.03 | 0.08 | 0.05 | −6.10 | 1.53 | −0.05 | 3.93 | 0.29 | 0.21 | 0.00 | 0.26 |
| SEQID-00176 | 0.06 | 0.08 | 0.05 | 0.06 | 0.10 | 0.02 | 0.01 | 0.05 | −6.48 | 1.21 | 0.02 | 10.57 | 0.00 | 0.32 | 0.00 | 0.00 |
| SEQID-00177 | 0.02 | 0.11 | 0.01 | 0.07 | 0.06 | 0.03 | 0.06 | 0.09 | −4.33 | 1.65 | −0.01 | 5.45 | 0.22 | 0.30 | 0.22 | 0.27 |
| SEQID-00178 | 0.05 | 0.14 | 0.04 | 0.04 | 0.07 | 0.05 | 0.06 | 0.05 | −6.01 | 1.52 | 0.00 | 7.34 | 0.23 | 0.28 | 0.27 | 0.20 |
| SEQID-00179 | 0.01 | 0.11 | 0.04 | 0.07 | 0.03 | 0.02 | 0.06 | 0.04 | −9.40 | 1.40 | −0.02 | 4.73 | 0.20 | 0.33 | 0.00 | 0.27 |
| SEQID-00180 | 0.06 | 0.05 | 0.07 | 0.05 | 0.07 | 0.08 | 0.04 | 0.02 | −7.83 | 1.16 | 0.00 | 6.95 | 0.29 | 0.30 | 0.00 | 0.27 |
| SEQID-00181 | 0.07 | 0.10 | 0.03 | 0.03 | 0.09 | 0.02 | 0.04 | 0.01 | −8.86 | 1.29 | −0.01 | 5.65 | 0.29 | 0.32 | 0.00 | 0.30 |
| SEQID-00182 | 0.05 | 0.08 | 0.05 | 0.06 | 0.04 | 0.05 | 0.06 | 0.04 | −7.84 | 1.36 | 0.02 | 9.13 | 0.25 | 0.28 | 0.00 | 0.23 |
| SEQID-00183 | 0.02 | 0.10 | 0.02 | 0.03 | 0.03 | 0.02 | 0.04 | 0.03 | −9.90 | 1.21 | −0.04 | 4.17 | 0.18 | 0.28 | 0.23 | 0.25 |
| SEQID-00184 | 0.04 | 0.16 | 0.02 | 0.05 | 0.03 | 0.05 | 0.07 | 0.06 | −10.84 | 1.38 | −0.04 | 4.29 | 0.27 | 0.28 | 0.27 | 0.27 |
| SEQID-00185 | 0.02 | 0.11 | 0.03 | 0.08 | 0.08 | 0.05 | 0.06 | 0.04 | −10.00 | 1.28 | 0.01 | 8.21 | 0.26 | 0.31 | 0.24 | 0.23 |
| SEQID-00186 | 0.05 | 0.14 | 0.02 | 0.03 | 0.03 | 0.04 | 0.04 | 0.07 | −9.98 | 1.54 | 0.02 | 9.17 | 0.25 | 0.28 | 0.00 | 0.26 |
| SEQID-00187 | 0.02 | 0.18 | 0.03 | 0.05 | 0.05 | 0.02 | 0.03 | 0.07 | −7.42 | 1.30 | 0.01 | 8.23 | 0.23 | 0.28 | 0.20 | 0.22 |
| SEQID-00188 | 0.04 | 0.03 | 0.07 | 0.04 | 0.05 | 0.10 | 0.00 | 0.04 | −6.18 | 1.52 | 0.00 | 7.72 | 0.25 | 0.33 | 0.00 | 0.27 |
| SEQID-00189 | 0.07 | 0.08 | 0.05 | 0.05 | 0.11 | 0.07 | 0.01 | 0.04 | −6.44 | 1.10 | 0.06 | 12.27 | 0.23 | 0.29 | 0.00 | 0.26 |
| SEQID-00190 | 0.05 | 0.01 | 0.08 | 0.05 | 0.12 | 0.03 | 0.01 | 0.01 | −5.82 | 1.11 | 0.01 | 9.35 | 0.27 | 0.32 | 0.24 | 0.30 |
| SEQID-00191 | 0.05 | 0.01 | 0.09 | 0.05 | 0.12 | 0.02 | 0.01 | 0.02 | −6.73 | 1.12 | 0.03 | 10.24 | 0.27 | 0.30 | 0.00 | 0.27 |
| SEQID-00192 | 0.04 | 0.00 | 0.07 | 0.05 | 0.12 | 0.05 | 0.00 | 0.03 | −6.30 | 1.37 | 0.00 | 7.72 | 0.23 | 0.27 | 0.23 | 0.29 |
| SEQID-00193 | 0.02 | 0.03 | 0.03 | 0.08 | 0.04 | 0.00 | 0.00 | 0.04 | −18.69 | 0.54 | 0.02 | 9.44 | 0.29 | 0.18 | 0.27 | 0.29 |
| SEQID-00194 | 0.02 | 0.11 | 0.03 | 0.08 | 0.04 | 0.04 | 0.00 | 0.04 | −17.31 | 0.54 | 0.04 | 10.49 | 0.31 | 0.20 | 0.24 | 0.35 |
| SEQID-00195 | 0.02 | 0.14 | 0.02 | 0.09 | 0.04 | 0.04 | 0.00 | 0.04 | −17.40 | 0.47 | 0.04 | 10.49 | 0.31 | 0.20 | 0.24 | 0.33 |
| SEQID-00196 | 0.02 | 0.00 | 0.03 | 0.06 | 0.04 | 0.04 | 0.02 | 0.04 | −22.65 | 0.39 | 0.00 | 7.42 | 0.24 | 0.32 | 0.22 | 0.34 |
| SEQID-00197 | 0.03 | 0.04 | 0.03 | 0.06 | 0.04 | 0.04 | 0.02 | 0.04 | −22.50 | 0.39 | 0.00 | 7.42 | 0.20 | 0.32 | 0.25 | 0.25 |
| SEQID-00198 | 0.03 | 0.04 | 0.04 | 0.06 | 0.04 | 0.04 | 0.02 | 0.04 | −22.35 | 0.39 | 0.00 | 7.42 | 0.00 | 0.32 | 0.25 | 0.25 |
| SEQID-00199 | 0.03 | 0.04 | 0.04 | 0.06 | 0.04 | 0.04 | 0.02 | 0.04 | −22.74 | 0.39 | 0.00 | 6.53 | 0.23 | 0.26 | 0.25 | 0.26 |
| SEQID-00200 | 0.03 | 0.04 | 0.03 | 0.06 | 0.04 | 0.04 | 0.02 | 0.04 | −22.59 | 0.38 | −0.01 | 6.53 | 0.23 | 0.23 | 0.00 | 0.25 |
| SEQID-00201 | 0.03 | 0.04 | 0.03 | 0.06 | 0.04 | 0.04 | 0.02 | 0.04 | −22.97 | 0.38 | −0.02 | 5.82 | 0.22 | 0.31 | 0.24 | 0.25 |
| SEQID-00202 | 0.03 | 0.04 | 0.04 | 0.06 | 0.04 | 0.04 | 0.01 | 0.04 | −23.34 | 0.38 | −0.02 | 5.32 | 0.22 | 0.32 | 0.24 | 0.25 |
| SEQID-00203 | 0.03 | 0.04 | 0.04 | 0.05 | 0.04 | 0.04 | 0.02 | 0.04 | −23.25 | 0.38 | 0.00 | 5.32 | 0.22 | 0.32 | 0.00 | 0.25 |
| SEQID-00204 | 0.03 | 0.04 | 0.03 | 0.05 | 0.04 | 0.02 | 0.02 | 0.04 | −23.61 | 0.37 | −0.02 | 5.06 | 0.25 | 0.32 | 0.23 | 0.28 |
| SEQID-00205 | 0.03 | 0.04 | 0.06 | 0.06 | 0.04 | 0.02 | 0.02 | 0.04 | −24.11 | 0.36 | −0.04 | 4.67 | 0.25 | 0.32 | 0.29 | 0.26 |
| SEQID-00206 | 0.00 | 0.00 | 0.00 | 0.00 | 0.00 | 0.09 | 0.03 | 0.08 | −27.16 | 0.30 | 0.10 | 10.48 | 0.00 | 0.10 | 0.29 | 0.25 |
| SEQID-00207 | 0.02 | 0.02 | 0.02 | 0.02 | 0.04 | 0.07 | 0.02 | 0.06 | −33.49 | 0.15 | 0.01 | 7.70 | 0.32 | 0.26 | 0.26 | 0.00 |
| SEQID-00208 | 0.02 | 0.02 | 0.02 | 0.02 | 0.03 | 0.00 | 0.02 | 0.03 | −37.87 | 0.12 | 0.18 | 4.11 | 0.31 | 0.23 | 0.29 | 0.27 |
| SEQID-00209 | 0.01 | 0.04 | 0.04 | 0.03 | 0.03 | 0.04 | 0.01 | 0.05 | −29.13 | 0.21 | 0.02 | 9.15 | 0.34 | 0.31 | 0.00 | 0.00 |
| SEQID-00210 | 0.02 | 0.02 | 0.03 | 0.04 | 0.03 | 0.05 | 0.01 | 0.04 | −32.93 | 0.17 | −0.04 | 5.09 | 0.30 | 0.34 | 0.24 | 0.23 |
| SEQID-00211 | 0.02 | 0.02 | 0.00 | 0.00 | 0.03 | 0.04 | 0.01 | 0.04 | −33.59 | 0.15 | −0.05 | 4.95 | 0.30 | 0.21 | 0.00 | 0.00 |
| SEQID-00212 | 0.00 | 0.00 | 0.00 | 0.01 | 0.03 | 0.00 | 0.03 | 0.04 | −36.26 | 0.21 | −0.06 | 4.77 | 0.34 | 0.22 | 0.23 | 0.33 |
| SEQID-00213 | 0.00 | 0.00 | 0.00 | 0.01 | 0.05 | 0.00 | 0.03 | 0.05 | −34.27 | 0.27 | −0.04 | 4.76 | 0.35 | 0.25 | 0.31 | 0.00 |
| SEQID-00214 | 0.00 | 0.00 | 0.00 | 0.01 | 0.06 | 0.00 | 0.02 | 0.05 | −32.73 | 0.22 | −0.04 | 4.66 | 0.29 | 0.25 | 0.00 | 0.00 |
| SEQID-00215 | 0.00 | 0.00 | 0.00 | 0.03 | 0.03 | 0.00 | 0.02 | 0.06 | −34.50 | 0.23 | 0.00 | 7.54 | 0.31 | 0.21 | 0.00 | 0.00 |

TABLE 1-continued

| | | | | | | | | | | | | | |
|---|---|---|---|---|---|---|---|---|---|---|---|---|---|
| SEQID-00216 | 0.00 | 0.02 | 0.00 | 0.01 | 0.03 | 0.00 | 0.00 | 0.02 | 0.05 | -34.08 | 0.25 | 0.00 | 7.54 | 0.32 | 0.26 | 0.00 | 0.00 |
| SEQID-00217 | 0.00 | 0.02 | 0.00 | 0.01 | 0.05 | 0.00 | 0.03 | 0.03 | 0.06 | -35.54 | 0.25 | -0.09 | 4.33 | 0.34 | 0.23 | 0.00 | 0.00 |
| SEQID-00218 | 0.00 | 0.00 | 0.00 | 0.01 | 0.05 | 0.00 | 0.00 | 0.05 | 0.05 | -34.67 | 0.22 | -0.07 | 4.60 | 0.32 | 0.20 | 0.25 | 0.25 |
| SEQID-00219 | 0.00 | 0.00 | 0.00 | 0.03 | 0.03 | 0.00 | 0.03 | 0.03 | 0.07 | -33.39 | 0.29 | -0.02 | 5.81 | 0.31 | 0.25 | 0.00 | 0.31 |
| SEQID-00220 | 0.00 | 0.00 | 0.00 | 0.01 | 0.05 | 0.00 | 0.03 | 0.02 | 0.05 | -37.57 | 0.19 | -0.07 | 4.55 | 0.32 | 0.24 | 0.31 | 0.00 |
| SEQID-00221 | 0.00 | 0.00 | 0.00 | 0.02 | 0.05 | 0.00 | 0.00 | 0.03 | 0.06 | -35.42 | 0.21 | -0.01 | 5.88 | 0.36 | 0.24 | 0.21 | 0.00 |
| SEQID-00222 | 0.00 | 0.03 | 0.00 | 0.03 | 0.05 | 0.00 | 0.00 | 0.02 | 0.02 | -30.85 | 0.13 | -0.10 | 4.23 | 0.36 | 0.23 | 0.00 | 0.33 |
| SEQID-00223 | 0.00 | 0.02 | 0.00 | 0.01 | 0.03 | 0.00 | 0.00 | 0.03 | 0.03 | -33.68 | 0.26 | -0.02 | 5.81 | 0.33 | 0.25 | 0.00 | 0.00 |
| SEQID-00224 | 0.00 | 0.00 | 0.00 | 0.01 | 0.06 | 0.00 | 0.00 | 0.02 | 0.06 | -35.47 | 0.23 | -0.05 | 4.66 | 0.30 | 0.31 | 0.00 | 0.00 |
| SEQID-00225 | 0.00 | 0.01 | 0.00 | 0.02 | 0.04 | 0.00 | 0.01 | 0.02 | 0.04 | -33.38 | 0.20 | -0.02 | 5.31 | 0.30 | 0.33 | 0.27 | 0.29 |
| SEQID-00226 | 0.00 | 0.01 | 0.00 | 0.02 | 0.04 | 0.00 | 0.01 | 0.04 | 0.04 | -32.78 | 0.18 | -0.03 | 5.01 | 0.33 | 0.35 | 0.00 | 0.00 |
| SEQID-00227 | 0.00 | 0.01 | 0.00 | 0.02 | 0.03 | 0.00 | 0.01 | 0.04 | 0.04 | -36.89 | 0.16 | -0.03 | 5.07 | 0.30 | 0.25 | 0.00 | 0.00 |
| SEQID-00228 | 0.00 | 0.01 | 0.00 | 0.02 | 0.04 | 0.00 | 0.03 | 0.02 | 0.04 | -37.66 | 0.15 | -0.03 | 4.97 | 0.33 | 0.39 | 0.00 | 0.00 |
| SEQID-00229 | 0.02 | 0.02 | 0.00 | 0.03 | 0.07 | 0.00 | 0.00 | 0.02 | 0.02 | -32.91 | 0.12 | -0.10 | 4.28 | 0.38 | 0.25 | 0.00 | 0.00 |
| SEQID-00230 | 0.00 | 0.03 | 0.00 | 0.03 | 0.02 | 0.00 | 0.00 | 0.02 | 0.02 | -29.21 | 0.16 | 0.02 | 9.18 | 0.39 | 0.25 | 0.27 | 0.27 |
| SEQID-00231 | 0.01 | 0.03 | 0.00 | 0.04 | 0.05 | 0.00 | 0.00 | 0.02 | 0.02 | -28.20 | 0.17 | -0.03 | 4.75 | 0.30 | 0.31 | 0.00 | 0.00 |
| SEQID-00232 | 0.00 | 0.03 | 0.00 | 0.03 | 0.05 | 0.00 | 0.00 | 0.03 | 0.03 | -30.24 | 0.12 | 0.04 | 10.27 | 0.31 | 0.33 | 0.00 | 0.00 |
| SEQID-00233 | 0.00 | 0.06 | 0.02 | 0.03 | 0.05 | 0.00 | 0.00 | 0.08 | 0.08 | -16.02 | 0.94 | -0.06 | 4.03 | 0.26 | 0.32 | 0.00 | 1.00 |
| SEQID-00234 | 0.00 | 0.07 | 0.02 | 0.07 | 0.04 | 0.00 | 0.07 | 0.08 | 0.08 | -16.69 | 0.94 | -0.07 | 4.03 | 0.23 | 0.30 | 0.00 | 1.00 |
| SEQID-00235 | 0.00 | 0.07 | 0.01 | 0.08 | 0.04 | 0.00 | 0.03 | 0.03 | 0.06 | -17.69 | 0.65 | -0.06 | 4.15 | 0.26 | 0.31 | 0.00 | 1.00 |
| SEQID-00236 | 0.02 | 0.00 | 0.00 | 0.01 | 0.05 | 0.00 | 0.00 | 0.03 | 0.03 | -34.37 | 0.07 | -0.06 | 4.67 | 0.36 | 0.29 | 0.00 | 0.00 |
| SEQID-00237 | 0.02 | 0.00 | 0.00 | 0.01 | 0.05 | 0.00 | 0.00 | 0.03 | 0.03 | -38.56 | 0.08 | -0.02 | 5.12 | 0.38 | 0.24 | 0.00 | 0.00 |
| SEQID-00238 | 0.02 | 0.00 | 0.00 | 0.01 | 0.03 | 0.00 | 0.00 | 0.03 | 0.03 | -38.44 | 0.16 | -0.09 | 4.53 | 0.35 | 0.24 | 0.27 | 0.32 |
| SEQID-00239 | 0.06 | 0.02 | 0.00 | 0.02 | 0.02 | 0.00 | 0.00 | 0.00 | 0.00 | -41.59 | 0.04 | -0.02 | 5.16 | 0.42 | 0.26 | 0.00 | 0.00 |
| SEQID-00240 | 0.04 | 0.00 | 0.00 | 0.03 | 0.02 | 0.00 | 0.00 | 0.00 | 0.00 | -40.29 | 0.04 | -0.04 | 4.82 | 0.37 | 0.23 | 0.00 | 0.00 |
| SEQID-00241 | 0.02 | 0.00 | 0.00 | 0.01 | 0.07 | 0.00 | 0.00 | 0.03 | 0.03 | -35.70 | 0.11 | -0.05 | 4.83 | 0.31 | 0.36 | 0.28 | 0.22 |
| SEQID-00242 | 0.00 | 0.10 | 0.05 | 0.05 | 0.05 | 0.07 | 0.03 | 0.08 | 0.02 | -5.77 | 1.91 | -0.02 | 4.18 | 0.33 | 0.20 | 0.26 | 0.26 |
| SEQID-00243 | 0.00 | 0.11 | 0.05 | 0.11 | 0.05 | 0.03 | 0.06 | 0.08 | 0.02 | -4.36 | 1.69 | 0.00 | 6.23 | 0.31 | 0.19 | 0.29 | 0.29 |
| SEQID-00244 | 0.05 | 0.00 | 0.04 | 0.00 | 0.15 | 0.03 | 0.03 | 0.12 | 0.00 | -3.56 | 1.26 | 0.02 | 9.70 | 0.37 | 0.24 | 0.00 | 0.33 |
| SEQID-00245 | 0.02 | 0.08 | 0.07 | 0.08 | 0.12 | 0.03 | 0.03 | 0.05 | 0.03 | -5.24 | 1.22 | 0.00 | 7.55 | 0.30 | 0.19 | 0.00 | 0.36 |
| SEQID-00246 | 0.00 | 0.08 | 0.05 | 0.03 | 0.04 | 0.02 | 0.02 | 0.04 | 0.05 | -6.47 | 1.61 | -0.09 | 3.87 | 0.29 | 0.19 | 0.00 | 0.29 |
| SEQID-00247 | 0.04 | 0.04 | 0.04 | 0.06 | 0.04 | 0.03 | 0.03 | 0.03 | 0.06 | -7.06 | 1.30 | -0.01 | 6.50 | 0.26 | 0.31 | 0.00 | 0.26 |
| SEQID-00248 | 0.07 | 0.03 | 0.12 | 0.03 | 0.09 | 0.02 | 0.03 | 0.00 | 0.00 | -6.58 | 1.34 | 0.00 | 6.49 | 0.33 | 0.22 | 0.00 | 0.29 |
| SEQID-00249 | 0.07 | 0.04 | 0.09 | 0.02 | 0.06 | 0.02 | 0.00 | 0.03 | 0.02 | -8.69 | 1.28 | 0.02 | 10.33 | 0.24 | 0.29 | 0.00 | 0.26 |
| SEQID-00250 | 0.00 | 0.08 | 0.05 | 0.02 | 0.09 | 0.07 | 0.03 | 0.03 | 0.04 | -9.82 | 1.03 | -0.05 | 4.57 | 0.33 | 0.21 | 0.00 | 0.37 |
| SEQID-00251 | 0.03 | 0.04 | 0.03 | 0.04 | 0.06 | 0.02 | 0.03 | 0.05 | 0.04 | -11.82 | 1.17 | 0.05 | 10.32 | 0.28 | 0.23 | 0.29 | 0.27 |
| SEQID-00252 | 0.00 | 0.05 | 0.02 | 0.05 | 0.09 | 0.02 | 0.04 | 0.05 | 0.04 | -14.21 | 1.08 | 0.00 | 10.00 | 0.31 | 0.20 | 0.36 | 0.30 |
| SEQID-00253 | 0.02 | 0.08 | 0.04 | 0.05 | 0.07 | 0.06 | 0.06 | 0.09 | 0.05 | -10.95 | 1.37 | 0.00 | 3.24 | 0.25 | 0.27 | 0.36 | 0.28 |
| SEQID-00254 | 0.01 | 0.10 | 0.03 | 0.03 | 0.04 | 0.06 | 0.06 | 0.09 | 0.09 | -11.95 | 1.26 | -0.03 | 8.49 | 0.28 | 0.29 | 0.27 | 0.31 |
| SEQID-00255 | 0.01 | 0.07 | 0.02 | 0.07 | 0.04 | 0.02 | 0.07 | 0.00 | 0.05 | -17.75 | 1.49 | -0.01 | 10.79 | 0.36 | 0.23 | 0.00 | 0.31 |
| SEQID-00256 | 0.00 | 0.08 | 0.09 | 0.05 | 0.04 | 0.03 | 0.00 | 0.00 | 0.05 | -7.56 | 1.48 | 0.05 | 9.54 | 0.33 | 0.22 | 0.35 | 0.33 |
| SEQID-00257 | 0.02 | 0.08 | 0.07 | 0.03 | 0.04 | 0.06 | 0.03 | 0.00 | 0.07 | -8.27 | 1.30 | 0.02 | 9.30 | 0.35 | 0.24 | 0.36 | 0.33 |
| SEQID-00258 | 0.07 | 0.05 | 0.06 | 0.02 | 0.10 | 0.03 | 0.00 | 0.03 | 0.03 | -3.63 | 0.94 | 0.02 | 13.28 | 0.30 | 0.19 | 0.00 | 0.00 |
| SEQID-00259 | 0.09 | 0.02 | 0.03 | 0.05 | 0.03 | 0.00 | 0.00 | 0.00 | 0.03 | -17.37 | 0.66 | 0.23 | 7.36 | 0.33 | 0.21 | 0.29 | 0.27 |
| SEQID-00260 | 0.00 | 0.05 | 0.02 | 0.05 | 0.06 | 0.02 | 0.04 | 0.00 | 0.02 | -19.14 | 0.40 | 0.00 | 7.25 | 0.30 | 0.23 | 0.00 | 0.39 |
| SEQID-00261 | 0.02 | 0.08 | 0.04 | 0.05 | 0.08 | 0.06 | 0.06 | 0.05 | 0.07 | -10.46 | 1.44 | 0.00 | 4.54 | 0.31 | 0.19 | 0.36 | 0.34 |
| SEQID-00262 | 0.00 | 0.10 | 0.03 | 0.07 | 0.07 | 0.06 | 0.06 | 0.09 | 0.03 | -11.32 | 1.17 | -0.03 | 6.51 | 0.31 | 0.20 | 0.00 | 0.29 |
| SEQID-00263 | 0.00 | 0.07 | 0.02 | 0.07 | 0.06 | 0.07 | 0.07 | 0.14 | 0.05 | -17.75 | 0.73 | -0.01 | 7.24 | 0.37 | 0.21 | 0.27 | 0.22 |
| SEQID-00264 | 0.04 | 0.01 | 0.03 | 0.03 | 0.07 | 0.00 | 0.00 | 0.00 | 0.02 | -5.22 | 1.51 | 0.00 | 4.58 | 0.29 | 0.24 | 0.00 | 0.29 |
| SEQID-00265 | 0.02 | 0.01 | 0.00 | 0.04 | 0.05 | 0.00 | 0.00 | 0.00 | 0.02 | -37.24 | 0.08 | -0.07 | 4.60 | 0.29 | 0.37 | 0.22 | 0.00 |
| SEQID-00266 | 0.01 | 0.00 | 0.00 | 0.02 | 0.03 | 0.00 | 0.01 | 0.00 | 0.03 | -34.97 | 0.13 | -0.06 | 4.55 | 0.31 | 0.40 | 0.23 | 0.22 |
| SEQID-00267 | 0.00 | 0.00 | 0.00 | 0.01 | 0.05 | 0.00 | 0.00 | 0.01 | 0.03 | -37.57 | 0.13 | -0.07 | 4.55 | 0.31 | 0.25 | 0.23 | 0.00 |
| SEQID-00268 | 0.00 | 0.00 | 0.00 | 0.01 | 0.05 | 0.00 | 0.02 | 0.02 | 0.01 | -37.57 | 0.17 | -0.07 | 4.55 | 0.33 | 0.27 | 0.32 | 0.00 |
| SEQID-00269 | 0.00 | 0.00 | 0.00 | 0.01 | 0.05 | 0.00 | 0.02 | 0.02 | 0.00 | -36.50 | 0.23 | -0.09 | 4.42 | 0.35 | 0.28 | 0.33 | 0.00 |

TABLE 1-continued

| | | | | | | | | | | | | | | | | |
|---|---|---|---|---|---|---|---|---|---|---|---|---|---|---|---|---|
| SEQID-00269 | 0.00 | 0.00 | 0.00 | 0.01 | 0.04 | 0.00 | 0.00 | 0.02 | 0.00 | -36.42 | 0.23 | -0.09 | 4.42 | 0.34 | 0.27 | 0.00 | 0.00 |
| SEQID-00270 | 0.00 | 0.00 | 0.00 | 0.01 | 0.04 | 0.00 | 0.00 | 0.02 | 0.00 | -36.42 | 0.28 | -0.09 | 4.42 | 0.38 | 0.31 | 0.00 | 0.26 |
| SEQID-00271 | 0.00 | 0.00 | 0.00 | 0.01 | 0.03 | 0.00 | 0.00 | 0.02 | 0.00 | -36.19 | 0.40 | -0.09 | 4.42 | 0.35 | 0.29 | 0.00 | 0.00 |
| SEQID-00272 | 0.00 | 0.00 | 0.00 | 0.01 | 0.05 | 0.00 | 0.00 | 0.02 | 0.00 | -37.57 | 0.19 | -0.07 | 4.55 | 0.33 | 0.27 | 0.33 | 0.00 |
| SEQID-00273 | 0.00 | 0.00 | 0.00 | 0.01 | 0.05 | 0.00 | 0.00 | 0.02 | 0.00 | -37.42 | 0.26 | -0.07 | 4.55 | 0.35 | 0.28 | 0.00 | 0.00 |
| SEQID-00274 | 0.00 | 0.00 | 0.00 | 0.01 | 0.04 | 0.00 | 0.00 | 0.02 | 0.00 | -37.34 | 0.37 | -0.07 | 4.55 | 0.35 | 0.28 | 0.00 | 0.00 |
| SEQID-00275 | 0.00 | 0.00 | 0.00 | 0.01 | 0.03 | 0.00 | 0.00 | 0.02 | 0.00 | -37.26 | 0.37 | -0.07 | 4.55 | 0.34 | 0.18 | 0.36 | 0.00 |
| SEQID-00276 | 0.00 | 0.00 | 0.00 | 0.01 | 0.04 | 0.00 | 0.00 | 0.02 | 0.00 | -37.16 | 0.47 | -0.07 | 4.55 | 0.35 | 0.29 | 0.00 | 0.00 |
| SEQID-00277 | 0.03 | 0.06 | 0.02 | 0.00 | 0.09 | 0.02 | 0.05 | 0.05 | 0.11 | -13.06 | 1.31 | 0.07 | 9.64 | 0.23 | 0.29 | 0.22 | 0.25 |
| SEQID-00278 | 0.02 | 0.08 | 0.06 | 0.06 | 0.06 | 0.05 | 0.11 | 0.11 | 0.07 | -18.57 | 0.24 | -0.01 | 5.38 | 0.25 | 0.38 | 0.20 | 0.21 |
| SEQID-00279 | 0.00 | 0.00 | 0.00 | 0.01 | 0.04 | 0.00 | 0.00 | 0.02 | 0.00 | -36.27 | 0.40 | -0.09 | 4.42 | 0.35 | 0.29 | 0.00 | 0.00 |
| SEQID-00280 | 0.00 | 0.00 | 0.00 | 0.01 | 0.03 | 0.00 | 0.00 | 0.02 | 0.00 | -37.26 | 0.37 | -0.07 | 4.55 | 0.35 | 0.28 | 0.00 | 0.00 |
| SEQID-00281 | 0.02 | 0.05 | 0.03 | 0.03 | 0.05 | 0.05 | 0.06 | 0.06 | 0.08 | -19.78 | 0.35 | -0.03 | 5.12 | 0.21 | 0.33 | 0.00 | 0.20 |
| SEQID-00282 | 0.04 | 0.10 | 0.03 | 0.03 | 0.07 | 0.06 | 0.00 | 0.00 | 0.10 | -19.86 | 1.03 | 0.09 | 9.58 | 0.44 | 0.14 | 0.42 | 0.38 |
| SEQID-00283 | 0.02 | 0.05 | 0.02 | 0.05 | 0.05 | 0.01 | 0.05 | 0.05 | 0.08 | -26.91 | 0.45 | 0.12 | 10.39 | 0.28 | 0.18 | 0.30 | 0.22 |
| SEQID-00284 | 0.04 | 0.04 | 0.03 | 0.01 | 0.05 | 0.03 | 0.04 | 0.04 | 0.08 | -25.52 | 0.46 | 0.01 | 7.51 | 0.23 | 0.29 | 0.00 | 0.25 |
| SEQID-00285 | 0.04 | 0.06 | 0.01 | 0.01 | 0.07 | 0.03 | 0.02 | 0.02 | 0.08 | -25.31 | 0.52 | 0.09 | 10.56 | 0.31 | 0.23 | 0.00 | 0.00 |
| SEQID-00286 | 0.04 | 0.05 | 0.00 | 0.03 | 0.06 | 0.06 | 0.04 | 0.05 | 0.09 | -20.36 | 0.77 | 0.06 | 9.29 | 0.34 | 0.28 | 0.31 | 0.22 |
| SEQID-00287 | 0.02 | 0.05 | 0.00 | 0.04 | 0.06 | 0.02 | 0.04 | 0.04 | 0.08 | -23.00 | 0.80 | -0.02 | 5.64 | 0.29 | 0.27 | 0.00 | 0.24 |
| SEQID-00288 | 0.03 | 0.03 | 0.03 | 0.06 | 0.05 | 0.04 | 0.04 | 0.04 | 0.07 | -21.14 | 0.53 | 0.01 | 7.38 | 0.20 | 0.33 | 0.19 | 0.17 |
| SEQID-00289 | 0.04 | 0.07 | 0.02 | 0.06 | 0.06 | 0.06 | 0.03 | 0.03 | 0.08 | -20.21 | 0.69 | 0.01 | 7.63 | 0.23 | 0.33 | 0.00 | 0.21 |
| SEQID-00290 | 0.04 | 0.04 | 0.05 | 0.05 | 0.04 | 0.01 | 0.04 | 0.04 | 0.08 | -19.04 | 0.52 | 0.00 | 6.72 | 0.21 | 0.32 | 0.00 | 0.19 |
| SEQID-00291 | 0.01 | 0.07 | 0.02 | 0.05 | 0.03 | 0.04 | 0.03 | 0.03 | 0.08 | -20.82 | 0.80 | -0.02 | 5.66 | 0.23 | 0.27 | 0.00 | 0.25 |
| SEQID-00292 | 0.02 | 0.05 | 0.00 | 0.00 | 0.06 | 0.02 | 0.02 | 0.02 | 0.07 | -23.98 | 0.70 | 0.00 | 5.64 | 0.29 | 0.25 | 0.27 | 0.25 |
| SEQID-00293 | 0.02 | 0.05 | 0.01 | 0.01 | 0.07 | 0.01 | 0.06 | 0.06 | 0.08 | -22.45 | 0.79 | -0.02 | 5.64 | 0.28 | 0.27 | 0.00 | 0.24 |
| SEQID-00294 | 0.02 | 0.07 | 0.01 | 0.01 | 0.06 | 0.04 | 0.04 | 0.04 | 0.08 | -22.10 | 0.80 | -0.02 | 5.64 | 0.28 | 0.27 | 0.28 | 0.25 |
| SEQID-00295 | 0.02 | 0.05 | 0.02 | 0.04 | 0.07 | 0.02 | 0.04 | 0.04 | 0.07 | -22.75 | 0.77 | -0.02 | 5.64 | 0.30 | 0.28 | 0.31 | 0.24 |
| SEQID-00296 | 0.02 | 0.05 | 0.00 | 0.05 | 0.05 | 0.02 | 0.04 | 0.04 | 0.07 | -23.28 | 0.71 | -0.03 | 5.00 | 0.29 | 0.28 | 0.28 | 0.25 |
| SEQID-00297 | 0.03 | 0.06 | 0.02 | 0.03 | 0.03 | 0.02 | 0.02 | 0.02 | 0.05 | -22.84 | 0.36 | 0.01 | 7.50 | 0.24 | 0.30 | 0.23 | 0.24 |
| SEQID-00298 | 0.03 | 0.06 | 0.02 | 0.03 | 0.03 | 0.02 | 0.02 | 0.02 | 0.05 | -22.93 | 0.57 | 0.01 | 7.54 | 0.29 | 0.30 | 0.23 | 0.22 |
| SEQID-00299 | 0.03 | 0.06 | 0.02 | 0.04 | 0.03 | 0.02 | 0.02 | 0.02 | 0.05 | -23.45 | 0.34 | -0.18 | 7.38 | 0.24 | 0.27 | 0.21 | 0.13 |
| SEQID-00300 | 0.02 | 0.07 | 0.04 | 0.03 | 0.03 | 0.02 | 0.05 | 0.05 | 0.06 | -29.09 | 0.40 | -0.17 | 3.78 | 0.22 | 0.31 | 0.00 | 0.23 |
| SEQID-00301 | 0.03 | 0.07 | 0.04 | 0.04 | 0.03 | 0.04 | 0.05 | 0.05 | 0.07 | -28.15 | 0.40 | -0.03 | 3.78 | 0.23 | 0.31 | 0.00 | 0.21 |
| SEQID-00302 | 0.02 | 0.05 | 0.03 | 0.03 | 0.05 | 0.06 | 0.02 | 0.02 | 0.08 | -19.36 | 0.48 | -0.03 | 4.71 | 0.20 | 0.33 | 0.21 | 0.22 |
| SEQID-00303 | 0.03 | 0.06 | 0.04 | 0.06 | 0.06 | 0.05 | 0.06 | 0.06 | 0.05 | -19.91 | 0.43 | -0.03 | 5.01 | 0.21 | 0.31 | 0.00 | 0.23 |
| SEQID-00304 | 0.03 | 0.04 | 0.04 | 0.03 | 0.04 | 0.04 | 0.08 | 0.08 | 0.07 | -23.25 | 0.38 | -0.06 | 5.16 | 0.21 | 0.32 | 0.00 | 0.18 |
| SEQID-00305 | 0.01 | 0.03 | 0.03 | 0.07 | 0.06 | 0.01 | 0.05 | 0.05 | 0.05 | -18.71 | 0.40 | -0.02 | 8.31 | 0.20 | 0.33 | 0.00 | 0.21 |
| SEQID-00306 | 0.04 | 0.05 | 0.05 | 0.08 | 0.04 | 0.02 | 0.02 | 0.02 | 0.09 | -20.25 | 0.45 | 0.01 | 8.46 | 0.23 | 0.33 | 0.21 | 0.23 |
| SEQID-00307 | 0.02 | 0.06 | 0.04 | 0.04 | 0.05 | 0.02 | 0.06 | 0.06 | 0.04 | -20.51 | 0.44 | 0.02 | 9.38 | 0.00 | 0.31 | 0.00 | 0.21 |
| SEQID-00308 | 0.02 | 0.04 | 0.04 | 0.05 | 0.06 | 0.02 | 0.04 | 0.04 | 0.05 | -20.65 | 0.37 | 0.00 | 7.10 | 0.22 | 0.33 | 0.22 | 0.22 |
| SEQID-00309 | 0.02 | 0.02 | 0.05 | 0.05 | 0.05 | 0.05 | 0.07 | 0.07 | 0.04 | -21.70 | 0.29 | -0.04 | 4.65 | 0.23 | 0.33 | 0.20 | 0.20 |
| SEQID-00310 | 0.05 | 0.09 | 0.04 | 0.03 | 0.04 | 0.03 | 0.05 | 0.05 | 0.06 | -20.85 | 0.36 | 0.00 | 7.29 | 0.32 | 0.32 | 0.24 | 0.25 |
| SEQID-00311 | 0.03 | 0.08 | 0.04 | 0.04 | 0.04 | 0.03 | 0.07 | 0.07 | 0.05 | -19.63 | 0.26 | 0.05 | 9.70 | 0.30 | 0.30 | 0.25 | 0.23 |
| SEQID-00312 | 0.04 | 0.03 | 0.03 | 0.04 | 0.06 | 0.01 | 0.05 | 0.05 | 0.07 | -20.18 | 0.48 | -0.06 | 4.54 | 0.00 | 0.30 | 0.00 | 0.00 |
| SEQID-00313 | 0.03 | 0.04 | 0.04 | 0.07 | 0.06 | 0.02 | 0.05 | 0.05 | 0.07 | -20.16 | 0.44 | -0.02 | 5.53 | 0.21 | 0.34 | 0.22 | 0.22 |
| SEQID-00314 | 0.06 | 0.05 | 0.02 | 0.05 | 0.07 | 0.04 | 0.04 | 0.04 | 0.04 | -23.28 | 0.41 | 0.05 | 10.12 | 0.21 | 0.33 | 0.16 | 0.19 |
| SEQID-00315 | 0.03 | 0.06 | 0.03 | 0.04 | 0.05 | 0.06 | 0.04 | 0.04 | 0.04 | -21.95 | 0.32 | -0.04 | 4.83 | 0.18 | 0.31 | 0.00 | 0.13 |
| SEQID-00316 | 0.03 | 0.07 | 0.04 | 0.05 | 0.06 | 0.04 | 0.03 | 0.03 | 0.04 | -20.35 | 0.36 | 0.02 | 8.34 | 0.21 | 0.33 | 0.19 | 0.20 |
| SEQID-00317 | 0.03 | 0.05 | 0.02 | 0.08 | 0.08 | 0.01 | 0.04 | 0.04 | 0.05 | -20.14 | 0.25 | -0.02 | 4.83 | 0.00 | 0.33 | 0.00 | 0.00 |
| SEQID-00318 | 0.02 | 0.06 | 0.04 | 0.06 | 0.05 | 0.05 | 0.04 | 0.04 | 0.04 | -17.30 | 0.36 | -0.01 | 6.18 | 0.21 | 0.34 | 0.22 | 0.21 |
| SEQID-00319 | 0.03 | 0.05 | 0.03 | 0.04 | 0.03 | 0.04 | 0.07 | 0.07 | 0.06 | -19.59 | 0.36 | -0.02 | 6.07 | 0.20 | 0.33 | 0.20 | 0.20 |
| SEQID-00320 | 0.03 | 0.06 | 0.02 | 0.02 | 0.03 | 0.03 | 0.07 | 0.07 | 0.04 | -28.07 | 0.20 | -0.01 | 6.59 | 0.23 | 0.34 | 0.22 | 0.21 |
| SEQID-00321 | 0.04 | 0.04 | 0.02 | 0.05 | 0.03 | 0.01 | 0.07 | 0.07 | 0.06 | -22.70 | 0.40 | 0.03 | 9.29 | 0.23 | 0.33 | 0.00 | 0.00 |

TABLE 1-continued

| SEQID | | | | | | | | | | | | | | | | | |
|---|---|---|---|---|---|---|---|---|---|---|---|---|---|---|---|---|---|
| SEQID-00322 | 0.03 | 0.03 | 0.03 | 0.05 | 0.06 | 0.05 | 0.04 | 0.07 | 0.06 | -19.27 | 0.31 | -0.01 | 6.37 | 0.22 | 0.34 | 0.22 | 0.21 |
| SEQID-00323 | 0.01 | 0.06 | 0.04 | 0.06 | 0.04 | 0.06 | 0.03 | 0.07 | 0.04 | -21.48 | 0.31 | 0.04 | 9.36 | 0.00 | 0.33 | 0.00 | 0.00 |
| SEQID-00324 | 0.03 | 0.09 | 0.04 | 0.06 | 0.04 | 0.03 | 0.03 | 0.09 | 0.03 | -20.93 | 0.27 | -0.01 | 6.45 | 0.16 | 0.33 | 0.00 | 0.19 |
| SEQID-00325 | 0.02 | 0.03 | 0.04 | 0.03 | 0.05 | 0.05 | 0.01 | 0.14 | 0.05 | -22.26 | 0.22 | 0.04 | 9.39 | 0.23 | 0.30 | 0.21 | 0.00 |
| SEQID-00326 | 0.03 | 0.07 | 0.05 | 0.05 | 0.05 | 0.05 | 0.03 | 0.07 | 0.05 | -19.44 | 0.37 | -0.01 | 6.51 | 0.26 | 0.30 | 0.24 | 0.23 |
| SEQID-00327 | 0.03 | 0.06 | 0.02 | 0.08 | 0.08 | 0.02 | 0.01 | 0.04 | 0.06 | -22.60 | 0.39 | 0.00 | 6.53 | 0.26 | 0.29 | 0.30 | 0.00 |
| SEQID-00328 | 0.05 | 0.04 | 0.01 | 0.03 | 0.03 | 0.02 | 0.01 | 0.02 | 0.05 | -22.69 | 0.22 | 0.21 | 12.35 | 0.25 | 0.29 | 0.24 | 0.23 |
| SEQID-00329 | 0.02 | 0.01 | 0.03 | 0.06 | 0.05 | 0.05 | 0.01 | 0.03 | 0.12 | -26.69 | 0.27 | 0.18 | 11.94 | 0.24 | 0.23 | 0.20 | 0.25 |
| SEQID-00330 | 0.02 | 0.03 | 0.01 | 0.02 | 0.03 | 0.05 | 0.02 | 0.04 | 0.06 | -24.07 | 0.28 | 0.09 | 10.90 | 0.23 | 0.29 | 0.00 | 0.21 |
| SEQID-00331 | 0.03 | 0.04 | 0.02 | 0.07 | 0.04 | 0.03 | 0.04 | 0.07 | 0.04 | -19.13 | 0.41 | 0.04 | 9.73 | 0.22 | 0.30 | 0.24 | 0.27 |
| SEQID-00332 | 0.03 | 0.03 | 0.02 | 0.05 | 0.03 | 0.05 | 0.02 | 0.06 | 0.04 | -21.07 | 0.23 | -0.04 | 4.72 | 0.22 | 0.34 | 0.00 | 0.20 |
| SEQID-00333 | 0.02 | 0.07 | 0.01 | 0.03 | 0.03 | 0.04 | 0.04 | 0.08 | 0.05 | -19.36 | 0.44 | 0.05 | 9.83 | 0.18 | 0.31 | 0.28 | 0.22 |
| SEQID-00334 | 0.02 | 0.05 | 0.03 | 0.03 | 0.04 | 0.01 | 0.01 | 0.05 | 0.06 | -26.57 | 0.23 | 0.10 | 10.93 | 0.00 | 0.33 | 0.00 | 0.20 |
| SEQID-00335 | 0.03 | 0.01 | 0.04 | 0.04 | 0.04 | 0.01 | 0.01 | 0.07 | 0.07 | -21.68 | 0.28 | 0.10 | 11.31 | 0.22 | 0.30 | 0.00 | 0.26 |
| SEQID-00336 | 0.05 | 0.02 | 0.04 | 0.07 | 0.05 | 0.02 | 0.02 | 0.03 | 0.05 | -29.65 | 0.18 | 0.22 | 12.00 | 0.24 | 0.32 | 0.18 | 0.23 |
| SEQID-00337 | 0.01 | 0.08 | 0.05 | 0.02 | 0.02 | 0.04 | 0.02 | 0.06 | 0.06 | -20.90 | 0.36 | 0.00 | 6.86 | 0.19 | 0.34 | 0.00 | 0.00 |
| SEQID-00338 | 0.04 | 0.03 | 0.05 | 0.04 | 0.05 | 0.05 | 0.02 | 0.02 | 0.04 | -21.97 | 0.28 | -0.01 | 6.37 | 0.00 | 0.35 | 0.00 | 0.00 |
| SEQID-00339 | 0.02 | 0.02 | 0.03 | 0.03 | 0.04 | 0.04 | 0.04 | 0.06 | 0.05 | -25.07 | 0.25 | -0.03 | 5.57 | 0.19 | 0.30 | 0.25 | 0.23 |
| SEQID-00340 | 0.04 | 0.02 | 0.03 | 0.04 | 0.05 | 0.04 | 0.02 | 0.04 | 0.07 | -22.52 | 0.30 | 0.05 | 10.51 | 0.21 | 0.31 | 0.21 | 0.22 |
| SEQID-00341 | 0.03 | 0.02 | 0.03 | 0.09 | 0.05 | 0.01 | 0.01 | 0.07 | 0.04 | -23.40 | 0.23 | -0.06 | 4.54 | 0.21 | 0.31 | 0.00 | 0.21 |
| SEQID-00342 | 0.04 | 0.07 | 0.03 | 0.05 | 0.06 | 0.03 | 0.03 | 0.04 | 0.03 | -20.62 | 0.33 | 0.02 | 9.39 | 0.24 | 0.32 | 0.00 | 0.20 |
| SEQID-00343 | 0.01 | 0.03 | 0.01 | 0.04 | 0.04 | 0.01 | 0.01 | 0.06 | 0.06 | -26.83 | 0.33 | 0.02 | 8.41 | 0.22 | 0.31 | 0.00 | 0.21 |
| SEQID-00344 | 0.01 | 0.02 | 0.06 | 0.07 | 0.05 | 0.02 | 0.02 | 0.04 | 0.07 | -16.90 | 0.50 | 0.03 | 0.12 | 0.22 | 0.31 | 0.00 | 0.00 |
| SEQID-00345 | 0.03 | 0.05 | 0.05 | 0.02 | 0.06 | 0.04 | 0.01 | 0.08 | 0.06 | -18.75 | 0.39 | -0.02 | 5.68 | 0.20 | 0.34 | 0.19 | 0.20 |
| SEQID-00346 | 0.02 | 0.05 | 0.03 | 0.03 | 0.05 | 0.01 | 0.02 | 0.06 | 0.07 | -19.87 | 0.46 | -0.02 | 5.27 | 0.21 | 0.31 | 0.00 | 0.23 |
| SEQID-00347 | 0.03 | 0.05 | 0.03 | 0.08 | 0.05 | 0.01 | 0.01 | 0.05 | 0.05 | -21.72 | 0.35 | -0.01 | 6.27 | 0.23 | 0.33 | 0.00 | 1.00 |
| SEQID-00348 | 0.03 | 0.04 | 0.03 | 0.05 | 0.05 | 0.03 | 0.03 | 0.02 | 0.12 | -18.43 | 0.59 | -0.01 | 7.75 | 0.24 | 0.33 | 0.21 | 0.22 |
| SEQID-00349 | 0.04 | 0.02 | 0.04 | 0.06 | 0.04 | 0.05 | 0.05 | 0.08 | 0.06 | -21.95 | 0.32 | -0.02 | 6.35 | 0.20 | 0.31 | 0.00 | 0.21 |
| SEQID-00350 | 0.02 | 0.05 | 0.03 | 0.05 | 0.03 | 0.05 | 0.00 | 0.03 | 0.05 | -18.20 | 0.43 | 0.02 | 8.65 | 0.00 | 0.32 | 0.00 | 0.23 |
| SEQID-00351 | 0.02 | 0.05 | 0.04 | 0.06 | 0.06 | 0.04 | 0.01 | 0.03 | 0.09 | -19.26 | 0.50 | -0.01 | 6.19 | 0.23 | 0.34 | 0.00 | 0.22 |
| SEQID-00352 | 0.02 | 0.05 | 0.04 | 0.04 | 0.04 | 0.06 | 0.03 | 0.03 | 0.09 | -30.47 | 0.53 | -0.01 | 5.58 | 0.23 | 0.33 | 0.00 | 0.21 |
| SEQID-00353 | 0.03 | 0.05 | 0.05 | 0.06 | 0.03 | 0.06 | 0.02 | 0.08 | 0.07 | -17.60 | 0.45 | -0.03 | 4.69 | 0.21 | 0.32 | 0.00 | 0.20 |
| SEQID-00354 | 0.04 | 0.05 | 0.04 | 0.05 | 0.04 | 0.04 | 0.02 | 0.02 | 0.09 | -20.25 | 0.45 | 0.01 | 8.46 | 0.23 | 0.33 | 0.00 | 0.23 |
| SEQID-00355 | 0.02 | 0.07 | 0.05 | 0.08 | 0.07 | 0.01 | 0.01 | 0.02 | 0.06 | -17.37 | 0.50 | 0.00 | 6.65 | 0.21 | 0.35 | 0.00 | 1.00 |
| SEQID-00356 | 0.01 | 0.05 | 0.05 | 0.05 | 0.05 | 0.04 | 0.03 | 0.02 | 0.09 | -19.88 | 0.46 | -0.02 | 4.98 | 0.21 | 0.33 | 0.00 | 0.22 |
| SEQID-00357 | 0.03 | 0.02 | 0.05 | 0.05 | 0.04 | 0.01 | 0.01 | 0.03 | 0.06 | -18.65 | 0.48 | -0.02 | 5.37 | 0.21 | 0.34 | 0.21 | 0.21 |
| SEQID-00358 | 0.04 | 0.07 | 0.04 | 0.03 | 0.06 | 0.03 | 0.03 | 0.03 | 0.05 | -20.25 | 0.37 | -0.01 | 6.46 | 0.20 | 0.35 | 0.20 | 0.21 |
| SEQID-00359 | 0.03 | 0.02 | 0.04 | 0.05 | 0.04 | 0.01 | 0.01 | 0.03 | 0.06 | -22.70 | 0.38 | -0.02 | 9.34 | 0.21 | 0.34 | 0.21 | 0.22 |
| SEQID-00360 | 0.03 | 0.06 | 0.05 | 0.04 | 0.04 | 0.04 | 0.04 | 0.07 | 0.06 | -19.19 | 0.37 | -0.02 | 5.22 | 0.21 | 0.33 | 0.21 | 0.21 |
| SEQID-00361 | 0.03 | 0.06 | 0.04 | 0.04 | 0.04 | 0.00 | 0.00 | 0.04 | 0.07 | -22.15 | 0.34 | 0.00 | 6.94 | 0.00 | 0.31 | 0.00 | 0.22 |
| SEQID-00362 | 0.03 | 0.07 | 0.05 | 0.05 | 0.04 | 0.02 | 0.00 | 0.06 | 0.06 | -23.27 | 0.34 | -0.01 | 6.22 | 0.21 | 0.33 | 0.19 | 0.21 |
| SEQID-00363 | 0.00 | 0.05 | 0.03 | 0.11 | 0.11 | 0.05 | 0.05 | 0.07 | 0.06 | -15.13 | 0.40 | -0.06 | 3.96 | 0.21 | 0.33 | 0.00 | 0.22 |
| SEQID-00364 | 0.03 | 0.02 | 0.07 | 0.01 | 0.02 | 0.11 | 0.04 | 0.14 | 0.03 | -45.75 | 0.03 | -0.24 | 4.02 | 0.30 | 0.23 | 0.28 | 0.21 |
| SEQID-00365 | 0.01 | 0.03 | 0.04 | 0.03 | 0.03 | 0.04 | 0.15 | 0.05 | 0.03 | -24.44 | 0.13 | 0.04 | 8.21 | 0.26 | 0.27 | 0.28 | 0.29 |
| SEQID-00366 | 0.00 | 0.14 | 0.07 | 0.06 | 0.05 | 0.15 | 0.13 | 0.04 | 0.01 | -22.70 | 0.11 | 0.04 | 10.10 | 0.27 | 0.24 | 0.00 | 0.27 |
| SEQID-00367 | 0.02 | 0.02 | 0.04 | 0.05 | 0.05 | 0.00 | 0.00 | 0.22 | 0.01 | -27.90 | 0.00 | -0.17 | 3.77 | 0.30 | 0.27 | 0.28 | 0.26 |
| SEQID-00368 | 0.03 | 0.05 | 0.01 | 0.04 | 0.04 | 0.02 | 0.02 | 0.02 | 0.02 | -26.53 | 0.31 | -0.04 | 4.88 | 0.23 | 0.26 | 0.00 | 0.21 |
| SEQID-00369 | 0.02 | 0.00 | 0.00 | 0.03 | 0.06 | 0.00 | 0.00 | 0.00 | 0.03 | -22.97 | 0.22 | 0.01 | 7.80 | 0.21 | 0.30 | 0.00 | 0.00 |
| SEQID-00370 | 0.02 | 0.02 | 0.00 | 0.01 | 0.04 | 0.00 | 0.00 | 0.00 | 0.02 | -25.72 | 0.17 | -0.03 | 4.31 | 0.35 | 0.31 | 0.00 | 0.32 |
| SEQID-00371 | 0.01 | 0.01 | 0.01 | 0.02 | 0.03 | 0.02 | 0.02 | 0.03 | 0.03 | -32.01 | 0.12 | -0.15 | 4.19 | 0.34 | 0.34 | 0.19 | 0.25 |
| SEQID-00372 | 0.03 | 0.05 | 0.05 | 0.02 | 0.02 | 0.02 | 0.02 | 0.06 | 0.04 | -24.83 | 0.16 | -0.01 | 5.63 | 0.27 | 0.23 | 0.00 | 0.00 |
| SEQID-00373 | 0.01 | 0.05 | 0.04 | 0.09 | 0.02 | 0.02 | 0.02 | 0.03 | 0.03 | -23.94 | 0.21 | -0.02 | 5.07 | 0.27 | 0.26 | 0.00 | 0.29 |
| SEQID-00374 | 0.03 | 0.06 | 0.01 | 0.03 | 0.03 | 0.04 | 0.04 | 0.03 | 0.08 | -25.39 | 0.30 | 0.05 | 10.23 | 0.25 | 0.27 | 0.00 | 0.24 |

TABLE 1-continued

| | | | | | | | | | | | | | | | |
|---|---|---|---|---|---|---|---|---|---|---|---|---|---|---|---|
| SEQID-00375 | 0.03 | 0.04 | 0.04 | 0.03 | 0.02 | 0.02 | 0.07 | -28.50 | 0.25 | 0.14 | 11.20 | 0.31 | 0.26 | 0.00 | 0.21 |
| SEQID-00376 | 0.01 | 0.02 | 0.04 | 0.02 | 0.05 | 0.05 | 0.09 | -24.79 | 0.46 | 0.11 | 11.40 | 0.26 | 0.31 | 0.27 | 0.23 |
| SEQID-00377 | 0.00 | 0.02 | 0.00 | 0.05 | 0.09 | 0.01 | 0.04 | -24.99 | 0.04 | -0.13 | 3.98 | 0.24 | 0.35 | 0.22 | 0.00 |
| SEQID-00378 | 0.02 | 0.01 | 0.02 | 0.06 | 0.05 | 0.01 | 0.03 | -25.00 | 0.15 | -0.07 | 4.35 | 0.29 | 0.33 | 0.00 | 0.25 |
| SEQID-00379 | 0.01 | 0.01 | 0.00 | 0.02 | 0.03 | 0.02 | 0.05 | -25.41 | 0.18 | -0.02 | 6.12 | 0.35 | 0.35 | 0.24 | 0.27 |
| SEQID-00380 | 0.02 | 0.02 | 0.00 | 0.06 | 0.04 | 0.00 | 0.02 | -28.46 | 0.17 | -0.05 | 4.69 | 0.29 | 0.33 | 0.00 | 0.23 |
| SEQID-00381 | 0.02 | 0.01 | 0.02 | 0.03 | 0.02 | 0.02 | 0.04 | -30.97 | 0.39 | 0.05 | 9.63 | 0.33 | 0.34 | 0.24 | 0.25 |
| SEQID-00382 | 0.03 | 0.02 | 0.04 | 0.04 | 0.01 | 0.01 | 0.08 | -33.88 | 0.23 | 0.14 | 11.31 | 0.25 | 0.29 | 0.30 | 0.21 |
| SEQID-00383 | 0.02 | 0.03 | 0.02 | 0.01 | 0.01 | 0.02 | 0.02 | -29.58 | 0.21 | 0.10 | 10.66 | 0.23 | 0.22 | 0.24 | 0.00 |
| SEQID-00384 | 0.02 | 0.05 | 0.01 | 0.03 | 0.03 | 0.02 | 0.05 | -25.11 | 0.31 | 0.12 | 11.78 | 0.29 | 0.30 | 0.00 | 0.00 |
| SEQID-00385 | 0.03 | 0.02 | 0.03 | 0.05 | 0.08 | 0.00 | 0.13 | -26.46 | 0.42 | 0.07 | 11.42 | 0.29 | 0.24 | 0.00 | 0.21 |
| SEQID-00386 | 0.02 | 0.00 | 0.04 | 0.14 | 0.04 | 0.03 | 0.06 | -19.07 | 0.39 | -0.03 | 4.51 | 0.24 | 0.30 | 0.00 | 0.24 |
| SEQID-00387 | 0.03 | 0.01 | 0.05 | 0.06 | 0.04 | 0.02 | 0.11 | -23.24 | 0.49 | 0.02 | 9.25 | 0.00 | 0.30 | 0.00 | 0.23 |
| SEQID-00388 | 0.03 | 0.01 | 0.05 | 0.06 | 0.04 | 0.00 | 0.11 | -23.34 | 0.50 | 0.0; | 9.30 | 0.25 | 0.30 | 0.22 | 0.24 |
| SEQID-00389 | 0.03 | 0.01 | 0.05 | 0.04 | 0.03 | 0.00 | 0.11 | -21.13 | 0.37 | 0.09 | 10.92 | 0.21 | 0.33 | 0.00 | 0.25 |
| SEQID-00390 | 0.02 | 0.03 | 0.03 | 0.05 | 0.07 | 0.02 | 0.04 | -21.63 | 0.38 | 0.01 | 9.14 | 0.00 | 0.30 | 0.00 | 0.00 |
| SEQID-00391 | 0.03 | 0.02 | 0.04 | 0.08 | 0.06 | 0.02 | 0.06 | -20.87 | 0.38 | -0.02 | 5.05 | 0.22 | 0.34 | 0.00 | 0.22 |
| SEQID-00392 | 0.02 | 0.06 | 0.03 | 0.04 | 0.05 | 0.02 | 0.04 | -22.88 | 0.23 | -0.04 | 4.76 | 0.18 | 0.31 | 0.00 | 0.00 |
| SEQID-00393 | 0.03 | 0.04 | 0.04 | 0.06 | 0.06 | 0.04 | 0.03 | -19.96 | 0.35 | 0.01 | 8.65 | 0.21 | 0.33 | 0.00 | 0.00 |
| SEQID-00394 | 0.02 | 0.05 | 0.04 | 0.05 | 0.06 | 0.05 | 0.04 | -17.65 | 0.27 | -0.02 | 5.57 | 0.19 | 0.33 | 0.00 | 0.28 |
| SEQID-00395 | 0.02 | 0.05 | 0.06 | 0.06 | 0.03 | 0.02 | 0.06 | -18.60 | 0.38 | -0.04 | 4.52 | 0.21 | 0.32 | 0.00 | 0.00 |
| SEQID-00396 | 0.01 | 0.04 | 0.00 | 0.05 | 0.06 | 0.02 | 0.04 | -25.26 | 0.21 | 0.01 | 8.44 | 0.17 | 0.30 | 0.18 | 0.22 |
| SEQID-00397 | 0.01 | 0.04 | 0.06 | 0.06 | 0.06 | 0.04 | 0.04 | -20.27 | 0.20 | 0.06 | 10.19 | 0.21 | 0.31 | 0.00 | 0.25 |
| SEQID-00398 | 0.04 | 0.03 | 0.04 | 0.04 | 0.05 | 0.02 | 0.06 | -21.47 | 0.27 | 0.01 | 3.63 | 0.22 | 0.32 | 0.00 | 0.21 |
| SEQID-00399 | 0.02 | 0.03 | 0.03 | 0.05 | 0.04 | 0.02 | 0.06 | -25.17 | 0.29 | -0.05 | 4.89 | 0.20 | 0.34 | 0.00 | 0.00 |
| SEQID-00400 | 0.03 | 0.06 | 0.01 | 0.05 | 0.07 | 0.04 | 0.06 | -23.79 | 0.29 | -0.01 | 6.64 | 0.23 | 0.30 | 0.00 | 0.20 |
| SEQID-00401 | 0.01 | 0.05 | 0.04 | 0.05 | 0.10 | 0.04 | 0.08 | -18.97 | 0.39 | -0.01 | 5.14 | 0.27 | 0.31 | 0.00 | 0.00 |
| SEQID-00402 | 0.01 | 0.03 | 0.04 | 0.05 | 0.06 | 0.02 | 0.06 | -25.96 | 0.30 | 0.00 | 7.19 | 0.21 | 0.32 | 0.00 | 0.28 |
| SEQID-00403 | 0.02 | 0.04 | 0.02 | 0.07 | 0.07 | 0.05 | 0.05 | -21.38 | 0.33 | 0.00 | 6.70 | 0.22 | 0.33 | 0.00 | 0.22 |
| SEQID-00404 | 0.02 | 0.06 | 0.04 | 0.07 | 0.14 | 0.01 | 0.04 | -16.05 | 0.35 | 0.03 | 9.57 | 0.21 | 0.30 | 0.18 | 0.25 |
| SEQID-00405 | 0.02 | 0.03 | 0.04 | 0.10 | 0.06 | 0.03 | 0.03 | -15.43 | 0.25 | 0.06 | 6.53 | 0.19 | 0.33 | 0.00 | 0.21 |
| SEQID-00406 | 0.02 | 0.07 | 0.03 | 0.05 | 0.06 | 0.01 | 0.04 | -24.16 | 0.24 | -0.02 | 4.90 | 0.20 | 0.31 | 0.00 | 0.00 |
| SEQID-00407 | 0.02 | 0.05 | 0.03 | 0.07 | 0.07 | 0.04 | 0.05 | -17.75 | 0.22 | -0.02 | 5.71 | 0.21 | 0.33 | 0.00 | 0.21 |
| SEQID-00408 | 0.02 | 0.05 | 0.06 | 0.05 | 0.07 | 0.02 | 0.03 | -18.90 | 0.25 | -0.05 | 4.66 | 0.22 | 0.31 | 0.00 | 0.00 |
| SEQID-00409 | 0.02 | 0.05 | 0.05 | 0.05 | 0.05 | 0.06 | 0.06 | -18.43 | 0.31 | -0.03 | 4.61 | 0.22 | 0.33 | 0.21 | 0.21 |
| SEQID-00410 | 0.03 | 0.04 | 0.04 | 0.06 | 0.07 | 0.06 | 0.06 | -15.30 | 0.48 | -0.04 | 4.32 | 0.00 | 0.31 | 0.23 | 0.00 |
| SEQID-00411 | 0.03 | 0.04 | 0.04 | 0.06 | 0.10 | 0.02 | 0.08 | -20.87 | 0.35 | -0.04 | 5.28 | 0.19 | 0.33 | 0.00 | 0.22 |
| SEQID-00412 | 0.02 | 0.06 | 0.02 | 0.06 | 0.06 | 0.03 | 0.06 | -18.00 | 0.33 | -0.02 | 4.78 | 0.20 | 0.33 | 0.18 | 0.20 |
| SEQID-00413 | 0.01 | 0.05 | 0.05 | 0.06 | 0.10 | 0.09 | 0.06 | -15.67 | 0.31 | -0.03 | 4.36 | 0.21 | 0.33 | 0.00 | 0.22 |
| SEQID-00414 | 0.01 | 0.05 | 0.04 | 0.04 | 0.06 | 0.04 | 0.06 | -16.00 | 0.35 | -0.04 | 4.79 | 0.19 | 0.34 | 0.00 | 0.22 |
| SEQID-00415 | 0.02 | 0.06 | 0.05 | 0.05 | 0.07 | 0.03 | 0.06 | -16.54 | 0.34 | -0.03 | 4.83 | 0.19 | 0.33 | 0.20 | 0.21 |
| SEQID-00416 | 0.01 | 0.04 | 0.04 | 0.04 | 0.06 | 0.03 | 0.07 | -16.52 | 0.36 | -0.03 | 4.28 | 0.21 | 0.34 | 0.00 | 0.20 |
| SEQID-00417 | 0.02 | 0.04 | 0.04 | 0.07 | 0.09 | 0.04 | 0.06 | -17.25 | 0.33 | -0.05 | 6.40 | 0.21 | 0.33 | 0.22 | 0.00 |
| SEQID-00418 | 0.03 | 0.04 | 0.04 | 0.06 | 0.06 | 0.07 | 0.06 | -16.75 | 0.27 | -0.01 | 4.69 | 0.23 | 0.33 | 0.00 | 0.20 |
| SEQID-00419 | 0.02 | 0.04 | 0.05 | 0.06 | 0.06 | 0.06 | 0.06 | -16.77 | 0.32 | -0.04 | 4.34 | 0.26 | 0.36 | 0.00 | 0.20 |
| SEQID-00420 | 0.00 | 0.04 | 0.02 | 0.09 | 0.06 | 0.08 | 0.06 | -17.45 | 0.28 | 0.00 | 6.65 | 0.27 | 0.41 | 0.00 | 0.21 |
| SEQID-00421 | 0.01 | 0.06 | 0.05 | 0.07 | 0.06 | 0.08 | 0.06 | -15.20 | 0.37 | -0.03 | 4.87 | 0.20 | 0.37 | 0.23 | 0.00 |
| SEQID-00422 | 0.02 | 0.06 | 0.04 | 0.06 | 0.10 | 0.09 | 0.06 | -18.05 | 0.33 | -0.03 | 4.46 | 0.23 | 0.39 | 0.20 | 0.21 |
| SEQID-00423 | 0.01 | 0.05 | 0.03 | 0.07 | 0.05 | 0.01 | 0.05 | -21.13 | 0.21 | -0.03 | 5.23 | 0.23 | 0.36 | 0.00 | 0.20 |
| SEQID-00424 | 0.02 | 0.04 | 0.04 | 0.05 | 0.06 | 0.06 | 0.05 | -16.16 | 0.36 | -0.05 | 4.29 | 1.00 | 1.00 | 0.19 | 0.21 |
| SEQID-00425 | 0.01 | 0.07 | 0.04 | 0.06 | 0.04 | 0.11 | 0.06 | -22.68 | 0.27 | -0.03 | 5.42 | 0.19 | 0.32 | 0.20 | 0.20 |
| SEQID-00426 | 0.00 | 0.08 | 0.04 | 0.05 | 0.07 | 0.07 | 0.06 | -17.18 | 0.33 | -0.03 | 4.81 | 0.00 | 0.31 | 0.19 | 0.24 |
| SEQID-00427 | 0.01 | 0.07 | 0.07 | 0.06 | 0.07 | 0.06 | 0.06 | -13.64 | 0.49 | -0.01 | 5.68 | 0.22 | 0.34 | 0.21 | 0.23 |

TABLE 1-continued

| | | | | | | | | | | | | | | | |
|---|---|---|---|---|---|---|---|---|---|---|---|---|---|---|---|
| SEQID-00428 | 0.34 | 0.00 | 0.00 | 0.00 | 0.04 | 0.01 | 0.00 | 0.02 | 0.00 | −36.89 | 0.05 | −0.09 | 4.42 | 0.22 | 0.22 | 0.00 | 0.18 |
| SEQID-00429 | 0.00 | 0.00 | 0.00 | 0.00 | 0.04 | 0.01 | 0.00 | 0.02 | 0.00 | −43.92 | 0.00 | −0.01 | 6.93 | 0.23 | 0.23 | 0.25 | 0.34 |
| SEQID-00430 | 0.34 | 0.00 | 0.00 | 0.00 | 0.04 | 0.01 | 0.00 | 0.02 | 0.00 | −36.89 | 0.05 | −0.09 | 4.42 | 0.27 | 0.22 | 0.00 | 0.18 |
| SEQID-00431 | 0.00 | 0.00 | 0.00 | 0.00 | 0.04 | 0.01 | 0.00 | 0.02 | 0.00 | −43.92 | 0.00 | −0.01 | 6.93 | 0.28 | 0.23 | 0.25 | 0.54 |
| SEQID-00432 | 0.00 | 0.00 | 0.00 | 0.00 | 0.04 | 0.01 | 0.00 | 0.02 | 0.00 | −58.85 | 0.00 | 0.23 | 10.67 | 0.31 | 0.25 | 0.29 | 0.29 |
| SEQID-00433 | 0.00 | 0.00 | 0.00 | 0.00 | 0.04 | 0.01 | 0.00 | 0.02 | 0.00 | −58.85 | 0.00 | 0.23 | 11.81 | 0.36 | 0.30 | 0.23 | 0.31 |
| SEQID-00434 | 0.00 | 0.00 | 0.00 | 0.00 | 0.04 | 0.01 | 0.00 | 0.00 | 0.00 | −39.46 | 0.16 | −0.09 | 4.42 | 0.35 | 0.29 | 0.22 | 0.31 |
| SEQID-00435 | 0.00 | 0.00 | 0.00 | 0.00 | 0.02 | 0.01 | 0.00 | 0.02 | 0.00 | −40.87 | 0.28 | 0.02 | 9.33 | 0.38 | 0.31 | 0.29 | 0.26 |
| SEQID-00436 | 0.03 | 0.07 | 0.00 | 0.05 | 0.08 | 0.00 | 0.05 | 0.00 | 0.05 | −38.16 | 0.35 | −0.06 | 5.16 | 0.28 | 0.22 | 0.00 | 0.00 |
| SEQID-00437 | 0.03 | 0.07 | 0.00 | 0.05 | 0.11 | 0.01 | 0.05 | 0.00 | 0.05 | −26.97 | 0.27 | 0.36 | 12.12 | 0.28 | 0.23 | 0.00 | 0.00 |
| SEQID-00438 | 0.00 | 0.00 | 0.00 | 0.00 | 0.04 | 0.01 | 0.00 | 0.02 | 0.00 | −36.42 | 0.25 | −0.09 | 4.42 | 0.32 | 0.26 | 0.27 | 0.00 |
| SEQID-00439 | 0.00 | 0.00 | 0.00 | 0.00 | 0.04 | 0.01 | 0.00 | 0.02 | 0.10 | −36.42 | 0.19 | −0.09 | 4.42 | 0.33 | 0.27 | 0.00 | 0.00 |
| SEQID-00440 | 0.00 | 0.15 | 0.00 | 0.00 | 0.04 | 0.01 | 0.00 | 0.02 | 0.00 | −36.51 | 0.07 | −0.09 | 4.42 | 0.30 | 0.25 | 0.00 | 0.29 |
| SEQID-00441 | 0.00 | 0.00 | 0.00 | 0.18 | 0.04 | 0.01 | 0.00 | 0.02 | 0.00 | −37.14 | 0.07 | −0.06 | 6.07 | 0.35 | 0.27 | 0.30 | 0.00 |
| SEQID-00442 | 0.00 | 0.00 | 0.00 | 0.00 | 0.15 | 0.01 | 0.00 | 0.02 | 0.00 | −37.04 | 0.15 | −0.09 | 4.42 | 0.30 | 0.23 | 0.00 | 0.25 |
| SEQID-00443 | 0.13 | 0.00 | 0.00 | 0.00 | 0.04 | 0.01 | 0.00 | 0.02 | 0.00 | −36.60 | 0.05 | −0.09 | 4.42 | 0.33 | 0.25 | 0.00 | 0.00 |
| SEQID-00444 | 0.00 | 0.00 | 0.00 | 0.00 | 0.04 | 0.01 | 0.01 | 0.02 | 0.00 | −33.92 | 0.04 | −0.06 | 6.07 | 0.33 | 0.27 | 0.00 | 0.32 |
| SEQID-00445 | 0.00 | 0.00 | 0.00 | 0.00 | 0.04 | 0.01 | 0.00 | 0.02 | 0.00 | −37.58 | 0.17 | −0.09 | 4.42 | 0.33 | 0.27 | 0.00 | 0.00 |
| SEQID-00446 | 0.00 | 0.00 | 0.00 | 0.00 | 0.04 | 0.01 | 0.00 | 0.02 | 0.00 | −38.20 | 0.04 | −0.06 | 4.55 | 0.37 | 0.30 | 0.00 | 0.25 |
| SEQID-00447 | 0.00 | 0.00 | 0.00 | 0.00 | 0.04 | 0.01 | 0.00 | 0.02 | 0.00 | −45.68 | 0.04 | 0.05 | 9.76 | 0.35 | 0.28 | 0.26 | 0.31 |
| SEQID-00448 | 0.00 | 0.00 | 0.00 | 0.00 | 0.04 | 0.01 | 0.00 | 0.02 | 0.00 | −45.68 | 0.04 | 0.05 | 11.23 | 0.38 | 0.31 | 0.00 | 0.00 |
| SEQID-00449 | 0.00 | 0.00 | 0.00 | 0.00 | 0.04 | 0.01 | 0.00 | 0.02 | 0.00 | −36.42 | 0.32 | −0.09 | 4.42 | 0.27 | 0.22 | 0.00 | 0.39 |
| SEQID-00450 | 0.00 | 0.00 | 0.00 | 0.00 | 0.04 | 0.01 | 0.00 | 0.02 | 0.28 | −36.42 | 0.28 | −0.09 | 4.42 | 0.29 | 0.23 | 0.00 | 0.34 |
| SEQID-00451 | 0.00 | 0.37 | 0.00 | 0.00 | 0.04 | 0.01 | 0.00 | 0.02 | 0.00 | −36.67 | 0.12 | −0.09 | 4.42 | 0.24 | 0.20 | 0.23 | 0.29 |
| SEQID-00452 | 0.00 | 0.00 | 0.00 | 0.00 | 0.03 | 0.01 | 0.42 | 0.02 | 0.00 | −38.31 | 0.00 | −0.09 | 4.42 | 0.74 | 0.20 | 0.26 | 0.22 |
| SEQID-00453 | 0.00 | 0.00 | 0.00 | 0.00 | 0.33 | 0.01 | 0.00 | 0.02 | 0.00 | −38.04 | 0.00 | −0.09 | 4.42 | 0.30 | 0.24 | 0.20 | 0.31 |
| SEQID-00454 | 0.00 | 0.00 | 0.00 | 0.00 | 0.00 | 0.00 | 0.00 | 0.00 | 0.00 | −46.29 | 0.00 | 0.67 | 13.81 | 0.37 | 0.28 | 0.00 | 0.27 |
| SEQID-00455 | 0.00 | 0.00 | 0.00 | 0.00 | 0.00 | 0.00 | 0.00 | 0.00 | 0.00 | −38.19 | 0.38 | 0.55 | 13.66 | 0.32 | 0.24 | 0.30 | 0.00 |
| SEQID-00456 | 0.00 | 0.00 | 0.00 | 0.00 | 0.00 | 0.00 | 0.00 | 0.00 | 0.00 | −30.09 | 0.62 | 0.43 | 13.62 | 0.33 | 0.25 | 0.00 | 0.00 |
| SEQID-00457 | 0.00 | 0.00 | 0.00 | 0.00 | 0.00 | 0.00 | 0.00 | 0.00 | 0.00 | −53.15 | 0.00 | −0.67 | 2.38 | 0.36 | 0.27 | 0.31 | 0.39 |
| SEQID-00458 | 0.00 | 0.00 | 0.00 | 0.00 | 0.00 | 0.00 | 0.00 | 0.00 | 0.00 | −43.89 | 0.46 | −0.55 | 2.44 | 0.32 | 0.24 | 0.37 | 0.34 |
| SEQID-00459 | 0.00 | 0.00 | 0.00 | 0.00 | 0.00 | 0.00 | 0.00 | 0.00 | 0.00 | −34.54 | 0.80 | −0.43 | 2.56 | 0.37 | 0.27 | 0.00 | 0.39 |
| SEQID-00460 | 0.00 | 0.00 | 0.00 | 0.00 | 0.00 | 0.00 | 0.00 | 0.00 | 0.00 | −49.89 | 0.00 | −0.03 | 5.00 | 0.39 | 0.29 | 0.00 | 0.33 |
| SEQID-00461 | 0.00 | 0.00 | 0.00 | 0.00 | 0.00 | 0.00 | 0.00 | 0.00 | 0.00 | −40.78 | 0.40 | 0.05 | 10.57 | 0.36 | 0.27 | 0.00 | 0.00 |
| SEQID-00462 | 0.00 | 0.00 | 0.00 | 0.00 | 0.00 | 0.00 | 0.00 | 0.00 | 0.00 | −32.52 | 0.72 | −0.03 | 4.79 | 0.34 | 0.26 | 0.00 | 0.00 |
| SEQID-00463 | 0.00 | 0.00 | 0.00 | 0.00 | 0.00 | 0.00 | 0.00 | 0.00 | 0.00 | −46.29 | 0.10 | 0.67 | 13.81 | 0.33 | 0.25 | 0.30 | 0.30 |
| SEQID-00464 | 0.00 | 0.00 | 0.00 | 0.00 | 0.00 | 0.00 | 0.00 | 0.00 | 0.00 | −40.50 | 0.37 | 0.58 | 13.76 | 0.28 | 0.21 | 0.00 | 0.31 |
| SEQID-00465 | 0.00 | 0.00 | 0.00 | 0.00 | 0.00 | 0.00 | 0.00 | 0.00 | 0.00 | −33.56 | 0.58 | 0.48 | 13.62 | 0.33 | 0.25 | 0.00 | 0.00 |
| SEQID-00466 | 0.00 | 0.00 | 0.00 | 0.00 | 0.00 | 0.00 | 0.00 | 0.00 | 0.00 | −53.15 | 0.15 | −0.67 | 2.38 | 0.35 | 0.27 | 0.00 | 0.30 |
| SEQID-00467 | 0.00 | 0.00 | 0.00 | 0.00 | 0.00 | 0.00 | 0.00 | 0.00 | 0.00 | −46.49 | 0.45 | −0.58 | 2.44 | 0.34 | 0.24 | 0.34 | 0.43 |
| SEQID-00468 | 0.00 | 0.00 | 0.00 | 0.00 | 0.00 | 0.00 | 0.00 | 0.00 | 0.00 | −38.56 | 0.69 | −0.48 | 2.50 | 0.32 | 0.25 | 0.38 | 0.34 |
| SEQID-00469 | 0.00 | 0.00 | 0.00 | 0.00 | 0.00 | 0.00 | 0.00 | 0.00 | 0.00 | −49.95 | 0.13 | −0.03 | 4.97 | 0.33 | 0.24 | 0.00 | 0.35 |
| SEQID-00470 | 0.00 | 0.00 | 0.00 | 0.00 | 0.00 | 0.00 | 0.00 | 0.00 | 0.00 | −43.82 | 0.43 | −0.05 | 4.72 | 0.31 | 0.25 | 0.00 | 0.33 |
| SEQID-00471 | 0.00 | 0.00 | 0.00 | 0.00 | 0.00 | 0.00 | 0.00 | 0.00 | 0.00 | −36.05 | 0.60 | 0.02 | 9.27 | 0.33 | 0.23 | 0.00 | 0.00 |
| SEQID-00472 | 0.00 | 0.00 | 0.00 | 0.00 | 0.00 | 0.00 | 0.00 | 0.00 | 0.00 | −48.60 | 0.78 | 0.70 | 13.83 | 0.29 | 0.22 | 0.00 | 0.30 |
| SEQID-00473 | 0.00 | 0.00 | 0.00 | 0.00 | 0.00 | 0.00 | 0.00 | 0.00 | 0.00 | −40.50 | 0.43 | 0.58 | 13.56 | 0.32 | 0.24 | 0.00 | 0.31 |
| SEQID-00474 | 0.00 | 0.00 | 0.00 | 0.00 | 0.00 | 0.00 | 0.00 | 0.00 | 0.00 | −33.56 | 0.90 | 0.48 | 13.68 | 0.31 | 0.23 | 0.00 | 0.00 |
| SEQID-00475 | 0.00 | 0.00 | 0.00 | 0.00 | 0.00 | 0.00 | 0.00 | 0.00 | 0.00 | −55.80 | 0.32 | −0.70 | 2.36 | 0.32 | 0.24 | 0.37 | 0.39 |
| SEQID-00476 | 0.00 | 0.00 | 0.00 | 0.00 | 0.00 | 0.00 | 0.00 | 0.00 | 0.00 | −46.64 | 0.53 | −0.58 | 2.40 | 0.28 | 0.21 | 0.30 | 0.32 |
| SEQID-00477 | 0.00 | 0.00 | 0.00 | 0.00 | 0.00 | 0.00 | 0.00 | 0.00 | 0.00 | −38.51 | 1.01 | −0.48 | 2.52 | 0.35 | 0.26 | 0.29 | 0.00 |
| SEQID-00478 | 0.00 | 0.00 | 0.00 | 0.00 | 0.00 | 0.00 | 0.00 | 0.00 | 0.00 | −52.37 | 0.31 | −0.03 | 5.03 | 0.32 | 0.24 | 0.00 | 0.30 |
| SEQID-00479 | 0.00 | 0.00 | 0.00 | 0.00 | 0.00 | 0.00 | 0.00 | 0.00 | 0.00 | −42.55 | 0.44 | 0.18 | 11.72 | 0.35 | 0.26 | 0.00 | 0.30 |
| SEQID-00480 | 0.00 | 0.00 | 0.00 | 0.00 | 0.00 | 0.00 | 0.00 | 0.00 | 0.00 | −36.35 | 0.97 | −0.05 | 4.63 | 0.32 | 0.24 | 0.00 | 0.00 |

TABLE 1-continued

| | | | | | | | | | | | | | | | |
|---|---|---|---|---|---|---|---|---|---|---|---|---|---|---|---|
| SEQID-00481 | 0.02 | 0.10 | 0.06 | 0.04 | 0.08 | 0.05 | 0.09 | 0.05 | −11.08 | 0.66 | 0.07 | 10.46 | 0.22 | 0.30 | 0.00 | 0.00 |
| SEQID-00482 | 0.05 | 0.02 | 0.02 | 0.07 | 0.04 | 0.01 | 0.00 | 0.04 | −27.29 | 0.18 | −0.03 | 4.37 | 0.24 | 0.35 | 0.00 | 0.00 |
| SEQID-00483 | 0.01 | 0.03 | 0.05 | 0.16 | 0.10 | 0.04 | 0.06 | 0.07 | −12.63 | 0.44 | 0.00 | 7.74 | 0.18 | 0.31 | 0.22 | 0.23 |
| SEQID-00484 | 0.00 | 0.07 | 0.02 | 0.05 | 0.03 | 0.01 | 0.01 | 0.02 | −33.66 | 0.11 | −0.13 | 4.08 | 0.23 | 0.32 | 0.00 | 0.21 |
| SEQID-00485 | 0.02 | 0.11 | 0.03 | 0.05 | 0.05 | 0.01 | 0.11 | 0.03 | −20.39 | 0.29 | 0.01 | 8.37 | 0.21 | 0.30 | 0.00 | 0.00 |
| SEQID-00486 | 0.09 | 0.04 | 0.05 | 0.05 | 0.07 | 0.01 | 0.06 | 0.05 | −14.98 | 0.69 | −0.05 | 4.44 | 0.21 | 0.31 | 0.00 | 0.19 |
| SEQID-00487 | 0.06 | 0.09 | 0.04 | 0.06 | 0.07 | 0.05 | 0.06 | 0.09 | −12.20 | 0.88 | 0.02 | 9.25 | 0.22 | 0.29 | 0.00 | 0.19 |
| SEQID-00488 | 0.02 | 0.08 | 0.05 | 0.04 | 0.06 | 0.02 | 0.05 | 0.07 | −20.86 | 0.42 | 0.02 | 7.03 | 0.21 | 0.31 | 0.19 | 0.00 |
| SEQID-00489 | 0.01 | 0.06 | 0.03 | 0.05 | 0.06 | 0.06 | 0.01 | 0.06 | −24.06 | 0.27 | −0.03 | 5.17 | 0.24 | 0.31 | 0.00 | 0.22 |
| SEQID-00490 | 0.06 | 0.09 | 0.03 | 0.03 | 0.05 | 0.01 | 0.02 | 0.12 | −9.86 | 1.25 | −0.03 | 4.30 | 0.20 | 0.31 | 0.00 | 0.22 |
| SEQID-00491 | 0.05 | 0.02 | 0.03 | 0.05 | 0.02 | 0.02 | 0.03 | 0.05 | −30.76 | 0.15 | 0.22 | 11.99 | 0.21 | 0.31 | 0.21 | 0.23 |
| SEQID-00492 | 0.02 | 0.02 | 0.04 | 0.04 | 0.03 | 0.05 | 0.09 | 0.06 | −25.46 | 0.19 | 0.21 | 11.95 | 0.25 | 0.34 | 0.00 | 0.20 |
| SEQID-00493 | 0.06 | 0.02 | 0.03 | 0.04 | 0.03 | 0.01 | 0.01 | 0.03 | −32.41 | 0.15 | 0.04 | 9.50 | 0.18 | 0.31 | 0.23 | 0.21 |
| SEQID-00494 | 0.01 | 0.07 | 0.01 | 0.05 | 0.03 | 0.02 | 0.06 | 0.09 | −17.65 | 0.90 | 0.03 | 9.78 | 0.24 | 0.31 | 0.19 | 0.22 |
| SEQID-00495 | 0.02 | 0.04 | 0.05 | 0.05 | 0.03 | 0.02 | 0.01 | 0.06 | −29.07 | 0.23 | 0.01 | 8.19 | 0.00 | 0.35 | 0.00 | 0.24 |
| SEQID-00496 | 0.03 | 0.03 | 0.07 | 0.07 | 0.02 | 0.03 | 0.02 | 0.07 | −30.33 | 0.30 | −0.12 | 4.11 | 0.00 | 0.31 | 0.00 | 0.24 |
| SEQID-00497 | 0.01 | 0.11 | 0.05 | 0.03 | 0.02 | 0.00 | 0.05 | 0.05 | −18.49 | 0.58 | −0.03 | 4.75 | 0.23 | 0.31 | 0.00 | 0.22 |
| SEQID-00498 | 0.05 | 0.04 | 0.02 | 0.05 | 0.04 | 0.00 | 0.02 | 0.08 | −19.54 | 0.57 | 0.00 | 6.55 | 0.27 | 0.52 | 0.26 | 0.26 |
| SEQID-00499 | 0.01 | 0.02 | 0.05 | 0.03 | 0.05 | 0.02 | 0.04 | 0.06 | −19.08 | 0.62 | −0.01 | 6.25 | 0.25 | 0.32 | 0.26 | 0.24 |
| SEQID-00500 | 0.02 | 0.06 | 0.04 | 0.02 | 0.06 | 0.05 | 0.06 | 0.07 | −15.40 | 0.43 | −0.01 | 6.65 | 0.26 | 0.30 | 0.22 | 0.26 |
| SEQID-00501 | 0.04 | 0.12 | 0.05 | 0.06 | 0.05 | 0.06 | 0.07 | 0.05 | −16.94 | 0.34 | −0.03 | 4.74 | 0.21 | 0.29 | 0.25 | 0.24 |
| SEQID-00502 | 0.01 | 0.09 | 0.03 | 0.05 | 0.04 | 0.01 | 0.05 | 0.06 | −20.99 | 0.33 | 0.00 | 7.18 | 0.23 | 0.32 | 0.25 | 0.25 |
| SEQID-00503 | 0.01 | 0.04 | 0.06 | 0.03 | 0.06 | 0.02 | 0.04 | 0.04 | −29.34 | 0.19 | 0.72 | 11.43 | 0.23 | 0.31 | 0.23 | 0.24 |
| SEQID-00504 | 0.03 | 0.03 | 0.05 | 0.04 | 0.11 | 0.07 | 0.04 | 0.09 | −11.10 | 0.46 | 0.02 | 9.37 | 0.22 | 0.30 | 0.28 | 0.26 |
| SEQID-00505 | 0.03 | 0.02 | 0.04 | 0.06 | 0.06 | 0.01 | 0.05 | 0.08 | −22.47 | 0.46 | −0.03 | 4.82 | 0.22 | 0.29 | 0.00 | 0.22 |
| SEQID-00506 | 0.03 | 0.11 | 0.03 | 0.04 | 0.04 | 0.07 | 0.08 | 0.07 | −11.44 | 1.03 | 0.02 | 9.04 | 0.20 | 0.30 | 0.00 | 0.23 |
| SEQID-00507 | 0.05 | 0.12 | 0.06 | 0.07 | 0.04 | 0.04 | 0.06 | 0.05 | −19.34 | 0.32 | −0.01 | 5.15 | 0.25 | 0.33 | 0.23 | 0.22 |
| SEQID-00508 | 0.03 | 0.06 | 0.03 | 0.05 | 0.05 | 0.03 | 0.03 | 0.13 | −17.01 | 0.60 | −0.01 | 6.50 | 0.27 | 0.32 | 0.00 | 0.00 |
| SEQID-00509 | 0.02 | 0.03 | 0.01 | 0.04 | 0.02 | 0.01 | 0.01 | 0.02 | −39.60 | 0.07 | 0.05 | 10.23 | 0.25 | 0.35 | 0.22 | 0.26 |
| SEQID-00510 | 0.03 | 0.07 | 0.04 | 0.04 | 0.04 | 0.03 | 0.05 | 0.04 | −25.37 | 0.32 | −0.03 | 4.91 | 0.21 | 0.32 | 0.24 | 0.23 |
| SEQID-00511 | 0.03 | 0.06 | 0.06 | 0.04 | 0.06 | 0.02 | 0.10 | 0.06 | −16.64 | 0.38 | −0.01 | 6.12 | 0.22 | 0.30 | 0.22 | 0.00 |
| SEQID-00512 | 0.02 | 0.05 | 0.02 | 0.05 | 0.03 | 0.07 | 0.04 | 0.05 | −10.38 | 0.87 | 0.03 | 9.59 | 0.24 | 0.35 | 0.28 | 0.24 |
| SEQID-00513 | 0.13 | 0.00 | 0.07 | 0.06 | 0.07 | 0.01 | 0.12 | 0.04 | −6.89 | 0.52 | 0.01 | 8.00 | 0.26 | 0.34 | 0.00 | 0.23 |
| SEQID-00514 | 0.01 | 0.01 | 0.04 | 0.04 | 0.04 | 0.03 | 0.01 | 0.13 | −19.37 | 0.48 | 0.10 | 11.46 | 0.00 | 0.34 | 0.00 | 0.23 |
| SEQID-00515 | 0.01 | 0.05 | 0.04 | 0.05 | 0.04 | 0.04 | 0.06 | 0.01 | −25.21 | 0.03 | −0.07 | 4.34 | 0.27 | 0.33 | 0.23 | 0.22 |
| SEQID-00516 | 0.02 | 0.03 | 0.06 | 0.05 | 0.07 | 0.02 | 0.05 | 0.06 | −20.21 | 0.76 | 0.00 | 6.92 | 0.22 | 0.32 | 0.00 | 0.00 |
| SEQID-00517 | 0.01 | 0.07 | 0.02 | 0.02 | 0.06 | 0.00 | 0.02 | 0.04 | −29.09 | 0.17 | 0.22 | 11.90 | 0.17 | 0.33 | 0.21 | 0.26 |
| SEQID-00518 | 0.03 | 0.02 | 0.04 | 0.04 | 0.04 | 0.02 | 0.01 | 0.13 | −22.45 | 0.33 | 0.08 | 10.62 | 0.24 | 0.33 | 0.00 | 0.25 |
| SEQID-00519 | 0.04 | 0.05 | 0.04 | 0.07 | 0.11 | 0.00 | 0.04 | 0.05 | −18.59 | 0.62 | −0.04 | 4.41 | 0.27 | 0.35 | 0.21 | 0.25 |
| SEQID-00520 | 0.05 | 0.02 | 0.02 | 0.04 | 0.05 | 0.01 | 0.02 | 0.04 | −32.61 | 0.15 | 0.04 | 9.81 | 0.25 | 0.33 | 0.26 | 0.24 |
| SEQID-00521 | 0.04 | 0.02 | 0.02 | 0.06 | 0.06 | 0.00 | 0.11 | 0.06 | −16.77 | 0.44 | 0.00 | 6.60 | 0.23 | 0.30 | 0.21 | 0.25 |
| SEQID-00522 | 0.04 | 0.03 | 0.01 | 0.04 | 0.13 | 0.03 | 0.01 | 0.01 | −25.65 | 0.04 | 0.02 | 9.76 | 0.27 | 0.32 | 0.22 | 0.25 |
| SEQID-00523 | 0.04 | 0.09 | 0.06 | 0.04 | 0.11 | 0.03 | 0.05 | 0.02 | −12.76 | 0.65 | 0.00 | 6.65 | 0.27 | 0.19 | 0.32 | 0.26 |
| SEQID-00524 | 0.03 | 0.06 | 0.06 | 0.11 | 0.04 | 0.02 | 0.04 | 0.09 | −18.82 | 0.26 | 0.05 | 10.11 | 0.24 | 0.23 | 0.25 | 0.23 |
| SEQID-00525 | 0.02 | 0.05 | 0.02 | 0.02 | 0.06 | 0.00 | 0.02 | 0.11 | −27.49 | 0.79 | −0.01 | 6.80 | 0.32 | 0.30 | 0.00 | 1.00 |
| SEQID-00526 | 0.09 | 0.09 | 0.03 | 0.06 | 0.06 | 0.00 | 0.00 | 0.05 | −18.31 | 0.55 | 0.07 | 8.61 | 0.31 | 0.29 | 0.34 | 0.30 |
| SEQID-00527 | 0.04 | 0.02 | 0.04 | 0.06 | 0.08 | 0.02 | 0.06 | 0.07 | −17.85 | 0.43 | −0.01 | 5.74 | 0.29 | 0.29 | 0.27 | 0.28 |
| SEQID-00528 | 0.01 | 0.05 | 0.04 | 0.07 | 0.11 | 0.00 | 0.02 | 0.08 | −16.90 | 0.49 | 0.03 | 9.51 | 0.29 | 0.28 | 0.23 | 0.29 |
| SEQID-00529 | 0.09 | 0.05 | 0.03 | 0.08 | 0.05 | 0.00 | 0.07 | 0.06 | −21.10 | 0.31 | 0.00 | 6.83 | 0.00 | 0.28 | 0.00 | 0.00 |
| SEQID-00530 | 0.04 | 0.03 | 0.04 | 0.05 | 0.04 | 0.04 | 0.03 | 0.10 | −9.31 | 0.92 | 0.08 | 9.06 | 0.32 | 0.32 | 0.29 | 0.30 |
| SEQID-00531 | 0.07 | 0.06 | 0.05 | 0.05 | 0.09 | 0.00 | 0.03 | 0.04 | −15.35 | 0.71 | 0.01 | 7.73 | 0.26 | 0.28 | 0.25 | 0.26 |
| SEQID-00532 | 0.04 | 0.03 | 0.03 | 0.08 | 0.05 | 0.00 | 0.06 | 0.15 | −17.89 | 0.60 | −0.01 | 5.70 | 0.21 | 0.30 | 0.00 | 0.00 |
| SEQID-00533 | 0.02 | 0.07 | 0.07 | 0.01 | 0.07 | 0.00 | 0.03 | 0.11 | −24.25 | 0.43 | 0.06 | 10.72 | 0.29 | 0.32 | 0.00 | 0.25 |

TABLE 1-continued

| | | | | | | | | | | | | | | |
|---|---|---|---|---|---|---|---|---|---|---|---|---|---|---|
| SEQID-00534 | 0.04 | 0.05 | 0.02 | 0.06 | 0.05 | 0.02 | 0.06 | 0.06 | -24.70 | 0.24 | -0.02 | 4.91 | 0.26 | 0.30 | 0.29 | 0.27 |
| SEQID-00535 | 0.01 | 0.04 | 0.03 | 0.16 | 0.07 | 0.02 | 0.06 | 0.06 | -11.86 | 0.30 | 0.01 | 8.20 | 0.22 | 0.28 | 0.27 | 0.28 |
| SEQID-00536 | 0.01 | 0.05 | 0.02 | 0.00 | 0.01 | 0.00 | 0.03 | 0.02 | -32.67 | 0.27 | 0.00 | 7.00 | 0.21 | 0.31 | 0.24 | 0.27 |
| SEQID-00537 | 0.01 | 0.02 | 0.01 | 0.04 | 0.05 | 0.00 | 0.00 | 0.05 | -31.23 | 0.13 | -0.02 | 5.11 | 0.29 | 0.33 | 0.27 | 0.22 |
| SEQID-00538 | 0.02 | 0.07 | 0.02 | 0.06 | 0.06 | 0.00 | 0.00 | 0.05 | -22.79 | 0.30 | -0.06 | 5.19 | 0.27 | 0.30 | 0.00 | 0.24 |
| SEQID-00539 | 0.06 | 0.03 | 0.04 | 0.03 | 0.04 | 0.00 | 0.01 | 0.09 | -19.20 | 0.71 | 0.00 | 7.52 | 0.27 | 0.32 | 0.00 | 0.23 |
| SEQID-00540 | 0.04 | 0.00 | 0.00 | 0.03 | 0.07 | 0.00 | 0.05 | 0.07 | -26.07 | 0.29 | 0.14 | 11.85 | 0.22 | 0.29 | 0.28 | 0.00 |
| SEQID-00541 | 0.02 | 0.03 | 0.02 | 0.06 | 0.02 | 0.00 | 0.04 | 0.09 | -19.28 | 0.56 | 0.10 | 11.02 | 0.23 | 0.30 | 0.24 | 0.22 |
| SEQID-00542 | 0.01 | 0.01 | 0.03 | 0.07 | 0.00 | 0.00 | 0.03 | 0.07 | -20.95 | 0.42 | 0.08 | 10.68 | 0.25 | 0.31 | 0.26 | 0.00 |
| SEQID-00543 | 0.02 | 0.05 | 0.01 | 0.04 | 0.10 | 0.05 | 0.10 | 0.07 | -19.52 | 0.31 | 0.00 | 7.18 | 0.00 | 0.30 | 0.24 | 0.25 |
| SEQID-00544 | 0.05 | 0.01 | 0.03 | 0.06 | 0.07 | 0.00 | 0.04 | 0.05 | -17.82 | 0.44 | -0.01 | 6.35 | 0.25 | 0.33 | 0.29 | 0.25 |
| SEQID-00545 | 0.01 | 0.08 | 0.04 | 0.04 | 0.04 | 0.00 | 0.08 | 0.06 | -26.17 | 0.22 | 0.00 | 5.86 | 0.25 | 0.31 | 0.19 | 0.25 |
| SEQID-00546 | 0.03 | 0.02 | 0.02 | 0.06 | 0.04 | 0.00 | 0.04 | 0.05 | -27.22 | 0.22 | -0.08 | 4.33 | 0.21 | 0.31 | 0.22 | 0.27 |
| SEQID-00547 | 0.07 | 0.00 | 0.04 | 0.04 | 0.13 | 0.00 | 0.02 | 0.06 | -20.21 | 0.09 | 0.03 | 9.81 | 0.25 | 0.34 | 0.27 | 0.24 |
| SEQID-00548 | 0.03 | 0.03 | 0.00 | 0.04 | 0.07 | 0.04 | 0.00 | 0.07 | -21.35 | 0.47 | -0.05 | 4.76 | 0.30 | 0.15 | 0.33 | 0.33 |
| SEQID-00549 | 0.02 | 0.02 | 0.03 | 0.09 | 0.10 | 0.03 | 0.10 | 0.03 | -14.48 | 0.26 | 0.06 | 10.19 | 0.30 | 0.23 | 0.00 | 0.34 |
| SEQID-00550 | 0.02 | 0.00 | 0.01 | 0.09 | 0.03 | 0.02 | 0.04 | 0.18 | -17.01 | 0.91 | -0.04 | 4.37 | 0.33 | 0.29 | 0.00 | 0.27 |
| SEQID-00551 | 0.03 | 0.08 | 0.03 | 0.05 | 0.06 | 0.00 | 0.00 | 0.07 | -17.92 | 0.64 | 0.12 | 10.11 | 0.32 | 0.32 | 0.30 | 0.31 |
| SEQID-00552 | 0.16 | 0.02 | 0.00 | 0.06 | 0.02 | 0.02 | 0.02 | 0.00 | -26.95 | 0.02 | 0.02 | 9.05 | 0.25 | 0.33 | 0.25 | 0.26 |
| SEQID-00553 | 0.01 | 0.00 | 0.24 | 0.06 | 0.07 | 0.00 | 0.00 | 0.04 | -29.60 | 0.05 | 0.00 | 7.54 | 0.33 | 0.35 | 0.33 | 0.34 |
| SEQID-00554 | 0.03 | 0.02 | 0.04 | 0.04 | 0.01 | 0.01 | 0.05 | 0.09 | -23.36 | 0.31 | 0.16 | 11.12 | 0.27 | 0.34 | 0.24 | 0.29 |
| SEQID-00555 | 0.03 | 0.03 | 0.03 | 0.02 | 0.05 | 0.00 | 0.04 | 0.10 | -23.32 | 0.33 | 0.10 | 11.21 | 0.20 | 0.29 | 0.24 | 0.00 |
| SEQID-00556 | 0.01 | 0.01 | 0.03 | 0.02 | 0.03 | 0.00 | 0.03 | 0.07 | -23.75 | 0.29 | 0.17 | 11.60 | 0.23 | 0.30 | 0.23 | 0.26 |
| SEQID-00557 | 0.02 | 0.03 | 0.06 | 0.13 | 0.07 | 0.05 | 0.02 | 0.10 | -12.39 | 0.59 | 0.02 | 8.90 | 0.29 | 0.33 | 0.24 | 0.26 |
| SEQID-00558 | 0.04 | 0.03 | 0.03 | 0.05 | 0.05 | 0.00 | 0.06 | 0.03 | -21.91 | 0.09 | 0.03 | 7.88 | 0.25 | 0.31 | 0.28 | 0.26 |
| SEQID-00559 | 0.02 | 0.02 | 0.03 | 0.02 | 0.08 | 0.00 | 0.04 | 0.05 | -25.27 | 0.34 | -0.01 | 5.85 | 0.00 | 0.33 | 0.00 | 0.00 |
| SEQID-00560 | 0.01 | 0.00 | 0.00 | 0.07 | 0.00 | 0.02 | 0.02 | 0.01 | -38.09 | 0.15 | 0.02 | 7.57 | 0.29 | 0.30 | 0.27 | 0.28 |
| SEQID-00561 | 0.04 | 0.13 | 0.04 | 0.04 | 0.04 | 0.00 | 0.01 | 0.04 | -8.41 | 1.32 | 0.00 | 8.53 | 0.19 | 0.28 | 0.21 | 0.00 |
| SEQID-00562 | 0.01 | 0.05 | 0.01 | 0.04 | 0.01 | 0.02 | 0.04 | 0.07 | -31.55 | 0.39 | -0.16 | 3.88 | 0.24 | 0.30 | 0.24 | 0.25 |
| SEQID-00563 | 0.05 | 0.05 | 0.02 | 0.03 | 0.05 | 0.00 | 0.03 | 0.07 | -18.88 | 0.52 | 0.03 | 8.84 | 0.24 | 0.31 | 0.00 | 0.23 |
| SEQID-00564 | 0.02 | 0.04 | 0.07 | 0.06 | 0.04 | 0.00 | 0.01 | 0.05 | -24.85 | 0.23 | 0.11 | 10.77 | 0.28 | 0.33 | 0.26 | 0.23 |
| SEQID-00565 | 0.01 | 0.03 | 0.04 | 0.06 | 0.06 | 0.03 | 0.03 | 0.06 | -18.34 | 0.73 | 0.02 | 8.87 | 0.23 | 0.31 | 0.23 | 0.00 |
| SEQID-00566 | 0.02 | 0.05 | 0.05 | 0.06 | 0.06 | 0.00 | 0.04 | 0.04 | -15.35 | 0.46 | 0.03 | 6.76 | 0.24 | 0.32 | 0.25 | 0.81 |
| SEQID-00567 | 0.01 | 0.03 | 0.04 | 0.03 | 0.04 | 0.02 | 0.04 | 0.07 | -25.61 | 0.22 | 0.21 | 12.15 | 0.23 | 0.31 | 0.00 | 0.22 |
| SEQID-00568 | 0.04 | 0.05 | 0.02 | 0.03 | 0.05 | 0.04 | 0.02 | 0.06 | -26.59 | 0.30 | 0.13 | 11.42 | 0.25 | 0.33 | 0.20 | 0.20 |
| SEQID-00569 | 0.02 | 0.06 | 0.06 | 0.06 | 0.13 | 0.04 | 0.01 | 0.05 | -16.16 | 0.52 | 0.04 | 10.35 | 0.23 | 0.32 | 0.00 | 0.24 |
| SEQID-00570 | 0.03 | 0.05 | 0.05 | 0.07 | 0.04 | 0.04 | 0.04 | 0.11 | -15.90 | 0.43 | 0.03 | 9.76 | 0.23 | 0.30 | 0.00 | 0.00 |
| SEQID-00571 | 0.02 | 0.09 | 0.02 | 0.01 | 0.03 | 0.02 | 0.02 | 0.12 | -18.31 | 0.58 | 0.00 | 7.24 | 0.28 | 0.31 | 0.24 | 0.25 |
| SEQID-00572 | 0.03 | 0.04 | 0.05 | 0.08 | 0.06 | 0.00 | 0.04 | 0.04 | -26.28 | 0.23 | 0.13 | 10.87 | 0.28 | 0.32 | 0.21 | 0.26 |
| SEQID-00573 | 0.03 | 0.03 | 0.04 | 0.06 | 0.05 | 0.00 | 0.03 | 0.05 | -26.70 | 0.25 | 0.13 | 10.82 | 0.25 | 0.33 | 0.25 | 0.21 |
| SEQID-00574 | 0.04 | 0.01 | 0.05 | 0.06 | 0.05 | 0.00 | 0.00 | 0.09 | -21.11 | 0.22 | 0.15 | 11.42 | 0.23 | 0.32 | 0.19 | 0.00 |
| SEQID-00575 | 0.01 | 0.03 | 0.08 | 0.02 | 0.01 | 0.00 | 0.04 | 0.07 | -24.56 | 0.26 | 0.17 | 11.38 | 0.24 | 0.28 | 0.00 | 0.25 |
| SEQID-00576 | 0.01 | 0.07 | 0.05 | 0.06 | 0.06 | 0.00 | 0.05 | 0.13 | -11.59 | 0.55 | 0.00 | 7.24 | 0.27 | 0.31 | 0.25 | 0.27 |
| SEQID-00577 | 0.02 | 0.02 | 0.03 | 0.12 | 0.08 | 0.00 | 0.06 | 0.05 | -22.27 | 0.21 | 0.11 | 10.74 | 0.24 | 0.29 | 0.23 | 0.25 |
| SEQID-00578 | 0.02 | 0.02 | 0.04 | 0.05 | 0.04 | 0.00 | 0.03 | 0.08 | -28.89 | 0.26 | 0.24 | 11.90 | 0.25 | 0.31 | 0.00 | 0.25 |
| SEQID-00579 | 0.01 | 0.01 | 0.01 | 0.05 | 0.07 | 0.00 | 0.06 | 0.04 | -25.22 | 0.20 | 0.25 | 11.95 | 0.00 | 0.30 | 0.27 | 0.25 |
| SEQID-00580 | 0.06 | 0.05 | 0.04 | 0.04 | 0.03 | 0.00 | 0.04 | 0.13 | -24.98 | 0.25 | 0.21 | 11.84 | 0.23 | 0.27 | 0.26 | 0.22 |
| SEQID-00581 | 0.04 | 0.04 | 0.02 | 0.05 | 0.05 | 0.01 | 0.06 | 0.06 | -25.40 | 0.28 | 0.12 | 11.02 | 0.00 | 0.29 | 0.00 | 0.00 |
| SEQID-00582 | 0.01 | 0.08 | 0.04 | 0.04 | 0.05 | 0.00 | 0.01 | 0.01 | -24.01 | 0.19 | 0.11 | 10.65 | 0.26 | 0.32 | 0.22 | 0.20 |
| SEQID-00583 | 0.05 | 0.02 | 0.03 | 0.03 | 0.07 | 0.03 | 0.07 | 0.06 | -28.61 | 0.28 | 0.24 | 12.14 | 0.24 | 0.31 | 0.25 | 0.21 |
| SEQID-00584 | 0.09 | 0.02 | 0.05 | 0.04 | 0.05 | 0.00 | 0.01 | 0.02 | -18.12 | 0.37 | 0.01 | 8.20 | 0.00 | 0.28 | 0.21 | 0.00 |
| SEQID-00585 | 0.04 | 0.01 | 0.02 | 0.04 | 0.01 | 0.00 | 0.03 | 0.03 | -29.34 | 0.13 | 0.03 | 8.91 | 0.26 | 0.30 | 0.27 | 0.30 |
| SEQID-00586 | 0.08 | 0.07 | 0.07 | 0.09 | 0.05 | 0.00 | 0.05 | 0.02 | -26.12 | 0.09 | 0.07 | 10.60 | 0.24 | 0.31 | 0.17 | 0.00 |

TABLE 1-continued

| SEQID | | | | | | | | | | | | | | | | | |
|---|---|---|---|---|---|---|---|---|---|---|---|---|---|---|---|---|---|
| SEQID-00587 | 0.02 | 0.04 | 0.04 | 0.04 | 0.04 | 0.04 | 0.00 | 0.01 | 0.11 | -19.76 | 0.50 | 0.02 | 9.69 | 0.27 | 0.31 | 0.00 | 0.26 |
| SEQID-00588 | 0.02 | 0.04 | 0.08 | 0.03 | 0.03 | 0.03 | 0.02 | 0.07 | 0.07 | -20.29 | 0.26 | 0.18 | 12.08 | 0.26 | 0.29 | 0.25 | 0.19 |
| SEQID-00589 | 0.04 | 0.05 | 0.03 | 0.04 | 0.05 | 0.05 | 0.00 | 0.03 | 0.02 | -30.06 | 0.12 | 0.06 | 10.32 | 0.22 | 0.31 | 0.25 | 0.25 |
| SEQID-00590 | 0.01 | 0.06 | 0.04 | 0.04 | 0.04 | 0.04 | 0.00 | 0.00 | 0.08 | -24.08 | 0.36 | 0.05 | 10.32 | 0.30 | 0.31 | 0.00 | 0.00 |
| SEQID-00591 | 0.01 | 0.03 | 0.04 | 0.03 | 0.04 | 0.01 | 0.00 | 0.05 | 0.02 | -27.30 | 0.13 | 0.09 | 10.47 | 0.30 | 0.32 | 0.00 | 0.27 |
| SEQID-00592 | 0.06 | 0.02 | 0.06 | 0.06 | 0.06 | 0.10 | 0.04 | 0.02 | 0.16 | -18.59 | 0.39 | -0.01 | 5.02 | 0.26 | 0.30 | 0.26 | 0.24 |
| SEQID-00593 | 0.01 | 0.09 | 0.04 | 0.04 | 0.10 | 0.10 | 0.00 | 0.05 | 0.03 | -16.04 | 0.63 | -0.01 | 5.76 | 0.30 | 0.27 | 0.00 | 0.23 |
| SEQID-00594 | 0.06 | 0.12 | 0.03 | 0.06 | 0.06 | 0.06 | 0.04 | 0.00 | 0.05 | -19.01 | 0.53 | 0.08 | 8.31 | 0.29 | 0.29 | 0.26 | 0.28 |
| SEQID-00595 | 0.09 | 0.13 | 0.03 | 0.06 | 0.05 | 0.05 | 0.00 | 0.02 | 0.02 | -18.17 | 0.56 | 0.07 | 8.61 | 0.34 | 0.28 | 0.30 | 0.28 |
| SEQID-00596 | 0.02 | 0.09 | 0.01 | 0.04 | 0.04 | 0.05 | 0.00 | 0.00 | 0.05 | -22.57 | 0.60 | 0.00 | 7.12 | 0.28 | 0.32 | 0.30 | 0.29 |
| SEQID-00597 | 0.02 | 0.12 | 0.02 | 0.03 | 0.03 | 0.04 | 0.00 | 0.00 | 0.05 | -21.54 | 0.57 | 0.11 | 9.35 | 0.26 | 0.26 | 0.33 | 0.29 |
| SEQID-00598 | 0.05 | 0.02 | 0.04 | 0.04 | 0.04 | 0.05 | 0.05 | 0.02 | 0.13 | -20.52 | 0.43 | 0.05 | 9.60 | 0.30 | 0.31 | 0.32 | 0.99 |
| SEQID-00599 | 0.01 | 0.04 | 0.02 | 0.09 | 0.06 | 0.06 | 0.06 | 0.04 | 0.09 | -19.09 | 0.44 | -0.02 | 5.99 | 0.22 | 0.30 | 0.00 | 0.20 |
| SEQID-00600 | 0.04 | 0.03 | 0.05 | 0.04 | 0.04 | 0.04 | 0.03 | 0.08 | 0.07 | -15.69 | 0.57 | -0.04 | 9.53 | 0.21 | 0.33 | 0.00 | 0.00 |
| SEQID-00601 | 0.01 | 0.03 | 0.04 | 0.03 | 0.03 | 0.03 | 0.05 | 0.08 | 0.04 | -21.74 | 0.27 | -0.01 | 6.72 | 0.20 | 0.33 | 0.00 | 0.20 |
| SEQID-00602 | 0.03 | 0.03 | 0.01 | 0.10 | 0.06 | 0.04 | 0.01 | 0.07 | 0.06 | -20.45 | 0.28 | -0.09 | 10.47 | 0.22 | 0.31 | 0.00 | 0.22 |
| SEQID-00603 | 0.00 | 0.02 | 0.03 | 0.07 | 0.06 | 0.06 | 0.08 | 0.03 | 0.08 | -20.14 | 0.42 | -0.03 | 5.54 | 0.21 | 0.32 | 0.00 | 0.20 |
| SEQID-00604 | 0.00 | 0.05 | 0.03 | 0.07 | 0.08 | 0.08 | 0.02 | 0.06 | 0.08 | -17.58 | 0.35 | 0.02 | 9.31 | 0.21 | 0.32 | 0.00 | 0.21 |
| SEQID-00605 | 0.01 | 0.04 | 0.04 | 0.05 | 0.07 | 0.07 | 0.01 | 0.01 | 0.05 | -23.29 | 0.20 | -0.03 | 4.72 | 0.21 | 0.31 | 0.00 | 0.00 |
| SEQID-00606 | 0.02 | 0.04 | 0.03 | 0.04 | 0.04 | 0.04 | 0.01 | 0.02 | 0.04 | -20.32 | 0.40 | 0.00 | 9.96 | 0.21 | 0.31 | 0.00 | 0.19 |
| SEQID-00607 | 0.02 | 0.04 | 0.05 | 0.06 | 0.06 | 0.06 | 0.03 | 0.01 | 0.05 | -21.52 | 0.39 | -0.03 | 6.81 | 0.21 | 0.34 | 0.00 | 0.36 |
| SEQID-00608 | 0.01 | 0.08 | 0.05 | 0.07 | 0.05 | 0.05 | 0.02 | 0.06 | 0.03 | -22.65 | 0.19 | 0.02 | 6.47 | 0.22 | 0.33 | 0.17 | 0.25 |
| SEQID-00609 | 0.00 | 0.03 | 0.04 | 0.06 | 0.06 | 0.06 | 0.01 | 0.02 | 0.05 | -18.71 | 0.25 | -0.02 | 9.92 | 0.21 | 0.31 | 0.23 | 0.23 |
| SEQID-00610 | 0.03 | 0.06 | 0.01 | 0.04 | 0.05 | 0.05 | 0.02 | 0.00 | 0.05 | -27.26 | 0.10 | 0.04 | 5.97 | 0.21 | 0.33 | 0.00 | 0.21 |
| SEQID-00611 | 0.03 | 0.06 | 0.07 | 0.06 | 0.05 | 0.05 | 0.01 | 0.01 | 0.05 | -20.53 | 0.46 | -0.06 | 10.39 | 0.21 | 0.32 | 0.21 | 0.27 |
| SEQID-00612 | 0.03 | 0.06 | 0.05 | 0.03 | 0.05 | 0.05 | 0.00 | 0.05 | 0.08 | -10.14 | 0.90 | 0.01 | 4.45 | 0.22 | 0.33 | 0.00 | 0.25 |
| SEQID-00613 | 0.02 | 0.07 | 0.07 | 0.07 | 0.02 | 0.02 | 0.01 | 0.02 | 0.10 | -14.35 | 0.60 | 0.01 | 8.79 | 0.24 | 0.34 | 0.00 | 0.24 |
| SEQID-00614 | 0.03 | 0.02 | 0.02 | 0.06 | 0.04 | 0.04 | 0.01 | 0.01 | 0.04 | -23.29 | 0.20 | -0.03 | 7.63 | 0.25 | 0.33 | 0.21 | 0.22 |
| SEQID-00615 | 0.01 | 0.08 | 0.03 | 0.02 | 0.07 | 0.07 | 0.04 | 0.02 | 0.05 | -13.56 | 0.91 | 0.04 | 4.72 | 0.21 | 0.32 | 0.00 | 0.00 |
| SEQID-00616 | 0.05 | 0.00 | 0.00 | 0.00 | 0.02 | 0.02 | 0.00 | 0.06 | 0.00 | -27.63 | 0.18 | 0.00 | 9.96 | 0.43 | 0.23 | 0.22 | 0.19 |
| SEQID-00617 | 0.04 | 0.03 | 0.03 | 0.06 | 0.05 | 0.05 | 0.00 | 0.03 | 0.05 | -24.45 | 0.32 | 0.20 | 12.14 | 0.25 | 0.27 | 0.33 | 0.36 |
| SEQID-00618 | 0.04 | 0.06 | 0.04 | 0.04 | 0.05 | 0.05 | 0.00 | 0.00 | 0.08 | -20.50 | 0.46 | 0.01 | 8.23 | 0.27 | 0.30 | 0.00 | 0.25 |
| SEQID-00619 | 0.01 | 0.01 | 0.07 | 0.03 | 0.03 | 0.03 | 0.00 | 0.04 | 0.08 | -21.61 | 0.44 | 0.15 | 11.36 | 0.26 | 0.30 | 0.00 | 0.23 |
| SEQID-00620 | 0.02 | 0.04 | 0.04 | 0.05 | 0.04 | 0.04 | 0.02 | 0.03 | 0.04 | -27.42 | 0.25 | 0.13 | 10.79 | 0.23 | 0.33 | 0.25 | 0.27 |
| SEQID-00621 | 0.03 | 0.01 | 0.01 | 0.04 | 0.05 | 0.05 | 0.00 | 0.00 | 0.15 | -22.84 | 0.58 | -0.07 | 4.39 | 0.25 | 0.31 | 0.00 | 0.25 |
| SEQID-00622 | 0.01 | 0.03 | 0.03 | 0.08 | 0.01 | 0.01 | 0.00 | 0.03 | 0.07 | -18.26 | 0.35 | 0.09 | 11.09 | 0.26 | 0.31 | 0.27 | 0.24 |
| SEQID-00623 | 0.02 | 0.05 | 0.05 | 0.06 | 0.05 | 0.05 | 0.02 | 0.08 | 0.11 | -18.79 | 0.43 | -0.02 | 5.65 | 0.28 | 0.33 | 0.20 | 0.22 |
| SEQID-00624 | 0.03 | 0.04 | 0.06 | 0.05 | 0.06 | 0.06 | 0.00 | 0.05 | 0.05 | -25.75 | 0.25 | -0.13 | 10.85 | 0.25 | 0.31 | 0.22 | 0.00 |
| SEQID-00625 | 0.06 | 0.03 | 0.03 | 0.06 | 0.03 | 0.03 | 0.00 | 0.03 | 0.03 | -25.21 | 0.43 | -0.07 | 4.34 | 0.25 | 0.34 | 0.23 | 0.00 |
| SEQID-00626 | 0.03 | 0.04 | 0.02 | 0.07 | 0.03 | 0.03 | 0.02 | 0.00 | 0.06 | -28.78 | 0.34 | 0.14 | 11.14 | 0.26 | 0.33 | 0.23 | 0.23 |
| SEQID-00627 | 0.03 | 0.02 | 0.03 | 0.05 | 0.05 | 0.05 | 0.01 | 0.06 | 0.05 | -21.94 | 0.44 | 0.03 | 9.85 | 0.24 | 0.32 | 0.20 | 0.15 |
| SEQID-00628 | 0.02 | 0.02 | 0.02 | 0.02 | 0.02 | 0.02 | 0.01 | 0.01 | 0.07 | -30.26 | 0.19 | 0.08 | 10.61 | 0.23 | 0.30 | 0.00 | 0.23 |
| SEQID-00629 | 0.02 | 0.01 | 0.01 | 0.04 | 0.07 | 0.07 | 0.01 | 0.02 | 0.10 | -23.95 | 0.29 | 0.05 | 10.21 | 0.25 | 0.29 | 0.22 | 0.00 |
| SEQID-00630 | 0.02 | 0.01 | 0.05 | 0.05 | 0.01 | 0.01 | 0.00 | 0.05 | 0.07 | -25.54 | 0.24 | 0.20 | 11.52 | 0.18 | 0.30 | 0.21 | 0.22 |
| SEQID-00631 | 0.02 | 0.02 | 0.02 | 0.05 | 0.14 | 0.14 | 0.02 | 0.09 | 0.05 | -12.56 | 0.23 | 0.01 | 8.03 | 0.25 | 0.34 | 0.29 | 0.25 |
| SEQID-00632 | 0.02 | 0.00 | 0.02 | 0.06 | 0.03 | 0.03 | 0.00 | 0.05 | 0.03 | -29.33 | 0.29 | 0.11 | 10.97 | 0.24 | 0.33 | 0.25 | 0.24 |
| SEQID-00633 | 0.01 | 0.06 | 0.02 | 0.02 | 0.06 | 0.06 | 0.00 | 0.05 | 0.07 | -22.73 | 0.35 | -0.03 | 4.74 | 0.26 | 0.33 | 0.29 | 0.27 |
| SEQID-00634 | 0.02 | 0.03 | 0.03 | 0.06 | 0.03 | 0.03 | 0.00 | 0.06 | 0.06 | -29.53 | 0.07 | -0.03 | 5.00 | 0.29 | 0.33 | 0.00 | 0.26 |
| SEQID-00635 | 0.02 | 0.00 | 0.02 | 0.07 | 0.03 | 0.03 | 0.02 | 0.05 | 0.05 | -24.75 | 0.38 | 0.15 | 11.02 | 0.22 | 0.26 | 0.00 | 0.24 |
| SEQID-00636 | 0.02 | 0.05 | 0.02 | 0.03 | 0.05 | 0.05 | 0.02 | 0.03 | 0.09 | -18.64 | 0.27 | 0.16 | 11.63 | 0.24 | 0.30 | 0.00 | 0.21 |
| SEQID-00637 | 0.04 | 0.01 | 0.02 | 0.02 | 0.02 | 0.02 | 0.02 | 0.04 | 0.08 | -24.50 | 0.28 | 0.19 | 12.27 | 0.20 | 0.29 | 0.00 | 0.26 |
| SEQID-00638 | 0.01 | 0.04 | 0.03 | 0.06 | 0.04 | 0.04 | 0.02 | 0.00 | 0.10 | -22.79 | 0.13 | 0.25 | 12.25 | 0.25 | 0.28 | 0.25 | 0.25 |
| SEQID-00639 | 0.03 | 0.01 | 0.00 | 0.00 | 0.09 | 0.05 | 0.02 | 0.06 | 0.08 | -21.28 | 0.30 | 0.19 | 11.06 | 0.26 | 0.29 | 0.28 | 0.23 |

TABLE 1-continued

| SEQID | | | | | | | | | | | | | | | |
|---|---|---|---|---|---|---|---|---|---|---|---|---|---|---|---|
| SEQID-00640 | 0.04 | 0.01 | 0.02 | 0.04 | 0.05 | 0.00 | 0.11 | 0.12 | -28.97 | 0.26 | 0.14 | 10.65 | 0.19 | 0.27 | 0.00 | 0.00 |
| SEQID-00641 | 0.03 | 0.06 | 0.02 | 0.03 | 0.04 | 0.00 | 0.02 | 0.04 | -29.69 | 0.09 | 0.07 | 10.79 | 0.27 | 0.28 | 0.00 | 0.31 |
| SEQID-00642 | 0.03 | 0.08 | 0.04 | 0.03 | 0.03 | 0.08 | 0.05 | 0.04 | -23.31 | 0.20 | -0.04 | 5.02 | 0.26 | 0.26 | 0.00 | 0.25 |
| SEQID-00643 | 0.07 | 0.05 | 0.04 | 0.00 | 0.04 | 0.00 | 0.02 | 0.05 | -26.01 | 0.39 | 0.04 | 8.90 | 0.25 | 0.25 | 0.27 | 0.00 |
| SEQID-00644 | 0.02 | 0.05 | 0.02 | 0.04 | 0.02 | 0.02 | 0.08 | 0.14 | -21.12 | 0.33 | 0.03 | 9.08 | 0.27 | 0.26 | 0.00 | 0.27 |
| SEQID-00645 | 0.05 | 0.07 | 0.08 | 0.06 | 0.08 | 0.04 | 0.06 | 0.01 | -15.18 | 0.44 | 0.02 | 9.00 | 0.26 | 0.25 | 0.00 | 0.26 |
| SEQID-00646 | 0.03 | 0.07 | 0.01 | 0.03 | 0.04 | 0.05 | 0.08 | 0.05 | -18.27 | 0.71 | 0.09 | 10.32 | 0.31 | 0.23 | 0.00 | 0.00 |
| SEQID-00647 | 0.02 | 0.00 | 0.04 | 0.04 | 0.04 | 0.00 | 0.00 | 0.01 | -27.75 | 0.24 | 0.04 | 10.19 | 0.34 | 0.30 | 0.27 | 0.30 |
| SEQID-00648 | 0.05 | 0.05 | 0.05 | 0.01 | 0.04 | 0.02 | 0.02 | 0.04 | -33.89 | 0.16 | 0.01 | 7.70 | 0.27 | 0.23 | 0.00 | 0.00 |
| SEQID-00649 | 0.01 | 0.06 | 0.07 | 0.05 | 0.06 | 0.04 | 0.04 | 0.08 | -14.83 | 0.68 | 0.01 | 7.78 | 0.25 | 0.33 | 0.22 | 0.22 |
| SEQID-00650 | 0.02 | 0.05 | 0.03 | 0.06 | 0.10 | 0.03 | 0.03 | 0.07 | -23.09 | 0.36 | -0.02 | 4.88 | 0.27 | 0.17 | 0.30 | 0.35 |
| SEQID-00651 | 0.04 | 0.04 | 0.03 | 0.03 | 0.03 | 0.03 | 0.04 | 0.05 | -14.04 | 0.78 | -0.01 | 6.41 | 0.25 | 0.34 | 0.25 | 0.24 |
| SEQID-00652 | 0.06 | 0.03 | 0.05 | 0.12 | 0.03 | 0.00 | 0.05 | 0.00 | -23.90 | 0.31 | -0.04 | 4.69 | 0.26 | 0.27 | 0.31 | 1.00 |
| SEQID-00653 | 0.05 | 0.04 | 0.07 | 0.03 | 0.05 | 0.01 | 0.01 | 0.10 | -20.09 | 0.49 | 0.03 | 9.96 | 0.25 | 0.31 | 0.22 | 0.24 |
| SEQID-00654 | 0.02 | 0.04 | 0.03 | 0.04 | 0.06 | 0.01 | 0.10 | 0.06 | -19.75 | 0.51 | -0.03 | 5.30 | 0.19 | 0.32 | 0.22 | 0.28 |
| SEQID-00655 | 0.04 | 0.04 | 0.01 | 0.03 | 0.06 | 0.00 | 0.07 | 0.07 | -25.19 | 0.32 | -0.03 | 4.99 | 0.20 | 0.35 | 0.20 | 0.00 |
| SEQID-00656 | 0.00 | 0.01 | 0.04 | 0.05 | 0.07 | 0.03 | 0.03 | 0.08 | -19.20 | 0.26 | 0.00 | 8.72 | 0.00 | 0.36 | 0.00 | 0.20 |
| SEQID-00657 | 0.02 | 0.05 | 0.04 | 0.04 | 0.06 | 0.04 | 0.06 | 0.05 | -22.10 | 0.20 | 0.00 | 7.80 | 0.20 | 0.32 | 0.20 | 0.21 |
| SEQID-00658 | 0.01 | 0.03 | 0.01 | 0.09 | 0.04 | 0.01 | 0.02 | 0.05 | -26.41 | 0.23 | -0.05 | 6.84 | 0.22 | 0.37 | 0.00 | 0.22 |
| SEQID-00659 | 0.03 | 0.06 | 0.04 | 0.05 | 0.05 | 0.05 | 0.07 | 0.05 | -17.32 | 0.26 | 0.00 | 8.00 | 0.22 | 0.30 | 0.20 | 0.21 |
| SEQID-00660 | 0.02 | 0.07 | 0.02 | 0.06 | 0.06 | 0.01 | 0.03 | 0.05 | -23.14 | 0.27 | 0.01 | 5.82 | 0.24 | 0.33 | 0.00 | 0.22 |
| SEQID-00661 | 0.02 | 0.02 | 0.03 | 0.09 | 0.06 | 0.01 | 0.07 | 0.11 | -14.17 | 0.48 | 0.01 | 8.58 | 1.00 | 1.00 | 0.23 | 0.22 |
| SEQID-00662 | 0.02 | 0.03 | 0.04 | 0.09 | 0.05 | 0.08 | 0.10 | 0.03 | -15.75 | 0.26 | 0.00 | 6.53 | 0.00 | 0.33 | 0.00 | 0.22 |
| SEQID-00663 | 0.02 | 0.05 | 0.03 | 0.08 | 0.06 | 0.04 | 0.07 | 0.06 | -17.59 | 0.23 | 0.02 | 9.22 | 0.37 | 0.49 | 0.24 | 0.21 |
| SEQID-00664 | 0.01 | 0.06 | 0.01 | 0.05 | 0.09 | 0.02 | 0.02 | 0.09 | -20.23 | 0.27 | 0.02 | 9.02 | 0.00 | 0.33 | 0.00 | 0.23 |
| SEQID-00665 | 0.01 | 0.03 | 0.03 | 0.07 | 0.08 | 0.01 | 0.11 | 0.07 | -17.78 | 0.25 | 0.00 | 6.87 | 0.22 | 0.32 | 0.21 | 0.21 |
| SEQID-00666 | 0.03 | 0.05 | 0.02 | 0.05 | 0.06 | 0.00 | 0.05 | 0.08 | -20.08 | 0.44 | -0.05 | 4.40 | 0.55 | 0.71 | 0.19 | 0.23 |
| SEQID-00667 | 0.02 | 0.04 | 0.02 | 0.04 | 0.04 | 0.01 | 0.02 | 0.05 | -26.85 | 0.17 | -0.01 | 5.26 | 0.21 | 0.33 | 0.00 | 0.00 |
| SEQID-00668 | 0.02 | 0.03 | 0.00 | 0.05 | 0.05 | 0.01 | 0.07 | 0.06 | -30.38 | 0.14 | 0.03 | 9.69 | 0.23 | 0.35 | 0.00 | 0.20 |
| SEQID-00669 | 0.04 | 0.04 | 0.05 | 0.04 | 0.05 | 0.02 | 0.02 | 0.04 | -21.61 | 0.30 | 0.00 | 6.69 | 0.00 | 0.35 | 0.25 | 0.00 |
| SEQID-00670 | 0.04 | 0.03 | 0.04 | 0.04 | 0.04 | 0.02 | 0.02 | 0.04 | -21.61 | 0.31 | -0.01 | 6.69 | 0.00 | 0.35 | 0.25 | 0.00 |
| SEQID-00671 | 0.05 | 0.03 | 0.05 | 0.04 | 0.05 | 0.02 | 0.02 | 0.04 | -21.67 | 0.30 | -0.01 | 6.03 | 0.00 | 0.35 | 0.25 | 0.00 |
| SEQID-00672 | 0.04 | 0.03 | 0.05 | 0.04 | 0.05 | 0.02 | 0.02 | 0.04 | -21.97 | 0.28 | -0.01 | 6.37 | 0.00 | 0.35 | 0.25 | 0.00 |
| SEQID-00673 | 0.04 | 0.03 | 0.05 | 0.04 | 0.05 | 0.02 | 0.03 | 0.04 | -21.69 | 0.29 | -0.01 | 6.03 | 0.00 | 0.35 | 0.25 | 0.00 |
| SEQID-00674 | 0.04 | 0.03 | 0.05 | 0.04 | 0.05 | 0.02 | 0.02 | 0.04 | -21.66 | 0.30 | -0.01 | 6.03 | 0.00 | 0.32 | 0.25 | 0.00 |
| SEQID-00675 | 0.04 | 0.03 | 0.05 | 0.04 | 0.05 | 0.02 | 0.07 | 0.05 | -21.68 | 0.30 | -0.01 | 6.03 | 0.00 | 0.32 | 0.25 | 0.23 |
| SEQID-00676 | 0.04 | 0.03 | 0.03 | 0.06 | 0.07 | 0.04 | 0.06 | 0.05 | -21.66 | 0.29 | -0.02 | 6.03 | 0.00 | 0.33 | 0.00 | 0.21 |
| SEQID-00677 | 0.04 | 0.03 | 0.03 | 0.04 | 0.07 | 0.04 | 0.06 | 0.05 | -21.66 | 0.31 | -0.02 | 6.37 | 0.00 | 0.32 | 0.00 | 0.22 |
| SEQID-00678 | 0.04 | 0.03 | 0.03 | 0.07 | 0.07 | 0.04 | 0.06 | 0.05 | -21.97 | 0.28 | -0.02 | 6.03 | 0.00 | 0.34 | 0.00 | 0.00 |
| SEQID-00679 | 0.04 | 0.03 | 0.03 | 0.07 | 0.07 | 0.04 | 0.06 | 0.05 | -21.66 | 0.31 | -0.01 | 6.03 | 0.00 | 0.32 | 0.00 | 0.23 |
| SEQID-00680 | 0.04 | 0.03 | 0.03 | 0.07 | 0.07 | 0.04 | 0.06 | 0.05 | -21.70 | 0.28 | -0.01 | 6.03 | 0.00 | 0.32 | 0.25 | 0.00 |
| SEQID-00681 | 0.04 | 0.03 | 0.03 | 0.04 | 0.05 | 0.02 | 0.02 | 0.04 | -21.68 | 0.29 | -0.01 | 6.03 | 0.00 | 0.32 | 0.25 | 0.00 |
| SEQID-00682 | 0.04 | 0.03 | 0.03 | 0.04 | 0.05 | 0.02 | 0.02 | 0.05 | -21.66 | 0.31 | -0.01 | 6.03 | 0.00 | 0.32 | 0.25 | 0.23 |
| SEQID-00683 | 0.02 | 0.05 | 0.05 | 0.07 | 0.05 | 0.02 | 0.07 | 0.05 | -17.73 | 0.22 | -0.02 | 5.71 | 0.21 | 0.38 | 0.00 | 0.21 |
| SEQID-00684 | 0.02 | 0.05 | 0.03 | 0.06 | 0.07 | 0.04 | 0.06 | 0.05 | -17.50 | 0.25 | -0.01 | 6.00 | 0.21 | 0.39 | 0.00 | 0.22 |
| SEQID-00685 | 0.02 | 0.05 | 0.03 | 0.07 | 0.07 | 0.04 | 0.06 | 0.05 | -17.72 | 0.22 | -0.02 | 5.71 | 0.21 | 0.39 | 0.00 | 0.21 |
| SEQID-00686 | 0.02 | 0.05 | 0.03 | 0.07 | 0.07 | 0.04 | 0.06 | 0.05 | -17.59 | 0.22 | -0.02 | 5.84 | 0.22 | 0.40 | 0.00 | 0.22 |
| SEQID-00687 | 0.02 | 0.05 | 0.03 | 0.07 | 0.07 | 0.04 | 0.06 | 0.05 | -17.70 | 0.23 | -0.02 | 5.59 | 0.21 | 0.38 | 0.00 | 0.21 |
| SEQID-00688 | 0.02 | 0.05 | 0.03 | 0.07 | 0.07 | 0.04 | 0.06 | 0.05 | -17.70 | 0.22 | -0.02 | 5.73 | 0.21 | 0.40 | 0.00 | 0.21 |
| SEQID-00689 | 0.02 | 0.05 | 0.03 | 0.07 | 0.07 | 0.04 | 0.06 | 0.05 | -17.72 | 0.22 | -0.02 | 5.71 | 0.22 | 0.40 | 0.00 | 0.22 |
| SEQID-00690 | 0.02 | 0.05 | 0.03 | 0.06 | 0.06 | 0.04 | 0.06 | 0.05 | -17.68 | 0.26 | -0.01 | 6.46 | 0.21 | 0.40 | 0.00 | 0.20 |
| SEQID-00691 | 0.02 | 0.05 | 0.03 | 0.06 | 0.07 | 0.04 | 0.06 | 0.05 | -17.79 | 0.24 | -0.01 | 6.57 | 0.21 | 0.39 | 0.00 | 0.21 |
| SEQID-00692 | 0.02 | 0.05 | 0.03 | 0.06 | 0.07 | 0.04 | 0.06 | 0.05 | -17.59 | 0.25 | -0.01 | 6.35 | 0.21 | 0.40 | 0.00 | 0.21 |

TABLE 1-continued

| | | | | | | | | | | | | | | |
|---|---|---|---|---|---|---|---|---|---|---|---|---|---|---|
| SEQID-00693 | 0.02 | 0.05 | 0.03 | 0.06 | 0.07 | 0.04 | 0.06 | 0.05 | −17.85 | 0.23 | −0.01 | 6.35 | 0.21 | 0.39 | 0.21 | 0.21 |
| SEQID-00694 | 0.02 | 0.05 | 0.03 | 0.06 | 0.07 | 0.04 | 0.06 | 0.05 | −17.74 | 0.24 | −0.01 | 6.24 | 0.21 | 0.00 | 0.00 | 0.21 |
| SEQID-00695 | 0.02 | 0.05 | 0.03 | 0.07 | 0.07 | 0.04 | 0.06 | 0.05 | −17.72 | 0.22 | −0.02 | 5.71 | 0.21 | 0.40 | 0.00 | 0.22 |
| SEQID-00696 | 0.02 | 0.05 | 0.03 | 0.06 | 0.07 | 0.04 | 0.06 | 0.05 | −17.57 | 0.26 | −0.01 | 6.35 | 0.22 | 0.39 | 0.00 | 0.22 |
| SEQID-00697 | 0.02 | 0.05 | 0.03 | 0.07 | 0.07 | 0.04 | 0.06 | 0.05 | −17.50 | 0.25 | −0.01 | 6.00 | 0.21 | 0.39 | 0.00 | 0.21 |
| SEQID-00698 | 0.03 | 0.05 | 0.03 | 0.07 | 0.07 | 0.04 | 0.06 | 0.05 | −17.44 | 0.25 | −0.01 | 6.20 | 0.21 | 0.39 | 0.00 | 0.21 |
| SEQID-00699 | 0.02 | 0.05 | 0.03 | 0.06 | 0.07 | 0.04 | 0.06 | 0.05 | −17.62 | 0.23 | −0.01 | 5.35 | 0.21 | 0.40 | 0.00 | 0.21 |
| SEQID-00700 | 0.02 | 0.05 | 0.03 | 0.06 | 0.07 | 0.04 | 0.06 | 0.05 | −17.48 | 0.27 | −0.01 | 6.46 | 0.22 | 0.39 | 0.00 | 0.22 |
| SEQID-00701 | 0.02 | 0.05 | 0.03 | 0.06 | 0.07 | 0.04 | 0.06 | 0.05 | −17.57 | 0.26 | −0.01 | 6.35 | 0.21 | 0.39 | 0.00 | 0.22 |
| SEQID-00702 | 0.02 | 0.05 | 0.03 | 0.07 | 0.07 | 0.04 | 0.06 | 0.05 | −17.59 | 0.25 | −0.01 | 6.35 | 0.21 | 0.39 | 0.00 | 0.22 |
| SEQID-00703 | 0.02 | 0.05 | 0.03 | 0.06 | 0.07 | 0.04 | 0.06 | 0.05 | −17.80 | 0.23 | −0.02 | 5.85 | 0.21 | 0.40 | 0.00 | 0.21 |
| SEQID-00704 | 0.02 | 0.05 | 0.03 | 0.06 | 0.07 | 0.04 | 0.06 | 0.05 | −17.90 | 0.24 | 0.00 | 6.69 | 0.22 | 0.39 | 0.21 | 0.21 |
| SEQID-00705 | 0.02 | 0.05 | 0.03 | 0.06 | 0.07 | 0.04 | 0.06 | 0.06 | −17.58 | 0.25 | −0.01 | 6.35 | 0.22 | 0.40 | 0.00 | 0.21 |
| SEQID-00706 | 0.02 | 0.05 | 0.03 | 0.07 | 0.07 | 0.03 | 0.07 | 0.05 | −17.53 | 0.23 | −0.02 | 5.44 | 0.21 | 0.40 | 0.00 | 0.21 |
| SEQID-00707 | 0.02 | 0.05 | 0.03 | 0.07 | 0.07 | 0.03 | 0.07 | 0.05 | −17.53 | 0.23 | −0.02 | 5.44 | 0.21 | 0.40 | 0.00 | 0.21 |
| SEQID-00708 | 0.02 | 0.05 | 0.03 | 0.07 | 0.07 | 0.03 | 0.07 | 0.05 | −17.53 | 0.23 | −0.02 | 5.44 | 0.21 | 0.40 | 0.00 | 0.21 |
| SEQID-00709 | 0.02 | 0.05 | 0.03 | 0.07 | 0.07 | 0.04 | 0.07 | 0.05 | −17.53 | 0.23 | −0.02 | 5.44 | 0.22 | 0.40 | 0.00 | 0.21 |
| SEQID-00710 | 0.02 | 0.05 | 0.03 | 0.07 | 0.07 | 0.04 | 0.07 | 0.05 | −17.62 | 0.22 | −0.02 | 5.845 | 0.21 | 0.375 | 0 | 0.2083 |
| SEQID-00711 | 0.02 | 0.05 | 0.03 | 0.07 | 0.07 | 0.04 | 0.07 | 0.05 | −17.66 | 0.22 | −0.02 | 5.946 | 0.21 | 0.375 | 0 | 0.2083 |
| SEQID-00712 | 0.02 | 0.05 | 0.03 | 0.07 | 0.07 | 0.04 | 0.07 | 0.05 | −17.64 | 0.22 | −0.02 | 5.844 | 0.21 | 0.375 | 0 | 0.2083 |
| SEQID-00713 | 0.02 | 0.05 | 0.04 | 0.07 | 0.07 | 0.04 | 0.07 | 0.05 | −17.62 | 0.22 | −0.02 | 5.844 | 0.21 | 0.375 | 0 | 0.2083 |
| SEQID-00714 | 0.02 | 0.05 | 0.03 | 0.07 | 0.07 | 0.04 | 0.07 | 0.05 | −17.63 | 0.22 | −0.02 | 5.844 | 0.21 | 0.375 | 0 | 0.2083 |
| SEQID-00715 | 0.02 | 0.05 | 0.03 | 0.07 | 0.07 | 0.04 | 0.07 | 0.05 | −17.74 | 0.22 | −0.01 | 5.973 | 0.21 | 0.375 | 0 | 0.2098 |
| SEQID-00716 | 0.05 | 0.03 | 0.05 | 0.04 | 0.04 | 0.01 | 0.03 | 0.04 | −22.86 | 0.27 | 0.00 | 6.68 | 0.00 | 0.35 | 0.25 | 0.22 |
| SEQID-00717 | 0.02 | 0.02 | 0.02 | 0.06 | 0.05 | 0.01 | 0.04 | 0.03 | −26.21 | 0.21 | 0.00 | 6.81 | 0.00 | 0.37 | 0.17 | 0.18 |
| SEQID-00718 | 0.02 | 0.02 | 0.02 | 0.05 | 0.04 | 0.01 | 0.04 | 0.03 | −26.84 | 0.21 | 0.00 | 6.67 | 0.00 | 0.38 | 0.17 | 0.19 |
| SEQID-00719 | 0.02 | 0.03 | 0.02 | 0.06 | 0.05 | 0.01 | 0.04 | 0.04 | −26.53 | 0.21 | 0.00 | 6.85 | 0.00 | 0.38 | 0.18 | 0.18 |
| SEQID-00720 | 0.04 | 0.01 | 0.05 | 0.05 | 0.06 | 0.03 | 0.04 | 0.06 | −17.51 | 0.47 | −0.01 | 6.05 | 0.20 | 0.33 | 0.00 | 0.20 |
| SEQID-00721 | 0.04 | 0.04 | 0.05 | 0.09 | 0.03 | 0.01 | 0.05 | 0.05 | −18.44 | 0.28 | 0.01 | 8.63 | 0.68 | 0.89 | 0.21 | 0.21 |
| SEQID-00722 | 0.02 | 0.04 | 0.04 | 0.06 | 0.05 | 0.00 | 0.02 | 0.05 | −23.26 | 0.35 | 0.00 | 7.76 | 0.22 | 0.32 | 0.00 | 0.22 |
| SEQID-00723 | 0.02 | 0.04 | 0.03 | 0.05 | 0.04 | 0.00 | 0.04 | 0.05 | −24.71 | 0.36 | −0.02 | 5.10 | 0.20 | 0.35 | 0.00 | 0.20 |
| SEQID-00724 | 0.02 | 0.08 | 0.08 | 0.05 | 0.07 | 0.03 | 0.05 | 0.07 | −17.74 | 0.39 | −0.01 | 6.43 | 0.20 | 0.34 | 0.00 | 0.20 |
| SEQID-00725 | 0.03 | 0.03 | 0.04 | 0.10 | 0.06 | 0.01 | 0.05 | 0.09 | −18.15 | 0.28 | 0.04 | 9.15 | 0.21 | 0.32 | 0.00 | 0.21 |
| SEQID-00726 | 0.05 | 0.05 | 0.02 | 0.05 | 0.06 | 0.02 | 0.06 | 0.05 | −19.47 | 0.43 | −0.03 | 5.16 | 0.21 | 0.31 | 0.00 | 0.22 |
| SEQID-00727 | 0.03 | 0.03 | 0.03 | 0.06 | 0.06 | 0.00 | 0.08 | 0.03 | −25.41 | 0.34 | 0.00 | 7.39 | 0.21 | 0.32 | 0.17 | 0.19 |
| SEQID-00728 | 0.02 | 0.09 | 0.05 | 0.05 | 0.05 | 0.02 | 0.04 | 0.06 | −20.49 | 0.42 | 0.02 | 8.79 | 0.27 | 0.35 | 0.19 | 0.23 |
| SEQID-00729 | 0.04 | 0.01 | 0.05 | 0.07 | 0.06 | 0.00 | 0.04 | 0.07 | −25.53 | 0.22 | −0.02 | 4.24 | 0.17 | 0.33 | 0.19 | 0.23 |
| SEQID-00730 | 0.02 | 0.02 | 0.05 | 0.05 | 0.06 | 0.01 | 0.01 | 0.07 | −19.93 | 0.43 | −0.10 | 7.52 | 0.20 | 0.34 | 0.23 | 0.25 |
| SEQID-00731 | 0.01 | 0.01 | 0.13 | 0.07 | 0.10 | 0.00 | 0.06 | 0.07 | −10.66 | 0.22 | 0.00 | 5.11 | 0.49 | 0.70 | 0.00 | 0.22 |
| SEQID-00732 | 0.02 | 0.05 | 0.02 | 0.08 | 0.04 | 0.02 | 0.06 | 0.05 | −22.90 | 0.30 | 0.03 | 7.94 | 0.21 | 0.31 | 0.00 | 0.21 |
| SEQID-00733 | 0.04 | 0.01 | 0.04 | 0.04 | 0.05 | 0.01 | 0.03 | 0.05 | −20.80 | 0.45 | 0.01 | 7.95 | 0.25 | 0.36 | 0.00 | 0.22 |
| SEQID-00738 | 0.03 | 0.04 | 0.05 | 0.05 | 0.05 | 0.00 | 0.05 | 0.07 | −16.46 | 0.43 | −0.01 | 5.84 | 0.18 | 0.41 | 0.19 | 0.21 |
| SEQID-00739 | 0.04 | 0.03 | 0.04 | 0.07 | 0.07 | 0.01 | 0.05 | 0.07 | −20.09 | 0.34 | −0.01 | 6.31 | 0.21 | 0.33 | 0.00 | 0.21 |
| SEQID-00740 | 0.02 | 0.05 | 0.04 | 0.05 | 0.06 | 0.02 | 0.06 | 0.04 | −28.10 | 0.45 | 0.04 | 9.88 | 0.23 | 0.38 | 0.00 | 0.21 |
| SEQID-00741 | 0.04 | 0.04 | 0.03 | 0.09 | 0.04 | 0.01 | 0.03 | 0.06 | −20.57 | 0.11 | −0.05 | 4.66 | 0.19 | 0.39 | 0.17 | 0.19 |
| SEQID-00742 | 0.03 | 0.06 | 0.05 | 0.06 | 0.06 | 0.01 | 0.05 | 0.08 | −18.67 | 0.37 | 0.00 | 5.11 | 0.20 | 0.34 | 0.19 | 0.23 |
| SEQID-00743 | 0.01 | 0.00 | 0.28 | 0.02 | 0.03 | 0.00 | 0.00 | 0.07 | −21.41 | 0.07 | 0.05 | 4.98 | 0.18 | 0.43 | 0.31 | 0.27 |
| SEQID-00744 | 0.02 | 0.05 | 0.05 | 0.05 | 0.06 | 0.02 | 0.04 | 0.06 | −20.48 | 0.24 | 0.00 | 7.10 | 0.37 | 0.56 | 0.00 | 0.22 |

TABLE 1-continued

| | | | | | | | | | | | | | | |
|---|---|---|---|---|---|---|---|---|---|---|---|---|---|---|
| SEQID-00746 | 0.02 | 0.03 | 0.11 | 0.03 | 0.05 | 0.05 | 0.03 | 0.05 | -19.27 | 0.23 | -0.01 | 6.42 | 0.22 | 0.32 | 0.23 | 0.25 |
| SEQID-00747 | 0.03 | 0.04 | 0.04 | 0.05 | 0.05 | 0.05 | 0.05 | 0.07 | -18.93 | 0.47 | -0.01 | 5.90 | 0.21 | 0.33 | 0.00 | 0.22 |
| SEQID-00748 | 0.03 | 0.06 | 0.06 | 0.05 | 0.04 | 0.02 | 0.05 | 0.06 | -18.69 | 0.48 | 0.04 | 10.26 | 0.19 | 0.40 | 0.19 | 0.21 |
| SEQID-00749 | 0.02 | 0.04 | 0.06 | 0.05 | 0.06 | 0.01 | 0.02 | 0.08 | -20.08 | 0.43 | -0.01 | 6.51 | 0.00 | 0.33 | 0.00 | 0.20 |
| SEQID-00750 | 0.03 | 0.06 | 0.04 | 0.05 | 0.05 | 0.01 | 0.01 | 0.06 | -22.29 | 0.42 | -0.03 | 5.11 | 0.22 | 0.33 | 0.20 | 0.23 |
| SEQID-00751 | 0.01 | 0.02 | 0.16 | 0.09 | 0.08 | 0.01 | 0.06 | 0.05 | -15.46 | 0.16 | 0.03 | 8.07 | 0.22 | 0.34 | 0.00 | 0.24 |
| SEQID-00752 | 0.03 | 0.04 | 0.05 | 0.07 | 0.08 | 0.00 | 0.03 | 0.07 | -21.91 | 0.33 | 0.01 | 9.44 | 0.21 | 0.35 | 0.22 | 0.21 |
| SEQID-00753 | 0.01 | 0.05 | 0.02 | 0.07 | 0.05 | 0.01 | 0.04 | 0.04 | -20.98 | 0.47 | -0.02 | 5.20 | 0.22 | 0.35 | 0.00 | 0.23 |
| SEQID-00754 | 0.03 | 0.02 | 0.07 | 0.09 | 0.03 | 0.01 | 0.02 | 0.05 | -30.38 | 0.15 | -0.04 | 4.71 | 0.00 | 0.32 | 0.20 | 0.21 |
| SEQID-00755 | 0.04 | 0.05 | 0.02 | 0.06 | 0.06 | 0.06 | 0.04 | 0.05 | -21.04 | 0.43 | -0.03 | 5.03 | 0.00 | 0.30 | 0.00 | 0.21 |
| SEQID-00756 | 0.01 | 0.02 | 0.20 | 0.04 | 0.03 | 0.01 | 0.02 | 0.03 | -14.62 | 0.15 | 0.00 | 7.76 | 0.59 | 0.30 | 0.20 | 0.39 |
| SEQID-00757 | 0.02 | 0.03 | 0.08 | 0.12 | 0.06 | 0.01 | 0.02 | 0.04 | -20.53 | 0.21 | 0.00 | 7.12 | 0.18 | 0.38 | 0.19 | 0.19 |
| SEQID-00758 | 0.02 | 0.04 | 0.05 | 0.06 | 0.06 | 0.03 | 0.05 | 0.08 | -19.05 | 0.40 | -0.01 | 6.39 | 0.19 | 0.33 | 0.00 | 0.21 |
| SEQID-00759 | 0.02 | 0.03 | 0.04 | 0.07 | 0.04 | 0.03 | 0.06 | 0.06 | -23.41 | 0.23 | -0.03 | 5.04 | 0.00 | 0.31 | 0.21 | 0.25 |
| SEQID-00760 | 0.04 | 0.05 | 0.05 | 0.04 | 0.05 | 0.01 | 0.04 | 0.07 | -21.34 | 0.43 | 0.00 | 6.82 | 0.20 | 0.33 | 0.19 | 0.21 |
| SEQID-00761 | 0.00 | 0.02 | 0.10 | 0.27 | 0.03 | 0.00 | 0.04 | 0.06 | -8.13 | 0.28 | 0.02 | 8.77 | 0.25 | 0.52 | 0.22 | 0.27 |
| SEQID-00762 | 0.02 | 0.08 | 0.02 | 0.02 | 0.03 | 0.02 | 0.02 | 0.11 | -19.85 | 0.47 | 0.01 | 7.35 | 0.26 | 0.30 | 0.15 | 0.25 |
| SEQID-00763 | 0.05 | 0.05 | 0.04 | 0.05 | 0.03 | 0.02 | 0.06 | 0.05 | -19.53 | 0.43 | -0.03 | 5.15 | 0.21 | 0.31 | 0.00 | 0.22 |
| SEQID-00764 | 0.02 | 0.07 | 0.04 | 0.07 | 0.05 | 0.01 | 0.08 | 0.08 | -17.08 | 0.44 | 0.02 | 8.94 | 0.25 | 0.34 | 0.26 | 0.22 |
| SEQID-00765 | 0.02 | 0.04 | 0.01 | 0.04 | 0.04 | 0.03 | 0.03 | 0.04 | -25.78 | 0.23 | -0.04 | 4.94 | 0.16 | 0.36 | 0.18 | 0.27 |
| SEQID-00766 | 0.05 | 0.07 | 0.03 | 0.03 | 0.05 | 0.02 | 0.05 | 0.06 | -19.72 | 0.34 | -0.06 | 4.46 | 0.40 | 0.54 | 0.00 | 0.19 |
| SEQID-00767 | 0.03 | 0.04 | 0.05 | 0.04 | 0.06 | 0.01 | 0.04 | 0.08 | -22.21 | 0.39 | 0.03 | 9.56 | 0.22 | 0.35 | 0.00 | 0.22 |
| SEQID-00768 | 0.03 | 0.08 | 0.04 | 0.04 | 0.04 | 0.01 | 0.04 | 0.06 | -23.12 | 0.37 | -0.03 | 4.87 | 0.68 | 0.91 | 0.21 | 0.22 |
| SEQID-00769 | 0.04 | 0.03 | 0.03 | 0.04 | 0.06 | 0.01 | 0.06 | 0.04 | -26.06 | 0.29 | -0.07 | 4.36 | 0.22 | 0.33 | 0.00 | 0.21 |
| SEQID-00770 | 0.03 | 0.06 | 0.04 | 0.05 | 0.05 | 0.01 | 0.06 | 0.08 | -19.57 | 0.40 | -0.05 | 4.68 | 0.80 | 0.90 | 0.23 | 0.00 |
| SEQID-00771 | 0.03 | 0.04 | 0.04 | 0.05 | 0.03 | 0.01 | 0.04 | 0.05 | -23.12 | 0.39 | -0.01 | 5.89 | 0.21 | 0.36 | 0.22 | 0.22 |
| SEQID-00772 | 0.02 | 0.05 | 0.03 | 0.04 | 0.04 | 0.02 | 0.08 | 0.05 | -24.11 | 0.37 | -0.05 | 4.75 | 0.20 | 0.33 | 0.00 | 0.22 |
| SEQID-00773 | 0.02 | 0.04 | 0.01 | 0.04 | 0.03 | 0.03 | 0.03 | 0.03 | -27.93 | 0.22 | -0.06 | 4.57 | 0.17 | 0.34 | 0.00 | 0.20 |
| SEQID-00774 | 0.01 | 0.04 | 0.09 | 0.07 | 0.05 | 0.04 | 0.01 | 0.06 | -19.68 | 0.37 | 0.08 | 10.85 | 0.23 | 0.32 | 0.18 | 0.18 |
| SEQID-00775 | 0.01 | 0.02 | 0.04 | 0.07 | 0.06 | 0.01 | 0.02 | 0.06 | -21.63 | 0.29 | 0.04 | 9.61 | 0.19 | 0.37 | 0.00 | 0.25 |
| SEQID-00776 | 0.02 | 0.08 | 0.01 | 0.10 | 0.05 | 0.00 | 0.03 | 0.05 | -16.79 | 0.24 | -0.01 | 5.66 | 0.62 | 0.91 | 0.22 | 0.21 |
| SEQID-00777 | 0.03 | 0.03 | 0.02 | 0.03 | 0.04 | 0.01 | 0.03 | 0.04 | -28.02 | 0.23 | -0.02 | 5.49 | 0.18 | 0.42 | 0.21 | 0.22 |
| SEQID-00778 | 0.03 | 0.04 | 0.01 | 0.01 | 0.03 | 0.02 | 0.02 | 0.03 | -29.55 | 0.22 | -0.02 | 5.34 | 0.19 | 0.42 | 0.17 | 0.18 |
| SEQID-00779 | 0.03 | 0.05 | 0.04 | 0.05 | 0.05 | 0.01 | 0.02 | 0.07 | -18.79 | 0.42 | -0.01 | 6.24 | 0.19 | 0.34 | 0.18 | 0.18 |
| SEQID-00780 | 0.03 | 0.05 | 0.05 | 0.06 | 0.08 | 0.02 | 0.04 | 0.06 | -22.58 | 0.29 | 0.02 | 8.69 | 1.00 | 1.00 | 0.19 | 0.19 |
| SEQID-00781 | 0.04 | 0.04 | 0.03 | 0.09 | 0.03 | 0.01 | 0.08 | 0.05 | -18.68 | 0.26 | 0.01 | 8.78 | 0.69 | 0.89 | 0.00 | 0.00 |
| SEQID-00782 | 0.02 | 0.02 | 0.04 | 0.07 | 0.07 | 0.00 | 0.05 | 0.05 | -26.50 | 0.17 | -0.04 | 4.77 | 0.30 | 0.44 | 0.21 | 0.21 |
| SEQID-00783 | 0.03 | 0.04 | 0.02 | 0.06 | 0.06 | 0.03 | 0.04 | 0.06 | -22.76 | 0.29 | -0.01 | 6.25 | 0.00 | 0.31 | 0.00 | 0.22 |
| SEQID-00784 | 0.02 | 0.03 | 0.03 | 0.04 | 0.04 | 0.00 | 0.03 | 0.05 | -25.48 | 0.36 | 0.01 | 8.05 | 0.20 | 0.34 | 0.43 | 0.22 |
| SEQID-00785 | 0.03 | 0.04 | 0.05 | 0.04 | 0.04 | 0.02 | 0.04 | 0.09 | -20.73 | 0.43 | 0.03 | 9.50 | 0.23 | 0.32 | 0.00 | 0.22 |
| SEQID-00786 | 0.03 | 0.05 | 0.03 | 0.05 | 0.05 | 0.01 | 0.05 | 0.05 | -28.05 | 0.31 | -0.05 | 4.66 | 0.65 | 0.88 | 0.00 | 0.21 |
| SEQID-00787 | 0.04 | 0.10 | 0.02 | 0.07 | 0.03 | 0.02 | 0.07 | 0.05 | -16.15 | 0.45 | 0.05 | 10.26 | 0.22 | 0.33 | 0.00 | 0.19 |
| SEQID-00788 | 0.03 | 0.04 | 0.05 | 0.04 | 0.04 | 0.00 | 0.04 | 0.08 | -17.76 | 0.53 | -0.03 | 4.92 | 0.22 | 0.36 | 0.23 | 0.22 |
| SEQID-00789 | 0.02 | 0.03 | 0.03 | 0.04 | 0.04 | 0.05 | 0.02 | 0.05 | -23.69 | 0.42 | 0.03 | 9.29 | 0.24 | 0.35 | 0.00 | 0.00 |
| SEQID-00790 | 0.02 | 0.02 | 0.04 | 0.02 | 0.02 | 0.00 | 0.03 | 0.04 | -25.14 | 0.25 | 0.11 | 10.51 | 0.22 | 0.30 | 0.27 | 0.00 |
| SEQID-00791 | 0.02 | 0.06 | 0.06 | 0.04 | 0.04 | 0.02 | 0.04 | 0.05 | -18.94 | 0.44 | 0.01 | 7.91 | 0.18 | 0.34 | 0.21 | 0.22 |
| SEQID-00792 | 0.03 | 0.05 | 0.02 | 0.05 | 0.05 | 0.01 | 0.05 | 0.05 | -23.78 | 0.31 | 0.00 | 7.09 | 0.18 | 0.34 | 0.18 | 0.18 |
| SEQID-00793 | 0.03 | 0.07 | 0.05 | 0.05 | 0.06 | 0.02 | 0.07 | 0.08 | -21.12 | 0.40 | -0.03 | 5.00 | 0.25 | 0.39 | 0.00 | 0.00 |
| SEQID-00794 | 0.02 | 0.04 | 0.04 | 0.04 | 0.05 | 0.01 | 0.04 | 0.04 | -22.19 | 0.35 | -0.01 | 6.31 | 0.20 | 0.34 | 0.20 | 0.20 |
| SEQID-00795 | 0.04 | 0.03 | 0.04 | 0.06 | 0.04 | 0.02 | 0.03 | 0.07 | -18.67 | 0.51 | 0.00 | 6.89 | 0.17 | 0.34 | 0.18 | 0.19 |
| SEQID-00796 | 0.02 | 0.06 | 0.04 | 0.05 | 0.05 | 0.01 | 0.06 | 0.07 | -19.06 | 0.46 | -0.01 | 6.44 | 0.19 | 0.37 | 0.19 | 0.20 |
| SEQID-00797 | 0.01 | 0.03 | 0.02 | 0.07 | 0.04 | 0.01 | 0.02 | 0.04 | -24.56 | 0.24 | 0.00 | 6.34 | 0.22 | 0.34 | 0.00 | 0.22 |
| SEQID-00798 | 0.03 | 0.07 | 0.04 | 0.06 | 0.05 | 0.02 | 0.06 | 0.07 | -19.87 | 0.41 | -0.05 | 4.37 | 0.20 | 0.33 | 0.00 | 0.21 |

TABLE 1-continued

| | | | | | | | | | | | | | | |
|---|---|---|---|---|---|---|---|---|---|---|---|---|---|---|
| SEQID-00799 | 0.03 | 0.06 | 0.04 | 0.05 | 0.04 | 0.01 | 0.06 | 0.06 | -20.28 | 0.40 | 0.00 | 6.88 | 0.21 | 0.33 | 0.20 | 0.21 |
| SEQID-00800 | 0.02 | 0.05 | 0.04 | 0.05 | 0.06 | 0.02 | 0.07 | 0.06 | -23.63 | 0.24 | 0.01 | 8.40 | 0.90 | 0.95 | 0.00 | 0.00 |
| SEQID-00801 | 0.03 | 0.03 | 0.05 | 0.08 | 0.05 | 0.02 | 0.04 | 0.05 | -26.41 | 0.21 | 0.05 | 10.06 | 0.20 | 0.33 | 0.00 | 0.21 |
| SEQID-00802 | 0.03 | 0.04 | 0.02 | 0.09 | 0.03 | 0.00 | 0.04 | 0.05 | -22.03 | 0.28 | 0.00 | 6.55 | 0.56 | 0.76 | 0.00 | 0.22 |
| SEQID-00803 | 0.03 | 0.04 | 0.07 | 0.07 | 0.02 | 0.02 | 0.07 | 0.04 | -19.42 | 0.33 | -0.02 | 5.12 | 0.88 | 0.89 | 0.00 | 0.21 |
| SEQID-00804 | 0.03 | 0.05 | 0.03 | 0.06 | 0.06 | 0.01 | 0.05 | 0.06 | -22.56 | 0.39 | 0.00 | 6.80 | 0.22 | 0.33 | 0.00 | 0.21 |
| SEQID-00805 | 0.04 | 0.05 | 0.13 | 0.05 | 0.04 | 0.01 | 0.02 | 0.09 | -15.61 | 0.52 | -0.03 | 5.06 | 0.92 | 0.94 | 0.23 | 0.22 |
| SEQID-00806 | 0.05 | 0.05 | 0.05 | 0.06 | 0.05 | 0.02 | 0.06 | 0.06 | -19.07 | 0.45 | -0.02 | 6.01 | 0.20 | 0.30 | 0.00 | 0.21 |
| SEQID-00807 | 0.02 | 0.04 | 0.04 | 0.07 | 0.06 | 0.02 | 0.04 | 0.06 | -22.08 | 0.41 | 0.01 | 7.91 | 0.20 | 0.34 | 0.00 | 0.20 |
| SEQID-00808 | 0.03 | 0.03 | 0.04 | 0.04 | 0.05 | 0.01 | 0.07 | 0.05 | -24.86 | 0.25 | -0.07 | 4.43 | 0.19 | 0.35 | 0.00 | 0.20 |
| SEQID-00809 | 0.02 | 0.05 | 0.09 | 0.05 | 0.07 | 0.01 | 0.07 | 0.06 | -15.74 | 0.43 | -0.01 | 6.10 | 0.84 | 0.95 | 0.00 | 0.24 |
| SEQID-00810 | 0.03 | 0.06 | 0.03 | 0.06 | 0.04 | 0.01 | 0.03 | 0.07 | -21.00 | 0.44 | -0.04 | 4.78 | 0.19 | 0.32 | 0.00 | 0.22 |
| SEQID-00811 | 0.03 | 0.06 | 0.02 | 0.05 | 0.06 | 0.02 | 0.05 | 0.04 | -21.49 | 0.37 | -0.02 | 5.48 | 0.22 | 0.32 | 0.00 | 0.22 |
| SEQID-00812 | 0.02 | 0.05 | 0.01 | 0.09 | 0.08 | 0.01 | 0.05 | 0.05 | -23.69 | 0.30 | -0.07 | 4.28 | 0.22 | 0.31 | 0.00 | 0.00 |
| SEQID-00813 | 0.04 | 0.07 | 0.04 | 0.04 | 0.04 | 0.03 | 0.05 | 0.05 | -20.90 | 0.36 | 0.00 | 6.68 | 0.20 | 0.33 | 0.22 | 0.21 |
| SEQID-00814 | 0.02 | 0.04 | 0.07 | 0.06 | 0.04 | 0.01 | 0.01 | 0.04 | -15.97 | 0.54 | 0.06 | 9.25 | 1.00 | 1.00 | 0.00 | 0.25 |
| SEQID-00815 | 0.02 | 0.07 | 0.03 | 0.06 | 0.04 | 0.03 | 0.06 | 0.04 | -21.94 | 0.26 | -0.02 | 5.45 | 0.20 | 0.33 | 0.00 | 0.20 |
| SEQID-00816 | 0.02 | 0.04 | 0.03 | 0.05 | 0.05 | 0.01 | 0.03 | 0.07 | -21.25 | 0.54 | -0.02 | 5.30 | 0.19 | 0.34 | 0.00 | 0.20 |
| SEQID-00817 | 0.03 | 0.06 | 0.03 | 0.08 | 0.05 | 0.02 | 0.03 | 0.05 | -17.92 | 0.47 | -0.03 | 4.98 | 0.22 | 0.31 | 0.00 | 0.22 |
| SEQID-00818 | 0.03 | 0.05 | 0.03 | 0.04 | 0.04 | 0.00 | 0.03 | 0.04 | -22.52 | 0.26 | 0.01 | 8.12 | 0.19 | 0.33 | 0.00 | 0.20 |
| SEQID-00819 | 0.02 | 0.03 | 0.01 | 0.02 | 0.06 | 0.01 | 0.06 | 0.08 | -23.82 | 0.30 | 0.01 | 11.91 | 0.19 | 0.23 | 0.00 | 0.28 |
| SEQID-00820 | 0.05 | 0.05 | 0.05 | 0.07 | 0.05 | 0.01 | 0.05 | 0.02 | -22.32 | 0.13 | 0.00 | 6.55 | 0.19 | 0.33 | 0.19 | 0.70 |
| SEQID-00821 | 0.02 | 0.06 | 0.03 | 0.05 | 0.03 | 0.01 | 0.02 | 0.05 | -27.82 | 0.30 | -0.05 | 4.54 | 0.75 | 0.89 | 0.18 | 0.21 |
| SEQID-00822 | 0.03 | 0.03 | 0.04 | 0.04 | 0.04 | 0.01 | 0.01 | 0.09 | -21.46 | 0.48 | 0.00 | 6.76 | 0.21 | 0.33 | 0.00 | 0.21 |
| SEQID-00823 | 0.03 | 0.05 | 0.05 | 0.06 | 0.04 | 0.02 | 0.04 | 0.07 | -19.60 | 0.45 | 0.03 | 9.21 | 0.21 | 0.38 | 0.00 | 0.23 |
| SEQID-00824 | 0.02 | 0.07 | 0.05 | 0.06 | 0.05 | 0.03 | 0.07 | 0.06 | -18.82 | 0.38 | 0.01 | 7.62 | 0.43 | 0.70 | 0.21 | 0.21 |
| SEQID-00825 | 0.02 | 0.04 | 0.05 | 0.06 | 0.06 | 0.01 | 0.03 | 0.03 | -27.73 | 0.20 | -0.01 | 5.87 | 0.20 | 0.34 | 0.21 | 0.12 |
| SEQID-00826 | 0.02 | 0.05 | 0.02 | 0.08 | 0.05 | 0.03 | 0.04 | 0.06 | -23.22 | 0.17 | -0.06 | 4.46 | 0.22 | 0.32 | 0.00 | 0.22 |
| SEQID-00827 | 0.02 | 0.05 | 0.04 | 0.05 | 0.04 | 0.02 | 0.04 | 0.05 | -18.66 | 0.36 | -0.01 | 6.55 | 0.18 | 0.33 | 0.00 | 0.19 |
| SEQID-00828 | 0.02 | 0.05 | 0.04 | 0.06 | 0.05 | 0.00 | 0.05 | 0.06 | -21.15 | 0.40 | -0.01 | 5.88 | 0.19 | 0.33 | 0.19 | 0.22 |
| SEQID-00829 | 0.04 | 0.02 | 0.03 | 0.03 | 0.06 | 0.01 | 0.02 | 0.04 | -27.07 | 0.18 | 0.00 | 6.97 | 0.19 | 0.36 | 0.19 | 0.17 |
| SEQID-00830 | 0.05 | 0.05 | 0.04 | 0.04 | 0.05 | 0.02 | 0.05 | 0.02 | -31.03 | 0.20 | 0.03 | 9.50 | 0.21 | 0.31 | 0.18 | 0.23 |
| SEQID-00831 | 0.02 | 0.06 | 0.03 | 0.07 | 0.03 | 0.03 | 0.04 | 0.06 | -20.27 | 0.49 | -0.01 | 6.52 | 0.19 | 0.32 | 0.00 | 0.20 |
| SEQID-00832 | 0.03 | 0.07 | 0.07 | 0.04 | 0.03 | 0.03 | 0.03 | 0.05 | -19.84 | 0.49 | -0.02 | 6.35 | 0.23 | 0.33 | 0.24 | 0.23 |
| SEQID-00833 | 0.03 | 0.03 | 0.06 | 0.08 | 0.06 | 0.03 | 0.03 | 0.06 | -18.70 | 0.04 | 0.03 | 5.99 | 0.00 | 0.36 | 0.00 | 0.18 |
| SEQID-00834 | 0.03 | 0.04 | 0.07 | 0.06 | 0.06 | 0.01 | 0.04 | 0.05 | -19.80 | 0.30 | 0.03 | 9.51 | 0.21 | 0.33 | 0.00 | 0.20 |
| SEQID-00835 | 0.02 | 0.06 | 0.03 | 0.04 | 0.05 | 0.05 | 0.07 | 0.06 | -21.75 | 0.42 | 0.04 | 9.78 | 0.20 | 0.33 | 0.00 | 0.20 |
| SEQID-00836 | 0.02 | 0.02 | 0.05 | 0.07 | 0.05 | 0.04 | 0.05 | 0.04 | -28.27 | 0.15 | -0.06 | 4.67 | 0.00 | 0.36 | 0.16 | 0.19 |
| SEQID-00837 | 0.01 | 0.07 | 0.05 | 0.05 | 0.02 | 0.01 | 0.01 | 0.04 | -23.16 | 0.37 | 0.01 | 8.05 | 0.44 | 0.59 | 0.00 | 0.21 |
| SEQID-00838 | 0.02 | 0.06 | 0.06 | 0.06 | 0.06 | 0.04 | 0.03 | 0.05 | -17.20 | 0.33 | 0.02 | 4.36 | 0.23 | 0.43 | 0.00 | 0.21 |
| SEQID-00839 | 0.02 | 0.09 | 0.04 | 0.05 | 0.07 | 0.05 | 0.08 | 0.08 | -17.20 | 0.33 | -0.04 | 4.36 | 0.23 | 0.43 | 0.00 | 0.21 |
| SEQID-00840 | 0.02 | 0.05 | 0.06 | 0.08 | 0.06 | 0.03 | 0.04 | 0.04 | -16.79 | 0.41 | -0.03 | 4.92 | 0.23 | 0.41 | 0.00 | 0.22 |
| SEQID-00841 | 0.02 | 0.07 | 0.06 | 0.05 | 0.06 | 0.03 | 0.06 | 0.07 | -15.70 | 0.45 | 0.01 | 8.78 | 0.21 | 0.33 | 0.00 | 0.21 |
| SEQID-00842 | 0.02 | 0.08 | 0.05 | 0.06 | 0.06 | 0.07 | 0.05 | 0.08 | -15.37 | 0.40 | -0.01 | 6.24 | 0.21 | 0.33 | 0.00 | 0.20 |
| SEQID-00843 | 0.02 | 0.05 | 0.03 | 0.04 | 0.04 | 0.05 | 0.09 | 0.05 | -19.75 | 0.35 | -0.06 | 4.34 | 0.21 | 0.33 | 0.00 | 0.21 |
| SEQID-00844 | 0.02 | 0.08 | 0.05 | 0.07 | 0.04 | 0.04 | 0.03 | 0.06 | -17.13 | 0.43 | 0.03 | 9.49 | 0.20 | 0.36 | 0.00 | 0.19 |
| SEQID-00845 | 0.02 | 0.06 | 0.05 | 0.05 | 0.04 | 0.04 | 0.03 | 0.05 | -19.30 | 0.37 | 0.02 | 8.68 | 0.44 | 0.59 | 0.00 | 0.21 |
| SEQID-00846 | 0.01 | 0.07 | 0.06 | 0.06 | 0.03 | 0.03 | 0.03 | 0.08 | -19.54 | 0.47 | -0.01 | 5.25 | 0.23 | 0.37 | 0.21 | 0.21 |
| SEQID-00847 | 0.02 | 0.07 | 0.04 | 0.07 | 0.06 | 0.04 | 0.05 | 0.04 | -15.64 | 0.32 | 0.00 | 7.17 | 0.21 | 0.31 | 0.35 | 0.22 |
| SEQID-00848 | 0.02 | 0.05 | 0.02 | 0.06 | 0.04 | 0.04 | 0.03 | 0.04 | -20.06 | 0.27 | -0.02 | 5.45 | 0.21 | 0.31 | 0.29 | 0.21 |
| SEQID-00849 | 0.02 | 0.08 | 0.02 | 0.09 | 0.08 | 0.05 | 0.06 | 0.07 | -17.01 | 0.41 | -0.06 | 4.10 | 0.25 | 0.35 | 0.00 | 0.21 |
| SEQID-00850 | 0.01 | 0.03 | 0.03 | 0.12 | 0.08 | 0.03 | 0.09 | 0.09 | -14.72 | 0.43 | -0.03 | 4.43 | 0.22 | 0.41 | 0.00 | 0.22 |
| SEQID-00851 | 0.01 | 0.07 | 0.06 | 0.05 | 0.03 | 0.04 | 0.07 | 0.05 | -16.72 | 0.46 | -0.01 | 5.64 | 0.25 | 0.31 | 0.00 | 0.00 |

TABLE 1-continued

| SEQID | | | | | | | | | | | | | | | | | |
|---|---|---|---|---|---|---|---|---|---|---|---|---|---|---|---|---|---|
| SEQID-00852 | 0.03 | 0.08 | 0.03 | 0.08 | 0.06 | 0.05 | 0.06 | 0.06 | -11.63 | 0.39 | 0.03 | 8.62 | 0.29 | 0.37 | 0.00 | 0.19 |
| SEQID-00853 | 0.01 | 0.05 | 0.06 | 0.07 | 0.01 | 0.03 | 0.07 | 0.05 | -21.01 | 0.41 | 0.02 | 8.22 | 0.28 | 0.30 | 0.25 | 0.26 |
| SEQID-00854 | 0.02 | 0.04 | 0.05 | 0.05 | 0.04 | 0.03 | 0.09 | 0.03 | -22.92 | 0.44 | 0.01 | 7.66 | 0.20 | 0.28 | 0.21 | 0.22 |
| SEQID-00855 | 0.02 | 0.06 | 0.03 | 0.05 | 0.05 | 0.02 | 0.06 | 0.04 | -22.85 | 0.50 | -0.02 | 5.69 | 0.28 | 0.32 | 0.23 | 0.27 |
| SEQID-00856 | 0.03 | 0.04 | 0.05 | 0.07 | 0.07 | 0.02 | 0.02 | 0.05 | -21.90 | 0.33 | 0.04 | 9.19 | 0.21 | 0.29 | 0.00 | 0.00 |
| SEQID-00857 | 0.02 | 0.05 | 0.06 | 0.06 | 0.04 | 0.00 | 0.03 | 0.05 | -20.43 | 0.34 | -0.04 | 4.89 | 0.21 | 0.33 | 0.20 | 0.21 |
| SEQID-00858 | 0.02 | 0.05 | 0.04 | 0.05 | 0.07 | 0.00 | 0.05 | 0.04 | -19.78 | 0.44 | 0.00 | 6.90 | 0.20 | 0.30 | 0.00 | 0.00 |
| SEQID-00859 | 0.02 | 0.03 | 0.04 | 0.09 | 0.07 | 0.00 | 0.01 | 0.03 | -22.27 | 0.41 | -0.01 | 6.63 | 0.21 | 0.33 | 0.23 | 0.22 |
| SEQID-00860 | 0.03 | 0.03 | 0.02 | 0.06 | 0.05 | 0.00 | 0.08 | 0.05 | -25.41 | 0.34 | 0.00 | 7.39 | 0.21 | 0.32 | 0.00 | 0.00 |
| SEQID-00861 | 0.05 | 0.05 | 0.04 | 0.05 | 0.06 | 0.02 | 0.06 | 0.05 | -19.53 | 0.43 | -0.03 | 5.15 | 0.21 | 0.31 | 0.00 | 0.22 |
| SEQID-00862 | 0.05 | 0.05 | 0.04 | 0.05 | 0.06 | 0.02 | 0.06 | 0.05 | -19.52 | 0.43 | -0.03 | 5.16 | 0.21 | 0.31 | 0.00 | 0.22 |
| SEQID-00863 | 0.02 | 0.04 | 0.02 | 0.03 | 0.08 | 0.00 | 0.02 | 0.05 | -23.67 | 0.33 | 0.00 | 7.90 | 0.22 | 0.31 | 0.00 | 0.21 |
| SEQID-00864 | 0.07 | 0.08 | 0.01 | 0.03 | 0.05 | 0.00 | 0.01 | 0.04 | -28.98 | 0.24 | -0.15 | 3.89 | 0.44 | 0.48 | 0.24 | 0.19 |
| SEQID-00865 | 0.08 | 0.07 | 0.01 | 0.03 | 0.06 | 0.00 | 0.00 | 0.05 | -27.55 | 0.34 | -0.16 | 3.79 | 0.39 | 0.46 | 0.22 | 0.24 |
| SEQID-00866 | 0.06 | 0.08 | 0.01 | 0.04 | 0.03 | 0.03 | 0.07 | 0.04 | -29.02 | 0.33 | -0.16 | 3.88 | 0.39 | 0.44 | 0.23 | 0.24 |
| SEQID-00867 | 0.05 | 0.07 | 0.01 | 0.04 | 0.04 | 0.02 | 0.00 | 0.04 | -28.60 | 0.33 | -0.18 | 3.76 | 0.44 | 0.49 | 0.24 | 0.23 |
| SEQID-00868 | 0.09 | 0.10 | 0.01 | 0.05 | 0.04 | 0.03 | 0.03 | 0.03 | -24.77 | 0.34 | -0.12 | 3.96 | 0.34 | 0.45 | 0.00 | 0.00 |
| SEQID-00869 | 0.06 | 0.07 | 0.02 | 0.01 | 0.06 | 0.01 | 0.01 | 0.06 | -28.16 | 0.29 | -0.14 | 3.97 | 0.44 | 0.47 | 0.23 | 0.25 |
| SEQID-00870 | 0.07 | 0.07 | 0.01 | 0.04 | 0.04 | 0.02 | 0.02 | 0.05 | -28.99 | 0.30 | -0.13 | 4.03 | 0.35 | 0.45 | 0.00 | 0.00 |
| SEQID-00871 | 0.02 | 0.04 | 0.04 | 0.05 | 0.06 | 0.03 | 0.03 | 0.06 | -25.67 | 0.29 | -0.03 | 4.94 | 0.23 | 0.34 | 0.00 | 0.00 |
| SEQID-00872 | 0.04 | 0.03 | 0.03 | 0.04 | 0.07 | 0.05 | 0.08 | 0.08 | -25.39 | 0.32 | 0.01 | 8.62 | 0.00 | 0.33 | 0.00 | 0.21 |
| SEQID-00873 | 0.03 | 0.03 | 0.03 | 0.04 | 0.06 | 0.06 | 0.06 | 0.07 | -25.16 | 0.32 | 0.02 | 8.95 | 0.22 | 0.33 | 0.00 | 0.22 |
| SEQID-00874 | 0.01 | 0.04 | 0.03 | 0.03 | 0.03 | 0.07 | 0.05 | 0.05 | -25.15 | 0.33 | -0.08 | 4.45 | 0.25 | 0.31 | 0.21 | 0.25 |
| SEQID-00875 | 0.02 | 0.04 | 0.03 | 0.03 | 0.04 | 0.07 | 0.07 | 0.05 | -25.71 | 0.29 | 0.08 | 4.36 | 0.23 | 0.34 | 0.21 | 0.25 |
| SEQID-00876 | 0.02 | 0.03 | 0.02 | 0.04 | 0.05 | 0.05 | 0.02 | 0.05 | -26.34 | 0.38 | -0.10 | 4.27 | 0.23 | 0.31 | 0.22 | 0.22 |
| SEQID-00877 | 0.03 | 0.03 | 0.02 | 0.05 | 0.02 | 0.02 | 0.06 | 0.07 | -27.67 | 0.29 | 0.10 | 4.27 | 0.24 | 0.31 | 0.25 | 0.25 |
| SEQID-00878 | 0.03 | 0.05 | 0.03 | 0.04 | 0.03 | 0.06 | 0.04 | 0.06 | -26.25 | 0.35 | -0.01 | 5.48 | 0.21 | 0.33 | 0.21 | 0.22 |
| SEQID-00879 | 0.03 | 0.05 | 0.03 | 0.05 | 0.04 | 0.04 | 0.04 | 0.07 | -25.44 | 0.39 | 0.00 | 7.29 | 0.20 | 0.31 | 0.00 | 0.23 |
| SEQID-00880 | 0.03 | 0.02 | 0.09 | 0.06 | 0.01 | 0.00 | 0.00 | 0.00 | -21.21 | 0.14 | 0.01 | 8.06 | 0.35 | 0.34 | 0.34 | 0.36 |
| SEQID-00881 | 0.02 | 0.00 | 0.06 | 0.09 | 0.13 | 0.00 | 0.00 | 0.01 | -15.62 | 0.24 | 0.01 | 7.37 | 0.27 | 0.31 | 0.30 | 0.31 |
| SEQID-00882 | 0.04 | 0.01 | 0.06 | 0.08 | 0.05 | 0.00 | 0.02 | 0.02 | -29.20 | 0.07 | -0.02 | 5.28 | 0.29 | 0.30 | 0.30 | 0.30 |
| SEQID-00883 | 0.01 | 0.05 | 0.04 | 0.03 | 0.04 | 0.01 | 0.01 | 0.03 | -23.50 | 0.25 | 0.05 | 8.55 | 0.23 | 0.35 | 0.25 | 0.25 |
| SEQID-00884 | 0.02 | 0.03 | 0.04 | 0.12 | 0.02 | 0.00 | 0.01 | 0.04 | -19.99 | 0.33 | 0.07 | 10.84 | 0.23 | 0.35 | 0.24 | 0.23 |
| SEQID-00885 | 0.03 | 0.04 | 0.03 | 0.05 | 0.04 | 0.01 | 0.02 | 0.03 | -20.99 | 0.15 | 0.08 | 11.70 | 0.24 | 0.37 | 0.25 | 0.25 |
| SEQID-00886 | 0.04 | 0.05 | 0.01 | 0.00 | 0.06 | 0.00 | 0.02 | 0.05 | -30.02 | 0.32 | 0.07 | 10.21 | 0.21 | 0.28 | 0.21 | 1.00 |
| SEQID-00887 | 0.01 | 0.06 | 0.03 | 0.00 | 0.03 | 0.02 | 0.02 | 0.07 | -32.84 | 0.06 | 0.07 | 10.25 | 0.29 | 0.28 | 0.28 | 0.27 |
| SEQID-00888 | 0.01 | 0.03 | 0.01 | 0.00 | 0.07 | 0.05 | 0.02 | 0.04 | -44.55 | 0.23 | -0.34 | 3.56 | 0.30 | 0.29 | 0.19 | 0.10 |
| SEQID-00889 | 0.07 | 0.04 | 0.02 | 0.00 | 0.04 | 0.04 | 0.04 | 0.02 | -33.51 | 0.19 | -0.10 | 4.35 | 0.28 | 0.32 | 0.00 | 0.26 |
| SEQID-00890 | 0.04 | 0.02 | 0.01 | 0.00 | 0.02 | 0.01 | 0.04 | 0.04 | -35.96 | 0.10 | -0.02 | 5.48 | 0.27 | 0.35 | 0.20 | 0.25 |
| SEQID-00891 | 0.07 | 0.07 | 0.00 | 0.00 | 0.01 | 0.01 | 0.01 | 0.03 | -33.58 | 0.07 | -0.04 | 5.39 | 0.28 | 0.33 | 0.25 | 0.25 |
| SEQID-00892 | 0.04 | 0.05 | 0.03 | 0.00 | 0.05 | 0.00 | 0.03 | 0.03 | -29.13 | 0.16 | 0.07 | 10.36 | 0.29 | 0.28 | 0.00 | 0.26 |
| SEQID-00893 | 0.01 | 0.08 | 0.03 | 0.00 | 0.01 | 0.04 | 0.04 | 0.02 | -34.20 | 0.12 | 0.07 | 9.83 | 0.30 | 0.26 | 0.28 | 0.28 |
| SEQID-00894 | 0.03 | 0.04 | 0.01 | 0.04 | 0.04 | 0.01 | 0.03 | 0.04 | -28.24 | 0.23 | -0.02 | 5.45 | 0.18 | 0.56 | 0.18 | 0.18 |
| SEQID-00895 | 0.03 | 0.04 | 0.03 | 0.04 | 0.05 | 0.01 | 0.03 | 0.04 | -28.12 | 0.24 | -0.02 | 5.53 | 0.18 | 0.56 | 0.18 | 0.17 |
| SEQID-00896 | 0.02 | 0.05 | 0.04 | 0.05 | 0.07 | 0.02 | 0.04 | 0.08 | -21.96 | 0.34 | -0.02 | 5.52 | 0.00 | 0.34 | 0.00 | 0.00 |
| SEQID-00897 | 0.03 | 0.04 | 0.01 | 0.04 | 0.04 | 0.01 | 0.02 | 0.04 | -28.40 | 0.22 | -0.02 | 5.45 | 0.19 | 0.53 | 0.18 | 0.18 |
| SEQID-00898 | 0.05 | 0.04 | 0.04 | 0.05 | 0.06 | 0.02 | 0.01 | 0.05 | -19.69 | 0.41 | -0.03 | 5.05 | 0.19 | 0.30 | 0.00 | 0.20 |
| SEQID-00899 | 0.04 | 0.05 | 0.04 | 0.05 | 0.04 | 0.02 | 0.04 | 0.04 | -19.52 | 0.43 | -0.03 | 5.16 | 0.21 | 0.31 | 0.00 | 0.22 |
| SEQID-00900 | 0.03 | 0.04 | 0.01 | 0.04 | 0.04 | 0.01 | 0.03 | 0.04 | -27.76 | 0.23 | -0.02 | 5.43 | 0.19 | 0.54 | 0.18 | 0.18 |
| SEQID-00901 | 0.03 | 0.06 | 0.04 | 0.06 | 0.04 | 0.02 | 0.03 | 0.06 | -23.59 | 0.31 | 0.00 | 7.14 | 0.42 | 0.64 | 0.00 | 0.19 |
| SEQID-00902 | 0.03 | 0.06 | 0.03 | 0.06 | 0.04 | 0.02 | 0.06 | 0.06 | -22.21 | 0.34 | 0.00 | 7.11 | 0.19 | 0.33 | 0.00 | 0.20 |
| SEQID-00903 | 0.03 | 0.04 | 0.03 | 0.04 | 0.04 | 0.02 | 0.04 | 0.03 | -24.33 | 0.29 | -0.03 | 5.13 | 0.20 | 0.30 | 0.00 | 0.20 |
| SEQID-00904 | 0.03 | 0.04 | 0.03 | 0.04 | 0.04 | 0.03 | 0.03 | 0.04 | -23.52 | 0.31 | -0.03 | 5.12 | 0.21 | 0.35 | 0.00 | 0.20 |

TABLE 1-continued

| | | | | | | | | | | | | | | |
|---|---|---|---|---|---|---|---|---|---|---|---|---|---|---|
| SEQID-00905 | 0.02 | 0.00 | 0.00 | 0.04 | 0.02 | 0.00 | 0.03 | 0.03 | −36.76 | 0.12 | −0.09 | 4.39 | 0.58 | 0.69 | 0.22 | 0.22 |
| SEQID-00906 | 0.03 | 0.05 | 0.04 | 0.04 | 0.03 | 0.01 | 0.04 | 0.07 | −20.67 | 0.42 | 0.01 | 7.85 | 0.85 | 0.99 | 0.20 | 0.22 |
| SEQID-00907 | 0.02 | 0.04 | 0.06 | 0.04 | 0.06 | 0.03 | 0.05 | 0.07 | −23.89 | 0.29 | −0.01 | 5.48 | 0.19 | 0.35 | 0.19 | 0.20 |
| SEQID-00908 | 0.03 | 0.00 | 0.00 | 0.03 | 0.02 | 0.00 | 0.03 | 0.03 | −37.05 | 0.12 | −0.10 | 4.35 | 0.56 | 0.68 | 0.21 | 0.19 |
| SEQID-00909 | 0.04 | 0.06 | 0.03 | 0.04 | 0.06 | 0.02 | 0.04 | 0.09 | −17.81 | 0.47 | 0.02 | 8.58 | 0.69 | 0.85 | 0.00 | 0.22 |
| SEQID-00910 | 0.03 | 0.03 | 0.00 | 0.05 | 0.05 | 0.03 | 0.05 | 0.09 | −18.50 | 0.56 | 0.01 | 8.14 | 0.23 | 0.32 | 0.00 | 0.21 |
| SEQID-00911 | 0.02 | 0.05 | 0.04 | 0.06 | 0.05 | 0.03 | 0.05 | 0.08 | −22.55 | 0.33 | −0.01 | 6.39 | 0.18 | 0.34 | 0.19 | 0.20 |
| SEQID-00912 | 0.04 | 0.06 | 0.06 | 0.03 | 0.03 | 0.00 | 0.02 | 0.05 | −22.92 | 0.34 | −0.04 | 4.67 | 0.32 | 0.46 | 0.00 | 0.24 |
| SEQID-00913 | 0.01 | 0.06 | 0.04 | 0.04 | 0.05 | 0.01 | 0.05 | 0.05 | −25.08 | 0.34 | −0.02 | 6.09 | 1.00 | 1.00 | 0.20 | 0.21 |
| SEQID-00914 | 0.04 | 0.05 | 0.04 | 0.04 | 0.03 | 0.03 | 0.05 | 0.03 | −19.09 | 0.62 | −0.02 | 4.93 | 0.18 | 0.35 | 0.19 | 0.20 |
| SEQID-00915 | 0.04 | 0.04 | 0.04 | 0.05 | 0.05 | 0.01 | 0.03 | 0.08 | −20.80 | 0.45 | 0.01 | 7.95 | 0.21 | 0.31 | 0.00 | 0.21 |
| SEQID-00916 | 0.02 | 0.07 | 0.04 | 0.05 | 0.05 | 0.01 | 0.05 | 0.06 | −18.96 | 0.48 | 0.00 | 6.80 | 0.21 | 0.31 | 0.00 | 0.22 |
| SEQID-00917 | 0.01 | 0.07 | 0.03 | 0.04 | 0.05 | 0.02 | 0.07 | 0.06 | −21.16 | 0.25 | 0.07 | 8.51 | 0.22 | 0.31 | 0.23 | 0.23 |
| SEQID-00918 | 0.01 | 0.05 | 0.07 | 0.06 | 0.04 | 0.05 | 0.06 | 0.04 | −20.38 | 0.30 | 0.01 | 7.96 | 0.20 | 0.34 | 0.00 | 0.22 |
| SEQID-00919 | 0.04 | 0.05 | 0.05 | 0.05 | 0.06 | 0.02 | 0.03 | 0.07 | −19.53 | 0.46 | 0.01 | 8.37 | 0.20 | 0.34 | 0.00 | 0.20 |
| SEQID-00920 | 0.03 | 0.02 | 0.03 | 0.05 | 0.06 | 0.02 | 0.09 | 0.05 | −25.14 | 0.21 | 0.04 | 9.57 | 0.00 | 0.34 | 0.00 | 0.00 |
| SEQID-00921 | 0.03 | 0.07 | 0.04 | 0.05 | 0.06 | 0.04 | 0.03 | 0.05 | −18.81 | 0.42 | 0.01 | 7.80 | 0.20 | 0.35 | 0.00 | 0.21 |
| SEQID-00922 | 0.04 | 0.01 | 0.03 | 0.07 | 0.03 | 0.02 | 0.02 | 0.05 | −31.38 | 0.24 | −0.08 | 10.51 | 0.25 | 0.34 | 0.00 | 0.20 |
| SEQID-00923 | 0.02 | 0.05 | 0.06 | 0.04 | 0.06 | 0.02 | 0.04 | 0.09 | −23.98 | 0.32 | 0.00 | 6.83 | 0.19 | 0.36 | 0.19 | 0.20 |
| SEQID-00924 | 0.02 | 0.05 | 0.07 | 0.05 | 0.07 | 0.01 | 0.04 | 0.05 | −18.81 | 0.32 | −0.02 | 5.87 | 0.00 | 0.39 | 0.16 | 0.22 |
| SEQID-00925 | 0.04 | 0.01 | 0.00 | 0.02 | 0.03 | 0.01 | 0.02 | 0.04 | −33.82 | 0.22 | −0.05 | 4.71 | 0.49 | 0.68 | 0.23 | 0.00 |
| SEQID-00926 | 0.04 | 0.05 | 0.04 | 0.05 | 0.04 | 0.02 | 0.02 | 0.09 | −20.25 | 0.45 | 0.01 | 3.46 | 0.23 | 0.33 | 0.21 | 0.23 |
| SEQID-00927 | 0.05 | 0.09 | 0.03 | 0.03 | 0.03 | 0.02 | 0.05 | 0.05 | −25.17 | 0.31 | −0.04 | 4.62 | 0.39 | 0.58 | 0.23 | 0.00 |
| SEQID-00928 | 0.06 | 0.02 | 0.06 | 0.04 | 0.05 | 0.01 | 0.03 | 0.05 | −32.56 | 0.15 | 0.04 | 9.50 | 0.25 | 0.34 | 0.23 | 0.21 |
| SEQID-00929 | 0.01 | 0.04 | 0.04 | 0.04 | 0.05 | 0.03 | 0.09 | 0.09 | −19.07 | 0.45 | 0.00 | 6.93 | 0.64 | 0.83 | 0.20 | 0.23 |
| SEQID-00930 | 0.01 | 0.10 | 0.08 | 0.07 | 0.04 | 0.02 | 0.02 | 0.05 | −23.31 | 0.29 | 0.01 | 7.38 | 0.25 | 0.35 | 0.23 | 0.23 |
| SEQID-00931 | 0.02 | 0.01 | 0.03 | 0.02 | 0.04 | 0.02 | 0.02 | 0.03 | −33.39 | 0.06 | −0.01 | 6.23 | 0.23 | 0.36 | 0.23 | 0.25 |
| SEQID-00932 | 0.02 | 0.05 | 0.06 | 0.04 | 0.06 | 0.02 | 0.04 | 0.06 | −22.04 | 0.35 | −0.01 | 8.31 | 0.38 | 0.56 | 0.21 | 0.21 |
| SEQID-00933 | 0.02 | 0.04 | 0.02 | 0.02 | 0.05 | 0.00 | 0.04 | 0.05 | −25.40 | 0.19 | −0.03 | 4.94 | 0.30 | 0.45 | 0.20 | 0.22 |
| SEQID-00934 | 0.04 | 0.06 | 0.04 | 0.05 | 0.06 | 0.03 | 0.03 | 0.08 | −18.24 | 0.65 | −0.02 | 4.99 | 0.19 | 0.35 | 0.19 | 0.19 |
| SEQID-00935 | 0.03 | 0.04 | 0.05 | 0.04 | 0.04 | 0.00 | 0.04 | 0.08 | −17.76 | 0.53 | −0.03 | 4.92 | 0.22 | 0.36 | 0.23 | 0.22 |
| SEQID-00936 | 0.04 | 0.05 | 0.04 | 0.03 | 0.05 | 0.05 | 0.03 | 0.04 | −23.52 | 0.27 | −0.03 | 9.32 | 0.22 | 0.28 | 0.21 | 0.00 |
| SEQID-00937 | 0.02 | 0.05 | 0.05 | 0.02 | 0.04 | 0.03 | 0.06 | 0.06 | −19.26 | 0.33 | 0.00 | 6.76 | 0.18 | 0.35 | 0.18 | 0.19 |
| SEQID-00938 | 0.03 | 0.06 | 0.04 | 0.06 | 0.06 | 0.03 | 0.05 | 0.06 | −20.58 | 0.35 | 0.02 | 8.95 | 0.21 | 0.31 | 0.00 | 0.21 |
| SEQID-00939 | 0.04 | 0.04 | 0.03 | 0.04 | 0.04 | 0.03 | 0.05 | 0.07 | −19.40 | 0.45 | 0.02 | 9.64 | 0.21 | 0.33 | 0.00 | 0.22 |
| SEQID-00940 | 0.01 | 0.06 | 0.06 | 0.06 | 0.05 | 0.00 | 0.03 | 0.08 | −18.74 | 0.44 | 0.00 | 6.43 | 0.00 | 0.55 | 0.17 | 0.56 |
| SEQID-00941 | 0.05 | 0.07 | 0.03 | 0.02 | 0.07 | 0.01 | 0.02 | 0.06 | −24.70 | 0.26 | −0.04 | 4.72 | 0.30 | 0.48 | 0.19 | 0.23 |
| SEQID-00942 | 0.03 | 0.05 | 0.04 | 0.04 | 0.02 | 0.00 | 0.03 | 0.04 | −23.23 | 0.35 | −0.02 | 5.20 | 0.28 | 0.42 | 0.00 | 0.24 |
| SEQID-00943 | 0.02 | 0.09 | 0.02 | 0.07 | 0.05 | 0.03 | 0.02 | 0.08 | −21.97 | 0.31 | −0.01 | 6.50 | 0.18 | 0.34 | 0.19 | 0.19 |
| SEQID-00944 | 0.05 | 0.11 | 0.05 | 0.01 | 0.05 | 0.00 | 0.05 | 0.07 | −25.95 | 0.30 | −0.05 | 4.56 | 0.40 | 0.58 | 0.00 | 0.00 |
| SEQID-00945 | 0.04 | 0.03 | 0.08 | 0.04 | 0.07 | 0.00 | 0.05 | 0.08 | −24.69 | 0.33 | 0.01 | 8.63 | 0.00 | 0.33 | 0.00 | 0.23 |
| SEQID-00946 | 0.01 | 0.05 | 0.03 | 0.07 | 0.05 | 0.05 | 0.04 | 0.05 | −19.88 | 0.23 | −0.01 | 6.36 | 0.21 | 0.32 | 0.22 | 0.25 |
| SEQID-00947 | 0.03 | 0.06 | 0.03 | 0.03 | 0.05 | 0.01 | 0.02 | 0.09 | −17.51 | 0.57 | 0.00 | 6.89 | 0.20 | 0.31 | 0.00 | 0.20 |
| SEQID-00948 | 0.03 | 0.05 | 0.06 | 0.05 | 0.07 | 0.00 | 0.07 | 0.08 | −16.36 | 0.55 | 0.02 | 8.73 | 0.51 | 0.69 | 0.22 | 0.21 |
| SEQID-00949 | 0.02 | 0.05 | 0.03 | 0.04 | 0.06 | 0.01 | 0.03 | 0.06 | −22.43 | 0.35 | −0.01 | 5.66 | 0.71 | 0.90 | 0.00 | 0.56 |
| SEQID-00950 | 0.02 | 0.09 | 0.02 | 0.03 | 0.04 | 0.02 | 0.03 | 0.11 | −19.79 | 0.53 | 0.01 | 7.77 | 0.28 | 0.30 | 0.24 | 0.23 |
| SEQID-00951 | 0.03 | 0.05 | 0.09 | 0.05 | 0.02 | 0.03 | 0.02 | 0.06 | −18.10 | 0.43 | 0.03 | 9.45 | 0.22 | 0.31 | 0.00 | 0.24 |
| SEQID-00952 | 0.02 | 0.06 | 0.04 | 0.05 | 0.03 | 0.05 | 0.05 | 0.07 | −22.51 | 0.46 | −0.03 | 4.87 | 0.20 | 0.33 | 0.19 | 0.19 |
| SEQID-00953 | 0.01 | 0.04 | 0.04 | 0.01 | 0.04 | 0.01 | 0.03 | 0.04 | −23.78 | 0.26 | −0.09 | 4.20 | 0.22 | 0.42 | 0.20 | 0.20 |
| SEQID-00954 | 0.02 | 0.03 | 0.07 | 0.04 | 0.04 | 0.01 | 0.03 | 0.05 | −25.81 | 0.25 | −0.01 | 5.77 | 0.00 | 0.41 | 0.00 | 0.23 |
| SEQID-00955 | 0.02 | 0.07 | 0.04 | 0.07 | 0.05 | 0.03 | 0.05 | 0.08 | −17.08 | 0.44 | 0.02 | 8.94 | 0.25 | 0.34 | 0.26 | 0.18 |
| SEQID-00956 | 0.04 | 0.05 | 0.06 | 0.09 | 0.04 | 0.01 | 0.05 | 0.03 | −17.66 | 0.20 | 0.02 | 9.66 | 0.24 | 0.41 | 0.26 | 0.27 |
| SEQID-00957 | 0.04 | 0.02 | 0.03 | 0.06 | 0.04 | 0.03 | 0.03 | 0.10 | −18.85 | 0.58 | −0.01 | 6.40 | 0.24 | 0.32 | 0.00 | 0.25 |

TABLE 1-continued

| | | | | | | | | | | | | | | | |
|---|---|---|---|---|---|---|---|---|---|---|---|---|---|---|---|
| SEQID-00958 | 0.02 | 0.07 | 0.05 | 0.05 | 0.05 | 0.05 | 0.04 | 0.06 | -18.60 | 0.41 | 0.00 | 7.56 | 0.23 | 0.34 | 0.19 | 0.20 |
| SEQID-00959 | 0.03 | 0.05 | 0.04 | 0.04 | 0.07 | 0.31 | 0.03 | 0.06 | -22.45 | 0.34 | -0.02 | 5.16 | 0.73 | 0.93 | 0.00 | 0.22 |
| SEQID-00960 | 0.01 | 0.04 | 0.12 | 0.06 | 0.02 | 0.01 | 0.01 | 0.08 | -16.72 | 0.46 | 0.01 | 6.39 | 0.25 | 0.32 | 0.25 | 0.26 |
| SEQID-00961 | 0.03 | 0.03 | 0.03 | 0.02 | 0.01 | 0.01 | 0.01 | 0.03 | -37.46 | 0.14 | 0.01 | 6.56 | 0.21 | 0.35 | 0.22 | 0.21 |
| SEQID-00962 | 0.02 | 0.05 | 0.06 | 0.09 | 0.04 | 0.01 | 0.04 | 0.06 | -19.01 | 0.20 | 0.02 | 9.32 | 0.20 | 0.30 | 0.19 | 0.24 |
| SEQID-00963 | 0.05 | 0.08 | 0.05 | 0.05 | 0.07 | 0.04 | 0.08 | 0.04 | -20.90 | 0.32 | 0.01 | 7.78 | 0.20 | 0.30 | 0.20 | 0.21 |
| SEQID-00964 | 0.02 | 0.05 | 0.11 | 0.09 | 0.02 | 0.06 | 0.06 | 0.03 | -15.95 | 0.27 | 0.00 | 7.95 | 0.20 | 0.45 | 0.20 | 0.21 |
| SEQID-00965 | 0.04 | 0.08 | 0.05 | 0.03 | 0.06 | 0.01 | 0.07 | 0.04 | -23.11 | 0.36 | 0.07 | 7.49 | 0.52 | 0.68 | 0.21 | 0.23 |
| SEQID-00966 | 0.03 | 0.09 | 0.02 | 0.04 | 0.02 | 0.03 | 0.06 | 0.07 | -16.84 | 0.56 | 0.00 | 10.36 | 0.21 | 0.34 | 0.00 | 0.00 |
| SEQID-00967 | 0.03 | 0.04 | 0.03 | 0.05 | 0.04 | 0.03 | 0.03 | 0.08 | -20.61 | 0.55 | 0.00 | 6.53 | 0.25 | 0.34 | 0.17 | 0.00 |
| SEQID-00968 | 0.03 | 0.02 | 0.01 | 0.06 | 0.04 | 0.02 | 0.01 | 0.05 | -25.41 | 0.27 | -0.06 | 4.52 | 0.25 | 0.34 | 0.00 | 0.00 |
| SEQID-00969 | 0.01 | 0.07 | 0.02 | 0.05 | 0.10 | 0.01 | 0.02 | 0.04 | -18.46 | 0.31 | 0.01 | 8.89 | 0.21 | 0.31 | 0.00 | 0.00 |
| SEQID-00970 | 0.03 | 0.06 | 0.04 | 0.04 | 0.05 | 0.01 | 0.06 | 0.06 | -20.02 | 0.37 | -0.05 | 4.69 | 0.94 | 1.00 | 0.20 | 0.22 |
| SEQID-00971 | 0.02 | 0.05 | 0.08 | 0.04 | 0.05 | 0.01 | 0.04 | 0.04 | -20.64 | 0.33 | -0.02 | 5.02 | 0.27 | 0.56 | 0.21 | 0.33 |
| SEQID-00972 | 0.03 | 0.04 | 0.04 | 0.03 | 0.07 | 0.00 | 0.03 | 0.04 | -24.05 | 0.30 | 0.15 | 11.71 | 0.24 | 0.30 | 0.22 | 0.00 |
| SEQID-00973 | 0.03 | 0.02 | 0.04 | 0.05 | 0.04 | 0.00 | 0.01 | 0.10 | -21.20 | 0.60 | 0.00 | 7.44 | 0.20 | 0.33 | 0.00 | 0.23 |
| SEQID-00974 | 0.03 | 0.06 | 0.07 | 0.03 | 0.06 | 0.02 | 0.02 | 0.05 | -22.31 | 0.45 | -0.01 | 6.30 | 0.50 | 0.56 | 0.00 | 0.00 |
| SEQID-00975 | 0.04 | 0.03 | 0.02 | 0.04 | 0.03 | 0.01 | 0.07 | 0.04 | -26.62 | 0.33 | -0.07 | 4.36 | 0.24 | 0.32 | 0.00 | 0.00 |
| SEQID-00976 | 0.01 | 0.04 | 0.05 | 0.05 | 0.05 | 0.03 | 0.04 | 0.06 | -20.20 | 0.42 | 0.05 | 9.78 | 0.20 | 0.34 | 0.00 | 0.21 |
| SEQID-00977 | 0.02 | 0.04 | 0.03 | 0.06 | 0.05 | 0.05 | 0.04 | 0.05 | -18.41 | 0.38 | -0.01 | 5.34 | 0.21 | 0.31 | 0.18 | 0.22 |
| SEQID-00978 | 0.01 | 0.05 | 0.07 | 0.04 | 0.03 | 0.03 | 0.02 | 0.06 | -20.46 | 0.43 | 0.00 | 7.02 | 0.19 | 0.33 | 0.21 | 0.24 |
| SEQID-00979 | 0.02 | 0.03 | 0.01 | 0.02 | 0.06 | 0.00 | 0.06 | 0.08 | -23.82 | 0.30 | 0.18 | 11.91 | 0.39 | 0.28 | 0.00 | 0.28 |
| SEQID-00980 | 0.09 | 0.09 | 0.01 | 0.03 | 0.06 | 0.00 | 0.01 | 0.04 | -29.38 | 0.32 | -0.16 | 3.85 | 0.39 | 0.45 | 0.00 | 0.25 |
| SEQID-00981 | 0.02 | 0.01 | 0.03 | 0.04 | 0.05 | 0.02 | 0.01 | 0.06 | -21.47 | 0.40 | 0.14 | 11.55 | 0.24 | 0.33 | 0.23 | 0.24 |
| SEQID-00982 | 0.03 | 0.02 | 0.04 | 0.09 | 0.06 | 0.02 | 0.00 | 0.06 | -23.96 | 0.22 | 0.15 | 11.00 | 0.25 | 0.30 | 0.00 | 0.22 |
| SEQID-00983 | 0.02 | 0.10 | 0.05 | 0.05 | 0.04 | 0.00 | 0.04 | 0.05 | -20.43 | 0.40 | 0.02 | 8.61 | 0.28 | 0.36 | 0.22 | 0.24 |
| SEQID-00984 | 0.05 | 0.03 | 0.04 | 0.08 | 0.06 | 0.00 | 0.03 | 0.09 | -18.31 | 0.47 | 0.07 | 10.55 | 0.00 | 0.31 | 0.23 | 0.24 |
| SEQID-00985 | 0.03 | 0.04 | 0.05 | 0.04 | 0.06 | 0.00 | 0.03 | 0.05 | -17.45 | 0.42 | 0.00 | 7.44 | 0.30 | 0.39 | 0.00 | 0.23 |
| SEQID-00986 | 0.03 | 0.07 | 0.04 | 0.03 | 0.03 | 0.02 | 0.03 | 0.04 | -23.98 | 0.30 | -0.06 | 4.53 | 0.22 | 0.32 | 0.00 | 0.22 |
| SEQID-00987 | 0.03 | 0.03 | 0.06 | 0.07 | 0.04 | 0.01 | 0.02 | 0.05 | -21.44 | 0.23 | 0.06 | 10.42 | 0.23 | 0.32 | 0.00 | 0.24 |
| SEQID-00988 | 0.03 | 0.04 | 0.06 | 0.09 | 0.04 | 0.01 | 0.04 | 0.10 | -18.81 | 0.50 | 0.03 | 9.15 | 0.21 | 0.31 | 0.00 | 0.00 |
| SEQID-00989 | 0.01 | 0.08 | 0.05 | 0.05 | 0.07 | 0.02 | 0.06 | 0.03 | -18.71 | 0.25 | -0.02 | 5.97 | 0.22 | 0.31 | 0.23 | 0.24 |
| SEQID-00990 | 0.02 | 0.05 | 0.08 | 0.06 | 0.04 | 0.01 | 0.05 | 0.06 | -18.94 | 0.32 | 0.01 | 8.02 | 0.21 | 0.35 | 0.00 | 0.21 |
| SEQID-00991 | 0.03 | 0.03 | 0.02 | 0.06 | 0.05 | 0.00 | 0.08 | 0.05 | -25.41 | 0.34 | 0.00 | 7.39 | 0.21 | 0.32 | 0.00 | 0.00 |
| SEQID-00992 | 0.02 | 0.05 | 0.04 | 0.07 | 0.04 | 0.00 | 0.05 | 0.07 | -15.67 | 0.41 | 0.02 | 9.07 | 0.21 | 0.34 | 0.20 | 0.23 |
| SEQID-00993 | 0.03 | 0.05 | 0.08 | 0.05 | 0.06 | 0.00 | 0.02 | 0.09 | -18.97 | 0.44 | 0.02 | 9.36 | 0.20 | 0.36 | 0.21 | 0.21 |
| SEQID-00994 | 0.03 | 0.04 | 0.05 | 0.04 | 0.05 | 0.02 | 0.04 | 0.08 | -20.80 | 0.41 | 0.03 | 9.50 | 0.22 | 0.34 | 0.00 | 0.22 |
| SEQID-00995 | 0.04 | 0.04 | 0.04 | 0.06 | 0.05 | 0.03 | 0.04 | 0.06 | -17.23 | 0.44 | 0.01 | 8.29 | 0.21 | 0.33 | 0.22 | 0.22 |
| SEQID-00996 | 0.03 | 0.04 | 0.10 | 0.05 | 0.07 | 0.02 | 0.02 | 0.07 | -17.11 | 0.45 | -0.02 | 8.25 | 0.21 | 0.36 | 0.22 | 0.22 |
| SEQID-00997 | 0.04 | 0.05 | 0.02 | 0.05 | 0.04 | 0.07 | 0.05 | 0.03 | -25.20 | 0.37 | -0.02 | 5.65 | 0.19 | 0.34 | 0.00 | 0.24 |
| SEQID-00998 | 0.02 | 0.04 | 0.05 | 0.04 | 0.05 | 0.00 | 0.00 | 0.03 | -19.46 | 0.39 | 0.01 | 7.90 | 0.20 | 0.32 | 0.00 | 0.20 |
| SEQID-00999 | 0.03 | 0.04 | 0.04 | 0.04 | 0.05 | 0.01 | 0.05 | 0.04 | -28.98 | 0.30 | -0.05 | 4.64 | 0.65 | 0.86 | 0.20 | 0.20 |
| SEQID-01000 | 0.02 | 0.05 | 0.05 | 0.05 | 0.05 | 0.03 | 0.04 | 0.06 | -23.33 | 0.29 | -0.01 | 5.62 | 0.19 | 0.33 | 0.00 | 0.20 |
| SEQID-01001 | 0.02 | 0.05 | 0.03 | 0.05 | 0.05 | 0.02 | 0.04 | 0.07 | -21.41 | 0.40 | 0.00 | 7.13 | 1.00 | 1.00 | 0.00 | 0.21 |
| SEQID-01002 | 0.02 | 0.05 | 0.05 | 0.05 | 0.06 | 0.03 | 0.04 | 0.07 | -21.00 | 0.42 | 0.00 | 7.04 | 0.93 | 1.00 | 0.00 | 0.21 |
| SEQID-01003 | 0.06 | 0.05 | 0.03 | 0.07 | 0.07 | 0.02 | 0.04 | 0.06 | -18.58 | 0.39 | -0.02 | 5.31 | 0.16 | 0.35 | 0.18 | 0.19 |
| SEQID-01004 | 0.02 | 0.08 | 0.05 | 0.05 | 0.06 | 0.02 | 0.05 | 0.05 | -19.09 | 0.45 | -0.03 | 4.97 | 0.57 | 0.74 | 0.00 | 0.45 |
| SEQID-01005 | 0.02 | 0.04 | 0.04 | 0.06 | 0.07 | 0.07 | 0.03 | 0.03 | -15.97 | 0.54 | 0.06 | 9.25 | 1.00 | 1.00 | 0.00 | 0.25 |
| SEQID-01006 | 0.02 | 0.02 | 0.03 | 0.05 | 0.04 | 0.00 | 0.00 | 0.04 | -20.07 | 0.51 | -0.05 | 4.51 | 1.00 | 1.00 | 0.24 | 1.00 |
| SEQID-01007 | 0.01 | 0.07 | 0.04 | 0.05 | 0.06 | 0.07 | 0.00 | 0.03 | -20.24 | 0.39 | -0.0 | 6.57 | 0.22 | 0.59 | 0.21 | 1.00 |
| SEQID-01008 | 0.03 | 0.06 | 0.04 | 0.06 | 0.03 | 0.02 | 0.06 | 0.06 | -17.92 | 0.49 | -0.0 | 5.89 | 0.18 | 0.34 | 0.18 | 0.99 |
| SEQID-01009 | 0.03 | 0.07 | 0.05 | 0.07 | 0.03 | 0.02 | 0.06 | 0.08 | -15.59 | 0.51 | 0.01 | 7.60 | 0.19 | 0.32 | 0.00 | 0.48 |
| SEQID-01010 | 0.06 | 0.07 | 0.04 | 0.06 | 0.07 | 0.02 | 0.03 | 0.05 | -19.62 | 0.48 | -0.0 | 4.66 | 0.64 | 0.78 | 0.21 | 0.46 |

TABLE 1-continued

| | | | | | | | | | | | | | | | |
|---|---|---|---|---|---|---|---|---|---|---|---|---|---|---|---|
| SEQID-01011 | 0.05 | 0.05 | 0.03 | 0.07 | 0.06 | 0.02 | 0.04 | 0.05 | -19.80 | 0.44 | 0.01 | 8.46 | 0.59 | 0.71 | 0.00 | 0.44 |
| SEQID-01012 | 0.03 | 0.07 | 0.04 | 0.05 | 0.05 | 0.03 | 0.01 | 0.05 | -23.91 | 0.24 | -0.03 | 5.29 | 0.22 | 0.33 | 0.00 | 0.21 |
| SEQID-01013 | 0.02 | 0.03 | 0.08 | 0.06 | 0.05 | 0.03 | 0.02 | 0.10 | -14.17 | 0.62 | -0.01 | 6.50 | 0.22 | 0.33 | 0.00 | 0.23 |
| SEQID-01014 | 0.01 | 0.07 | 0.02 | 0.06 | 0.06 | 0.00 | 0.00 | 0.06 | -22.97 | 0.30 | -0.06 | 5.19 | 0.27 | 0.30 | 0.25 | 0.25 |
| SEQID-01015 | 0.04 | 0.04 | 0.07 | 0.07 | 0.06 | 0.01 | 0.02 | 0.09 | -14.50 | 0.66 | -0.02 | 5.76 | 0.22 | 0.33 | 0.00 | 0.24 |
| SEQID-01016 | 0.03 | 0.08 | 0.07 | 0.06 | 0.06 | 0.02 | 0.06 | 0.07 | -16.56 | 0.51 | 0.01 | 8.22 | 0.20 | 0.33 | 0.00 | 0.41 |
| SEQID-01017 | 0.03 | 0.04 | 0.04 | 0.06 | 0.07 | 0.02 | 0.06 | 0.05 | -17.85 | 0.37 | -0.01 | 6.00 | 0.19 | 0.34 | 0.19 | 0.20 |
| SEQID-01018 | 0.02 | 0.06 | 0.02 | 0.07 | 0.13 | 0.02 | 0.08 | 0.05 | -16.16 | 0.52 | 0.04 | 10.35 | 0.23 | 0.32 | 0.00 | 0.24 |
| SEQID-01019 | 0.04 | 0.04 | 0.03 | 0.06 | 0.04 | 0.04 | 0.01 | 0.05 | -21.68 | 0.27 | -0.04 | 4.91 | 0.21 | 0.31 | 0.22 | 0.21 |
| SEQID-01020 | 0.05 | 0.05 | 0.04 | 0.10 | 0.07 | 0.04 | 0.05 | 0.02 | -23.98 | 0.52 | -0.01 | 5.41 | 0.28 | 0.31 | 0.00 | 0.28 |
| SEQID-01021 | 0.03 | 0.05 | 0.03 | 0.06 | 0.05 | 0.02 | 0.06 | 0.07 | -16.96 | 0.39 | -0.01 | 6.29 | 0.38 | 0.59 | 0.00 | 0.20 |
| SEQID-01022 | 0.04 | 0.06 | 0.04 | 0.07 | 0.06 | 0.08 | 0.11 | 0.06 | -10.42 | 0.83 | 0.11 | 9.33 | 0.31 | 0.25 | 0.36 | 0.29 |
| SEQID-01023 | 0.02 | 0.07 | 0.06 | 0.02 | 0.02 | 0.02 | 0.07 | 0.08 | -17.26 | 0.50 | 0.02 | 8.56 | 0.21 | 0.31 | 0.00 | 0.24 |
| SEQID-01024 | 0.03 | 0.03 | 0.03 | 0.07 | 0.03 | 0.01 | 0.05 | 0.08 | -18.61 | 0.64 | 0.00 | 7.82 | 0.24 | 0.30 | 0.24 | 1.00 |
| SEQID-01025 | 0.01 | 0.09 | 0.03 | 0.06 | 0.06 | 0.06 | 0.03 | 0.06 | -17.18 | 0.51 | 0.03 | 8.58 | 0.26 | 0.30 | 0.00 | 0.23 |
| SEQID-01026 | 0.02 | 0.05 | 0.10 | 0.06 | 0.08 | 0.01 | 0.07 | 0.06 | -14.96 | 0.42 | 0.00 | 6.78 | 0.98 | 1.00 | 0.00 | 0.24 |
| SEQID-01027 | 0.03 | 0.05 | 0.04 | 0.06 | 0.06 | 0.01 | 0.08 | 0.06 | -22.58 | 0.29 | 0.02 | 8.69 | 1.00 | 1.00 | 0.18 | 0.00 |
| SEQID-01028 | 0.03 | 0.03 | 0.04 | 0.03 | 0.05 | 0.02 | 0.03 | 0.05 | -20.98 | 0.57 | -0.04 | 4.66 | 0.99 | 1.00 | 0.00 | 0.24 |
| SEQID-01029 | 0.01 | 0.05 | 0.04 | 0.05 | 0.05 | 0.03 | 0.04 | 0.06 | -19.81 | 0.44 | 0.02 | 8.38 | 1.00 | 1.00 | 0.00 | 0.21 |
| SEQID-01030 | 0.03 | 0.07 | 0.05 | 0.05 | 0.06 | 0.01 | 0.04 | 0.06 | -18.85 | 0.43 | 0.01 | 7.72 | 0.19 | 0.33 | 0.19 | 0.20 |
| SEQID-01031 | 0.02 | 0.04 | 0.04 | 0.05 | 0.06 | 0.02 | 0.05 | 0.08 | -21.17 | 0.42 | 0.00 | 6.82 | 0.18 | 0.32 | 0.35 | 0.24 |
| SEQID-01032 | 0.02 | 0.07 | 0.04 | 0.05 | 0.06 | 0.04 | 0.05 | 0.04 | -15.64 | 0.38 | 0.00 | 7.17 | 0.21 | 0.31 | 0.20 | 0.21 |
| SEQID-01033 | 0.03 | 0.06 | 0.06 | 0.06 | 0.03 | 0.04 | 0.03 | 0.07 | -21.14 | 0.51 | -0.03 | 4.35 | 0.20 | 0.35 | 0.00 | 0.22 |
| SEQID-01034 | 0.01 | 0.05 | 0.05 | 0.16 | 0.10 | 0.04 | 0.04 | 0.09 | -19.28 | 0.39 | 0.00 | 7.29 | 0.20 | 0.37 | 0.00 | 0.21 |
| SEQID-01035 | 0.02 | 0.06 | 0.05 | 0.11 | 0.07 | 0.03 | 0.05 | 0.05 | -19.30 | 0.37 | 0.02 | 8.68 | 0.20 | 0.33 | 0.00 | 0.21 |
| SEQID-01036 | 0.02 | 0.03 | 0.04 | 0.05 | 0.06 | 0.04 | 0.01 | 0.03 | -22.27 | 0.41 | -0.01 | 6.68 | 0.20 | 0.33 | 0.23 | 0.22 |
| SEQID-01037 | 0.03 | 0.02 | 0.03 | 0.09 | 0.07 | 0.01 | 0.04 | 0.07 | -19.70 | 0.36 | 0.00 | 6.13 | 0.20 | 0.38 | 0.00 | 0.22 |
| SEQID-01038 | 0.02 | 0.06 | 0.04 | 0.06 | 0.05 | 0.03 | 0.06 | 0.06 | -19.11 | 0.39 | -0.01 | 8.68 | 0.21 | 0.45 | 0.00 | 0.22 |
| SEQID-01039 | 0.02 | 0.05 | 0.04 | 0.04 | 0.06 | 0.02 | 0.05 | 0.05 | -17.74 | 0.44 | 0.02 | 4.44 | 0.32 | 0.32 | 0.20 | 0.22 |
| SEQID-01040 | 0.02 | 0.05 | 0.04 | 0.05 | 0.05 | 0.02 | 0.05 | 0.05 | -21.57 | 0.37 | -0.05 | 7.08 | 0.59 | 0.71 | 0.21 | 0.21 |
| SEQID-01041 | 0.01 | 0.03 | 0.05 | 0.16 | 0.10 | 0.04 | 0.06 | 0.07 | -12.63 | 0.44 | 0.00 | 7.74 | 0.18 | 0.31 | 0.22 | 0.23 |
| SEQID-01042 | 0.01 | 0.07 | 0.06 | 0.11 | 0.07 | 0.04 | 0.03 | 0.10 | -16.09 | 0.53 | -0.03 | 4.64 | 0.22 | 0.34 | 0.00 | 0.21 |
| SEQID-01043 | 0.01 | 0.06 | 0.07 | 0.06 | 0.07 | 0.03 | 0.04 | 0.09 | -16.92 | 0.42 | -0.02 | 5.16 | 0.25 | 0.35 | 0.19 | 0.23 |
| SEQID-01044 | 0.02 | 0.05 | 0.06 | 0.06 | 0.04 | 0.04 | 0.08 | 0.05 | -20.43 | 0.34 | -0.04 | 4.39 | 0.21 | 0.33 | 0.20 | 0.21 |
| SEQID-01045 | 0.02 | 0.08 | 0.05 | 0.05 | 0.05 | 0.04 | 0.06 | 0.07 | -17.05 | 0.58 | -0.01 | 8.22 | 0.22 | 0.33 | 0.00 | 0.21 |
| SEQID-01046 | 0.03 | 0.04 | 0.04 | 0.03 | 0.03 | 0.01 | 0.02 | 0.04 | -28.00 | 0.22 | -0.05 | 4.87 | 0.23 | 0.35 | 0.00 | 0.23 |
| SEQID-01047 | 0.02 | 0.06 | 0.06 | 0.06 | 0.02 | 0.01 | 0.04 | 0.04 | -20.51 | 0.34 | 0.05 | 9.68 | 0.21 | 0.36 | 0.21 | 0.22 |
| SEQID-01048 | 0.01 | 0.02 | 0.06 | 0.11 | 0.10 | 0.03 | 0.06 | 0.06 | -15.19 | 0.47 | -0.01 | 5.69 | 0.20 | 0.32 | 0.00 | 0.22 |
| SEQID-01049 | 0.02 | 0.04 | 0.06 | 0.09 | 0.09 | 0.03 | 0.05 | 0.10 | -17.98 | 0.41 | 0.01 | 7.92 | 0.24 | 0.33 | 0.29 | 0.23 |
| SEQID-01050 | 0.02 | 0.05 | 0.02 | 0.06 | 0.06 | 0.04 | 0.08 | 0.04 | -20.06 | 0.27 | -0.02 | 5.45 | 0.43 | 0.53 | 0.00 | 0.21 |
| SEQID-01051 | 0.00 | 0.04 | 0.04 | 0.04 | 0.07 | 0.02 | 0.05 | 0.06 | -11.96 | 0.30 | 0.01 | 8.20 | 0.28 | 0.31 | 0.27 | 0.28 |
| SEQID-01052 | 0.02 | 0.07 | 0.05 | 0.05 | 0.05 | 0.05 | 0.07 | 0.06 | -15.49 | 0.41 | 0.02 | 8.00 | 0.25 | 0.39 | 0.52 | 0.32 |
| SEQID-01053 | 0.03 | 0.08 | 0.03 | 0.07 | 0.06 | 0.01 | 0.05 | 0.06 | -15.78 | 0.68 | 0.02 | 8.87 | 0.19 | 0.31 | 0.20 | 0.20 |
| SEQID-01054 | 0.03 | 0.05 | 0.05 | 0.06 | 0.05 | 0.02 | 0.03 | 0.08 | -16.22 | 0.48 | -0.01 | 6.42 | 0.17 | 0.35 | 0.17 | 0.19 |
| SEQID-01055 | 0.01 | 0.05 | 0.09 | 0.13 | 0.07 | 0.03 | 0.01 | 0.08 | -10.74 | 0.51 | 0.05 | 6.21 | 0.22 | 0.31 | 0.20 | 0.24 |
| SEQID-01056 | 0.02 | 0.07 | 0.04 | 0.07 | 0.07 | 0.03 | 0.02 | 0.08 | -14.33 | 0.87 | -0.01 | 7.51 | 0.20 | 0.33 | 0.00 | 0.20 |
| SEQID-01057 | 0.01 | 0.02 | 0.05 | 0.14 | 0.09 | 0.03 | 0.09 | 0.05 | -12.66 | 0.22 | 0.00 | 8.03 | 0.24 | 0.34 | 0.29 | 0.23 |
| SEQID-01058 | 0.04 | 0.06 | 0.01 | 0.04 | 0.12 | 0.04 | 0.03 | 0.10 | -21.36 | 0.43 | 0.01 | 7.51 | 0.43 | 0.53 | 0.00 | 0.20 |
| SEQID-01059 | 0.02 | 0.06 | 0.03 | 0.05 | 0.05 | 0.04 | 0.02 | 0.04 | -22.85 | 0.50 | 0.00 | 5.69 | 0.28 | 0.32 | 0.20 | 0.22 |
| SEQID-01060 | 0.03 | 0.04 | 0.05 | 0.07 | 0.07 | 0.02 | 0.06 | 0.05 | -21.90 | 0.38 | -0.02 | 9.19 | 0.21 | 0.29 | 0.23 | 0.00 |
| SEQID-01061 | 0.02 | 0.04 | 0.06 | 0.05 | 0.04 | 0.09 | 0.02 | 0.03 | -19.03 | 0.26 | 0.04 | 7.89 | 0.21 | 0.31 | 0.00 | 0.24 |
| SEQID-01062 | 0.01 | 0.07 | 0.03 | 0.05 | 0.06 | 0.09 | 0.04 | 0.06 | -19.76 | 0.52 | 0.02 | 5.84 | 0.27 | 0.39 | 0.20 | 1.00 |
| SEQID-01063 | 0.04 | 0.05 | 0.03 | 0.04 | 0.05 | 0.03 | 0.06 | 0.05 | -21.17 | 0.34 | -0.01 | 6.52 | 0.21 | 0.32 | 0.00 | 0.20 |

TABLE 1-continued

| | | | | | | | | | | | | | | | |
|---|---|---|---|---|---|---|---|---|---|---|---|---|---|---|---|
| SEQID-01064 | 0.02 | 0.03 | 0.06 | 0.05 | 0.05 | 0.04 | 0.07 | 0.08 | -19.14 | 0.35 | 0.03 | 8.38 | 0.22 | 0.43 | 0.21 | 0.26 |
| SEQID-01065 | 0.02 | 0.08 | 0.05 | 0.07 | 0.05 | 0.04 | 0.03 | 0.06 | -17.13 | 0.43 | 0.03 | 9.49 | 0.20 | 0.33 | 0.00 | 0.21 |
| SEQID-01066 | 0.02 | 0.07 | 0.04 | 0.04 | 0.07 | 0.00 | 0.07 | 0.08 | -14.90 | 0.75 | 0.02 | 8.31 | 0.35 | 0.39 | 0.26 | 0.26 |
| SEQID-01067 | 0.01 | 0.05 | 0.06 | 0.07 | 0.01 | 0.03 | 0.07 | 0.05 | -21.01 | 0.41 | 0.02 | 8.22 | 0.28 | 0.30 | 0.25 | 0.26 |
| SEQID-01068 | 0.02 | 0.03 | 0.06 | 0.13 | 0.07 | 0.05 | 0.02 | 0.10 | -12.39 | 0.59 | 0.02 | 8.90 | 0.29 | 0.33 | 0.24 | 0.26 |
| SEQID-01069 | 0.03 | 0.06 | 0.06 | 0.04 | 0.04 | 0.00 | 0.06 | 0.05 | -21.65 | 0.52 | 0.05 | 9.04 | 0.24 | 0.31 | 0.23 | 0.25 |
| SEQID-01070 | 0.03 | 0.02 | 0.04 | 0.06 | 0.07 | 0.01 | 0.05 | 0.08 | -22.47 | 0.46 | -0.03 | 4.82 | 0.22 | 0.29 | 0.00 | 0.26 |
| SEQID-01071 | 0.02 | 0.01 | 0.05 | 0.05 | 0.03 | 0.05 | 0.09 | 0.07 | -14.44 | 0.45 | 0.06 | 9.70 | 0.00 | 0.29 | 0.00 | 0.24 |
| SEQID-01072 | 0.04 | 0.10 | 0.03 | 0.04 | 0.04 | 0.02 | 0.04 | 0.06 | -16.09 | 1.02 | 0.00 | 6.72 | 0.22 | 0.30 | 0.00 | 0.20 |
| SEQID-01073 | 0.03 | 0.05 | 0.08 | 0.03 | 0.03 | 0.05 | 0.07 | 0.06 | -16.32 | 0.42 | 0.04 | 9.51 | 0.21 | 0.32 | 0.00 | 0.21 |
| SEQID-01074 | 0.03 | 0.02 | 0.05 | 0.06 | 0.06 | 0.05 | 0.07 | 0.05 | -22.62 | 0.18 | 0.01 | 8.31 | 0.21 | 0.33 | 0.19 | 0.22 |
| SEQID-01075 | 0.02 | 0.08 | 0.05 | 0.05 | 0.05 | 0.01 | 0.04 | 0.07 | -16.97 | 0.49 | 0.00 | 7.11 | 0.21 | 0.33 | 0.00 | 0.22 |
| SEQID-01076 | 0.01 | 0.03 | 0.13 | 0.17 | 0.11 | 0.01 | 0.04 | 0.04 | -9.51 | 0.35 | 0.00 | 7.31 | 0.22 | 0.33 | 0.23 | 0.22 |
| SEQID-01077 | 0.02 | 0.06 | 0.05 | 0.05 | 0.04 | 0.03 | 0.03 | 0.04 | -19.53 | 0.40 | -0.01 | 6.14 | 1.00 | 1.00 | 0.20 | 0.22 |
| SEQID-01078 | 0.01 | 0.06 | 0.06 | 0.06 | 0.02 | 0.01 | 0.03 | 0.04 | -26.15 | 0.38 | -0.03 | 4.84 | 1.00 | 1.00 | 0.19 | 0.20 |
| SEQID-01079 | 0.01 | 0.06 | 0.05 | 0.06 | 0.02 | 0.01 | 0.03 | 0.04 | -26.21 | 0.36 | -0.03 | 5.48 | 0.96 | 1.00 | 0.00 | 0.20 |
| SEQID-01080 | 0.01 | 0.04 | 0.06 | 0.06 | 0.03 | 0.02 | 0.04 | 0.05 | -23.03 | 0.33 | -0.04 | 4.95 | 1.00 | 1.00 | 0.00 | 0.20 |
| SEQID-01081 | 0.01 | 0.05 | 0.06 | 0.04 | 0.04 | 0.01 | 0.04 | 0.06 | -20.74 | 0.36 | -0.03 | 5.47 | 1.00 | 1.00 | 0.00 | 0.21 |
| SEQID-01082 | 0.01 | 0.08 | 0.05 | 0.05 | 0.03 | 0.01 | 0.03 | 0.05 | -18.72 | 0.42 | -0.01 | 5.78 | 1.00 | 1.00 | 0.19 | 0.22 |
| SEQID-01083 | 0.01 | 0.05 | 0.06 | 0.06 | 0.04 | 0.03 | 0.04 | 0.06 | -20.28 | 0.34 | -0.02 | 5.75 | 1.00 | 1.00 | 0.00 | 1.00 |
| SEQID-01084 | 0.02 | 0.09 | 0.04 | 0.06 | 0.04 | 0.01 | 0.02 | 0.05 | -24.13 | 0.42 | -0.01 | 6.47 | 0.45 | 0.63 | 0.00 | 0.21 |
| SEQID-01085 | 0.02 | 0.06 | 0.05 | 0.05 | 0.05 | 0.03 | 0.05 | 0.05 | -20.29 | 0.39 | 0.00 | 6.55 | 0.20 | 0.33 | 0.00 | 0.21 |
| SEQID-01086 | 0.02 | 0.09 | 0.04 | 0.06 | 0.06 | 0.01 | 0.02 | 0.05 | -24.06 | 0.41 | 0.00 | 6.87 | 0.44 | 0.63 | 0.00 | 0.20 |
| SEQID-01087 | 0.02 | 0.08 | 0.04 | 0.06 | 0.05 | 0.01 | 0.05 | 0.05 | -23.27 | 0.45 | -0.01 | 6.57 | 0.46 | 0.66 | 0.18 | 0.21 |
| SEQID-01088 | 0.02 | 0.05 | 0.05 | 0.05 | 0.05 | 0.02 | 0.06 | 0.06 | -19.35 | 0.40 | 0.00 | 6.73 | 0.20 | 0.34 | 0.00 | 0.21 |
| SEQID-01089 | 0.02 | 0.07 | 0.04 | 0.04 | 0.07 | 0.02 | 0.03 | 0.08 | -18.23 | 0.50 | 0.01 | 8.02 | 0.25 | 0.34 | 0.00 | 0.21 |
| SEQID-01090 | 0.02 | 0.09 | 0.04 | 0.06 | 0.06 | 0.02 | 0.03 | 0.06 | -20.83 | 0.56 | -0.03 | 4.72 | 1.00 | 1.00 | 0.25 | 0.21 |
| SEQID-01091 | 0.02 | 0.05 | 0.05 | 0.05 | 0.05 | 0.03 | 0.06 | 0.05 | -19.29 | 0.37 | -0.01 | 6.35 | 0.20 | 0.35 | 0.00 | 1.00 |
| SEQID-01092 | 0.02 | 0.06 | 0.04 | 0.06 | 0.05 | 0.02 | 0.04 | 0.09 | -20.78 | 0.50 | 0.00 | 7.27 | 0.84 | 0.94 | 0.00 | 0.21 |
| SEQID-01093 | 0.02 | 0.04 | 0.05 | 0.03 | 0.05 | 0.02 | 0.05 | 0.07 | -20.34 | 0.33 | -0.01 | 6.76 | 0.22 | 0.31 | 0.00 | 0.21 |
| SEQID-01094 | 0.02 | 0.06 | 0.06 | 0.05 | 0.06 | 0.03 | 0.04 | 0.11 | -20.35 | 0.49 | 0.00 | 7.61 | 0.86 | 0.96 | 0.20 | 0.20 |
| SEQID-01095 | 0.02 | 0.08 | 0.03 | 0.03 | 0.07 | 0.02 | 0.05 | 0.09 | -16.22 | 0.57 | 0.01 | 7.36 | 0.67 | 0.94 | 0.19 | 0.21 |
| SEQID-01096 | 0.02 | 0.06 | 0.03 | 0.05 | 0.06 | 0.03 | 0.04 | 0.10 | -20.79 | 0.50 | 0.00 | 7.27 | 1.00 | 0.94 | 0.00 | 0.21 |
| SEQID-01097 | 0.01 | 0.08 | 0.04 | 0.06 | 0.02 | 0.00 | 0.04 | 0.05 | -21.37 | 0.48 | -0.01 | 6.14 | 0.21 | 1.00 | 0.21 | 0.22 |
| SEQID-01098 | 0.05 | 0.04 | 0.04 | 0.03 | 0.05 | 0.04 | 0.05 | 0.07 | -19.99 | 0.38 | 0.00 | 6.76 | 0.21 | 0.31 | 0.00 | 0.20 |
| SEQID-01099 | 0.02 | 0.07 | 0.05 | 0.04 | 0.10 | 0.02 | 0.03 | 0.09 | -15.86 | 0.67 | 0.02 | 9.38 | 0.23 | 0.76 | 0.00 | 0.24 |
| SEQID-01100 | 0.01 | 0.04 | 0.06 | 0.04 | 0.10 | 0.01 | 0.02 | 0.09 | -16.06 | 0.72 | 0.02 | 9.38 | 0.47 | 0.71 | 0.00 | 0.21 |
| SEQID-01101 | 0.01 | 0.07 | 0.05 | 0.05 | 0.02 | 0.00 | 0.03 | 0.04 | -27.12 | 0.37 | 0.01 | 6.26 | 0.60 | 0.86 | 0.19 | 0.20 |
| SEQID-01102 | 0.01 | 0.03 | 0.04 | 0.06 | 0.05 | 0.01 | 0.05 | 0.08 | -17.38 | 0.42 | 0.01 | 7.63 | 0.21 | 0.32 | 0.00 | 0.22 |
| SEQID-01103 | 0.03 | 0.07 | 0.06 | 0.07 | 0.07 | 0.01 | 0.02 | 0.07 | -11.30 | 0.50 | 0.02 | 8.38 | 0.22 | 0.34 | 0.20 | 0.22 |
| SEQID-01104 | 0.03 | 0.07 | 0.05 | 0.05 | 0.05 | 0.01 | 0.01 | 0.09 | -18.02 | 0.50 | 0.01 | 6.50 | 0.27 | 0.36 | 0.22 | 0.21 |
| SEQID-01105 | 0.05 | 0.04 | 0.05 | 0.06 | 0.06 | 0.02 | 0.02 | 0.07 | -19.68 | 0.46 | -0.03 | 5.17 | 0.21 | 0.33 | 0.00 | 0.21 |
| SEQID-01106 | 0.02 | 0.07 | 0.05 | 0.04 | 0.06 | 0.02 | 0.06 | 0.08 | -19.23 | 0.47 | 0.00 | 6.76 | 0.24 | 0.33 | 0.00 | 0.21 |
| SEQID-01107 | 0.03 | 0.07 | 0.06 | 0.07 | 0.05 | 0.01 | 0.03 | 0.06 | -11.25 | 0.48 | 0.02 | 8.32 | 0.22 | 0.33 | 0.00 | 0.20 |
| SEQID-01108 | 0.02 | 0.06 | 0.05 | 0.05 | 0.05 | 0.01 | 0.03 | 0.10 | -17.31 | 0.52 | -0.01 | 6.43 | 0.27 | 0.36 | 0.00 | 0.21 |
| SEQID-01109 | 0.02 | 0.05 | 0.04 | 0.06 | 0.06 | 0.00 | 0.05 | 0.07 | -19.81 | 0.42 | 0.01 | 6.26 | 0.88 | 0.98 | 0.19 | 0.20 |
| SEQID-01110 | 0.01 | 0.07 | 0.05 | 0.05 | 0.08 | 0.01 | 0.03 | 0.01 | -15.10 | 0.55 | 0.01 | 5.94 | 1.00 | 1.00 | 0.00 | 0.22 |
| SEQID-01111 | 0.06 | 0.02 | 0.02 | 0.04 | 0.04 | 0.04 | 0.01 | 0.01 | -29.45 | 0.31 | -0.04 | 4.98 | 0.36 | 0.39 | 0.53 | 0.23 |
| SEQID-01112 | 0.02 | 0.06 | 0.04 | 0.03 | 0.03 | 0.01 | 0.01 | 0.06 | -21.45 | 0.41 | -0.01 | 6.32 | 0.20 | 0.32 | 0.23 | 0.36 |
| SEQID-01113 | 0.03 | 0.05 | 0.05 | 0.04 | 0.05 | 0.02 | 0.05 | 0.08 | -22.27 | 0.40 | -0.01 | 9.56 | 0.22 | 0.35 | 0.00 | 0.21 |
| SEQID-01114 | 0.01 | 0.11 | 0.05 | 0.06 | 0.07 | 0.01 | 0.04 | 0.07 | -17.31 | 0.41 | 0.03 | 4.82 | 0.21 | 0.36 | 0.20 | 0.22 |
| SEQID-01115 | 0.05 | 0.04 | 0.05 | 0.05 | 0.03 | 0.01 | 0.06 | 0.06 | -19.69 | 0.44 | -0.04 | 5.16 | 0.20 | 0.33 | 0.00 | 0.21 |
| SEQID-01116 | 0.02 | 0.04 | 0.03 | 0.04 | 0.05 | 0.02 | 0.05 | 0.09 | -19.41 | 0.46 | -0.01 | 5.37 | 0.91 | 0.98 | 0.20 | 0.22 |

TABLE 1-continued

| | | | | | | | | | | | | | | | |
|---|---|---|---|---|---|---|---|---|---|---|---|---|---|---|---|
| SEQID-01117 | 0.04 | 0.05 | 0.05 | 0.04 | 0.04 | 0.01 | 0.07 | 0.03 | -20.78 | 0.29 | 0.00 | 7.07 | 0.22 | 0.29 | 0.00 | 0.00 |
| SEQID-01118 | 0.03 | 0.08 | 0.07 | 0.05 | 0.04 | 0.03 | 0.05 | 0.05 | -21.32 | 0.34 | -0.01 | 6.11 | 0.22 | 0.37 | 0.00 | 0.21 |
| SEQID-01119 | 0.02 | 0.04 | 0.02 | 0.07 | 0.04 | 0.04 | 0.07 | 0.04 | -20.86 | 0.36 | -0.02 | 5.88 | 1.00 | 1.00 | 0.00 | 0.35 |
| SEQID-01120 | 0.06 | 0.03 | 0.05 | 0.12 | 0.03 | 0.00 | 0.05 | 0.00 | -23.90 | 0.31 | -0.04 | 4.69 | 0.26 | 0.27 | 0.31 | 1.00 |
| SEQID-01121 | 0.06 | 0.04 | 0.08 | 0.07 | 0.03 | 0.03 | 0.05 | 0.06 | -20.07 | 0.32 | -0.02 | 6.03 | 0.21 | 0.32 | 0.21 | 0.00 |
| SEQID-01122 | 0.03 | 0.05 | 0.04 | 0.04 | 0.05 | 0.02 | 0.02 | 0.08 | -16.87 | 0.43 | 0.00 | 6.85 | 0.25 | 0.34 | 0.24 | 0.00 |
| SEQID-01123 | 0.02 | 0.02 | 0.05 | 0.08 | 0.06 | 0.02 | 0.03 | 0.08 | -16.39 | 0.59 | 0.00 | 7.14 | 0.21 | 0.35 | 0.20 | 0.21 |
| SEQID-01124 | 0.02 | 0.04 | 0.04 | 0.04 | 0.05 | 0.01 | 0.04 | 0.07 | -25.16 | 0.41 | -0.02 | 5.27 | 0.87 | 1.00 | 0.00 | 0.22 |
| SEQID-01125 | 0.00 | 0.10 | 0.03 | 0.06 | 0.03 | 0.01 | 0.03 | 0.07 | -21.91 | 0.46 | -0.05 | 4.62 | 0.22 | 0.55 | 0.00 | 0.22 |
| SEQID-01126 | 0.02 | 0.04 | 0.05 | 0.06 | 0.05 | 0.00 | 0.04 | 0.07 | -18.33 | 0.49 | -0.01 | 6.05 | 0.21 | 0.33 | 0.20 | 0.20 |
| SEQID-01127 | 0.02 | 0.08 | 0.04 | 0.05 | 0.05 | 0.02 | 0.04 | 0.07 | -18.52 | 0.64 | -0.02 | 4.72 | 1.00 | 1.00 | 0.00 | 1.00 |
| SEQID-01128 | 0.03 | 0.03 | 0.05 | 0.05 | 0.05 | 0.03 | 0.03 | 0.09 | -16.77 | 0.56 | -0.01 | 6.25 | 0.27 | 0.34 | 0.20 | 0.20 |
| SEQID-01129 | 0.04 | 0.03 | 0.05 | 0.05 | 0.05 | 0.03 | 0.03 | 0.11 | -15.32 | 0.61 | 0.00 | 7.46 | 0.27 | 0.33 | 0.00 | 0.23 |
| SEQID-01130 | 0.02 | 0.04 | 0.05 | 0.08 | 0.04 | 0.01 | 0.02 | 0.09 | -17.73 | 0.53 | 0.01 | 8.68 | 0.23 | 0.33 | 0.21 | 0.22 |
| SEQID-01131 | 0.05 | 0.05 | 0.04 | 0.05 | 0.05 | 0.02 | 0.04 | 0.08 | -21.19 | 0.38 | -0.01 | 5.97 | 0.19 | 0.33 | 0.00 | 0.21 |
| SEQID-01132 | 0.02 | 0.04 | 0.03 | 0.05 | 0.04 | 0.01 | 0.04 | 0.08 | -19.78 | 0.43 | -0.01 | 6.20 | 0.90 | 0.98 | 0.20 | 0.21 |
| SEQID-01133 | 0.03 | 0.06 | 0.04 | 0.05 | 0.05 | 0.01 | 0.06 | 0.08 | -19.26 | 0.41 | -0.04 | 4.77 | 0.81 | 0.90 | 0.19 | 0.23 |
| SEQID-01134 | 0.05 | 0.07 | 0.04 | 0.05 | 0.04 | 0.02 | 0.05 | 0.06 | -19.53 | 0.34 | -0.05 | 4.46 | 0.39 | 0.55 | 0.00 | 0.22 |
| SEQID-01135 | 0.02 | 0.05 | 0.05 | 0.08 | 0.05 | 0.01 | 0.04 | 0.07 | -16.45 | 0.48 | 0.01 | 8.66 | 0.21 | 0.34 | 0.22 | 0.21 |
| SEQID-01136 | 0.03 | 0.04 | 0.08 | 0.03 | 0.05 | 0.04 | 0.03 | 0.05 | -17.04 | 0.43 | -0.03 | 4.88 | 0.21 | 0.31 | 0.20 | 0.22 |
| SEQID-01137 | 0.02 | 0.04 | 0.04 | 0.05 | 0.05 | 0.00 | 0.05 | 0.07 | -18.87 | 0.48 | 0.00 | 6.55 | 0.21 | 0.33 | 0.00 | 0.22 |
| SEQID-01138 | 0.05 | 0.02 | 0.05 | 0.05 | 0.07 | 0.01 | 0.03 | 0.08 | -19.52 | 0.52 | 0.01 | 7.63 | 0.22 | 0.34 | 0.00 | 0.22 |
| SEQID-01139 | 0.03 | 0.06 | 0.02 | 0.05 | 0.04 | 0.01 | 0.04 | 0.05 | -28.20 | 0.33 | -0.05 | 4.66 | 0.67 | 0.83 | 0.00 | 0.20 |
| SEQID-01140 | 0.03 | 0.05 | 0.05 | 0.04 | 0.06 | 0.01 | 0.03 | 0.06 | -18.65 | 0.44 | -0.02 | 5.97 | 0.19 | 0.32 | 0.00 | 0.21 |
| SEQID-01141 | 0.01 | 0.02 | 0.02 | 0.04 | 0.16 | 0.00 | 0.11 | 0.03 | -18.99 | 0.11 | -0.01 | 6.80 | 0.26 | 0.37 | 0.23 | 0.24 |
| SEQID-01142 | 0.03 | 0.05 | 0.03 | 0.04 | 0.05 | 0.01 | 0.03 | 0.07 | -23.21 | 0.36 | -0.02 | 5.12 | 0.71 | 0.91 | 0.00 | 0.20 |
| SEQID-01143 | 0.03 | 0.04 | 0.04 | 0.04 | 0.04 | 0.02 | 0.04 | 0.10 | -22.76 | 0.46 | 0.05 | 10.21 | 0.23 | 0.30 | 0.00 | 0.19 |
| SEQID-01144 | 0.03 | 0.05 | 0.05 | 0.05 | 0.06 | 0.00 | 0.04 | 0.08 | -16.78 | 0.51 | 0.01 | 6.97 | 0.20 | 0.33 | 0.20 | 0.21 |
| SEQID-01145 | 0.01 | 0.05 | 0.03 | 0.04 | 0.05 | 0.05 | 0.03 | 0.13 | -17.92 | 0.55 | 0.00 | 6.52 | 0.69 | 0.85 | 0.00 | 0.23 |
| SEQID-01146 | 0.07 | 0.01 | 0.02 | 0.04 | 0.02 | 0.01 | 0.05 | 0.00 | -26.27 | 0.38 | -0.01 | 6.35 | 0.37 | 0.39 | 0.26 | 0.37 |
| SEQID-01147 | 0.02 | 0.06 | 0.04 | 0.03 | 0.06 | 0.03 | 0.05 | 0.06 | -20.17 | 0.37 | -0.01 | 6.40 | 0.22 | 0.33 | 0.00 | 0.22 |
| SEQID-01148 | 0.03 | 0.08 | 0.05 | 0.05 | 0.02 | 0.01 | 0.03 | 0.06 | -22.38 | 0.28 | 0.13 | 11.03 | 0.24 | 0.29 | 0.19 | 0.21 |
| SEQID-01149 | 0.01 | 0.06 | 0.04 | 0.07 | 0.09 | 0.11 | 0.11 | 0.06 | -11.77 | 0.89 | 0.02 | 9.20 | 0.45 | 0.66 | 0.00 | 0.26 |
| SEQID-01150 | 0.04 | 0.03 | 0.04 | 0.03 | 0.06 | 0.03 | 0.04 | 0.07 | -19.34 | 0.53 | -0.01 | 6.04 | 0.20 | 0.33 | 0.21 | 0.21 |
| SEQID-01151 | 0.01 | 0.03 | 0.04 | 0.08 | 0.07 | 0.06 | 0.04 | 0.08 | -18.83 | 0.44 | -0.01 | 7.81 | 0.21 | 0.30 | 0.00 | 0.00 |
| SEQID-01152 | 0.02 | 0.07 | 0.05 | 0.07 | 0.04 | 0.03 | 0.07 | 0.06 | -17.08 | 0.48 | 0.00 | 7.30 | 0.51 | 0.65 | 0.20 | 0.51 |
| SEQID-01153 | 0.04 | 0.03 | 0.04 | 0.07 | 0.05 | 0.01 | 0.04 | 0.05 | -20.47 | 0.46 | -0.02 | 5.96 | 0.99 | 1.00 | 0.00 | 0.22 |
| SEQID-01154 | 0.01 | 0.07 | 0.06 | 0.07 | 0.07 | 0.02 | 0.03 | 0.07 | -11.40 | 0.52 | 0.02 | 7.89 | 0.40 | 0.52 | 0.00 | 0.32 |
| SEQID-01155 | 0.03 | 0.06 | 0.04 | 0.08 | 0.04 | 0.01 | 0.06 | 0.06 | -18.29 | 0.46 | 0.00 | 7.32 | 0.21 | 0.33 | 0.00 | 0.22 |
| SEQID-01156 | 0.01 | 0.06 | 0.05 | 0.05 | 0.05 | 0.02 | 0.05 | 0.08 | -16.00 | 0.53 | -0.01 | 6.03 | 0.20 | 0.32 | 0.18 | 0.21 |
| SEQID-01157 | 0.02 | 0.04 | 0.05 | 0.10 | 0.12 | 0.01 | 0.10 | 0.04 | -11.42 | 0.75 | 0.02 | 3.90 | 0.28 | 0.66 | 0.21 | 0.24 |
| SEQID-01158 | 0.03 | 0.05 | 0.04 | 0.03 | 0.05 | 0.01 | 0.04 | 0.06 | -23.09 | 0.36 | 0.11 | 10.94 | 0.20 | 0.32 | 0.00 | 0.00 |
| SEQID-01159 | 0.01 | 0.03 | 0.04 | 0.04 | 0.03 | 0.05 | 0.01 | 0.08 | -28.74 | 0.19 | -0.01 | 6.52 | 0.51 | 0.68 | 0.21 | 0.22 |
| SEQID-01160 | 0.02 | 0.06 | 0.04 | 0.04 | 0.03 | 0.03 | 0.05 | 0.06 | -18.96 | 0.36 | -0.02 | 5.68 | 0.34 | 0.48 | 0.20 | 0.20 |
| SEQID-01161 | 0.04 | 0.03 | 0.06 | 0.05 | 0.05 | 0.05 | 0.05 | 0.09 | -19.80 | 0.48 | 0.00 | 7.21 | 0.21 | 0.29 | 0.00 | 0.23 |
| SEQID-01162 | 0.02 | 0.04 | 0.03 | 0.03 | 0.04 | 0.01 | 0.03 | 0.04 | -21.52 | 0.39 | -0.03 | 6.47 | 0.21 | 0.34 | 0.00 | 0.21 |
| SEQID-01163 | 0.03 | 0.04 | 0.04 | 0.07 | 0.04 | 0.01 | 0.06 | 0.04 | -25.01 | 0.32 | -0.07 | 4.39 | 0.23 | 0.32 | 0.00 | 0.00 |
| SEQID-01164 | 0.02 | 0.06 | 0.03 | 0.05 | 0.04 | 0.01 | 0.03 | 0.06 | -24.61 | 0.35 | -0.03 | 4.86 | 0.19 | 0.33 | 0.00 | 0.20 |
| SEQID-01165 | 0.01 | 0.06 | 0.08 | 0.04 | 0.03 | 0.01 | 0.04 | 0.08 | -23.84 | 0.38 | 0.12 | 10.90 | 0.00 | 0.31 | 0.18 | 0.23 |
| SEQID-01166 | 0.02 | 0.04 | 0.04 | 0.06 | 0.05 | 0.02 | 0.05 | 0.07 | -19.45 | 0.42 | -0.02 | 5.20 | 0.20 | 0.32 | 0.21 | 0.22 |
| SEQID-01167 | 0.04 | 0.05 | 0.05 | 0.03 | 0.04 | 0.04 | 0.05 | 0.06 | -23.34 | 0.35 | -0.02 | 5.84 | 0.21 | 0.34 | 0.00 | 0.21 |
| SEQID-01168 | 0.02 | 0.05 | 0.03 | 0.04 | 0.03 | 0.02 | 0.02 | 0.04 | -32.07 | 0.35 | -0.03 | 5.18 | 0.22 | 0.50 | 0.19 | 0.22 |
| SEQID-01169 | 0.04 | 0.08 | 0.05 | 0.04 | 0.07 | 0.00 | 0.02 | 0.11 | -24.06 | 0.34 | 0.04 | 10.06 | 0.23 | 0.31 | 0.00 | 0.20 |

TABLE 1-continued

| | | | | | | | | | | | | | | | |
|---|---|---|---|---|---|---|---|---|---|---|---|---|---|---|---|
| SEQID-01170 | 0.02 | 0.10 | 0.06 | 0.06 | 0.03 | 0.00 | 0.09 | −26.89 | 0.25 | −0.01 | 5.88 | 0.71 | 0.83 | 0.00 | 0.22 |
| SEQID-01171 | 0.03 | 0.04 | 0.02 | 0.03 | 0.01 | 0.03 | 0.10 | −28.78 | 0.34 | 0.14 | 11.14 | 0.26 | 0.34 | 0.23 | 0.23 |
| SEQID-01172 | 0.03 | 0.06 | 0.04 | 0.04 | 0.05 | 0.02 | 0.07 | −19.93 | 0.37 | 0.01 | 7.90 | 0.21 | 0.33 | 0.00 | 0.22 |
| SEQID-01173 | 0.06 | 0.04 | 0.07 | 0.04 | 0.02 | 0.06 | 0.09 | −17.74 | 0.54 | 0.00 | 7.20 | 0.19 | 0.32 | 0.00 | 0.23 |
| SEQID-01174 | 0.02 | 0.04 | 0.03 | 0.02 | 0.01 | 0.04 | 0.05 | −26.31 | 0.28 | 0.10 | 10.61 | 0.24 | 0.32 | 0.00 | 0.00 |
| SEQID-01175 | 0.07 | 0.07 | 0.02 | 0.06 | 0.01 | 0.07 | 0.07 | −18.65 | 0.43 | 0.00 | 6.91 | 0.27 | 0.35 | 0.25 | 0.25 |
| SEQID-01176 | 0.03 | 0.03 | 0.05 | 0.06 | 0.03 | 0.03 | 0.08 | −22.07 | 0.32 | 0.11 | 11.15 | 0.22 | 0.33 | 0.00 | 0.00 |
| SEQID-01177 | 0.02 | 0.05 | 0.05 | 0.03 | 0.03 | 0.03 | 0.08 | −19.41 | 0.37 | 0.12 | 11.44 | 0.00 | 0.34 | 0.20 | 0.19 |
| SEQID-01178 | 0.02 | 0.06 | 0.04 | 0.04 | 0.04 | 0.05 | 0.06 | −22.03 | 0.34 | −0.02 | 5.45 | 0.19 | 0.35 | 0.00 | 0.25 |
| SEQID-01179 | 0.02 | 0.06 | 0.06 | 0.04 | 0.05 | 0.02 | 0.06 | −19.17 | 0.38 | −0.02 | 5.11 | 0.20 | 0.33 | 0.00 | 0.20 |
| SEQID-01180 | 0.01 | 0.04 | 0.04 | 0.05 | 0.02 | 0.05 | 0.07 | −19.10 | 0.54 | 0.00 | 5.53 | 0.22 | 0.34 | 0.21 | 0.23 |
| SEQID-01181 | 0.01 | 0.05 | 0.10 | 0.05 | 0.02 | 0.04 | 0.07 | −15.33 | 0.56 | 0.01 | 7.73 | 0.21 | 0.33 | 0.00 | 0.21 |
| SEQID-01182 | 0.04 | 0.05 | 0.05 | 0.04 | 0.03 | 0.05 | 0.04 | −23.47 | 0.27 | −0.01 | 6.04 | 0.37 | 0.31 | 0.00 | 0.23 |
| SEQID-01183 | 0.01 | 0.05 | 0.04 | 0.06 | 0.05 | 0.06 | 0.04 | −29.60 | 0.23 | −0.11 | 4.19 | 0.21 | 0.55 | 0.00 | 0.20 |
| SEQID-01184 | 0.02 | 0.04 | 0.06 | 0.06 | 0.04 | 0.01 | 0.09 | −11.24 | 1.01 | 0.03 | 9.70 | 0.72 | 0.48 | 0.00 | 0.22 |
| SEQID-01185 | 0.03 | 0.07 | 0.06 | 0.04 | 0.06 | 0.06 | 0.09 | −25.30 | 0.28 | 0.00 | 6.32 | 0.73 | 0.34 | 0.00 | 0.26 |
| SEQID-01186 | 0.02 | 0.06 | 0.03 | 0.03 | 0.07 | 0.00 | 0.08 | −22.51 | 0.39 | 0.09 | 11.06 | 0.20 | 0.33 | 0.00 | 0.21 |
| SEQID-01187 | 0.04 | 0.06 | 0.04 | 0.06 | 0.02 | 0.02 | 0.08 | −20.50 | 0.45 | −0.02 | 5.09 | 0.21 | 0.32 | 0.00 | 0.25 |
| SEQID-01188 | 0.02 | 0.05 | 0.03 | 0.06 | 0.06 | 0.04 | 0.08 | −24.54 | 0.31 | 0.12 | 10.75 | 0.68 | 0.79 | 0.00 | 0.00 |
| SEQID-01189 | 0.01 | 0.07 | 0.06 | 0.07 | 0.03 | 0.08 | 0.06 | −18.06 | 0.47 | −0.03 | 5.52 | 0.43 | 0.61 | 0.21 | 0.21 |
| SEQID-01190 | 0.02 | 0.04 | 0.03 | 0.03 | 0.04 | 0.09 | 0.06 | −27.23 | 0.36 | 0.04 | 9.73 | 0.19 | 0.31 | 0.00 | 0.00 |
| SEQID-01191 | 0.02 | 0.07 | 0.06 | 0.06 | 0.06 | 0.02 | 0.08 | −11.49 | 1.06 | 0.03 | 9.41 | 0.37 | 0.50 | 0.23 | 0.27 |
| SEQID-01192 | 0.01 | 0.07 | 0.07 | 0.04 | 0.03 | 0.06 | 0.08 | −20.15 | 0.37 | 0.01 | 8.19 | 0.17 | 0.32 | 0.00 | 0.00 |
| SEQID-01193 | 0.02 | 0.07 | 0.05 | 0.06 | 0.01 | 0.03 | 0.04 | −21.17 | 0.30 | 0.17 | 11.45 | 0.23 | 0.31 | 0.20 | 0.22 |
| SEQID-01194 | 0.04 | 0.05 | 0.02 | 0.06 | 0.05 | 0.04 | 0.05 | −21.04 | 0.43 | −0.03 | 5.03 | 0.00 | 0.32 | 0.00 | 0.21 |
| SEQID-01195 | 0.04 | 0.06 | 0.02 | 0.02 | 0.05 | 0.01 | 0.10 | −21.65 | 0.54 | 0.07 | 10.46 | 0.22 | 0.31 | 0.00 | 0.24 |
| SEQID-01196 | 0.01 | 0.07 | 0.06 | 0.07 | 0.06 | 0.04 | 0.09 | −15.53 | 0.59 | 0.01 | 8.47 | 0.24 | 0.64 | 0.24 | 0.47 |
| SEQID-01197 | 0.01 | 0.04 | 0.04 | 0.06 | 0.03 | 0.04 | 0.05 | −24.61 | 0.22 | 0.12 | 10.98 | 0.00 | 0.30 | 0.18 | 0.21 |
| SEQID-01198 | 0.03 | 0.06 | 0.02 | 0.05 | 0.04 | 0.06 | 0.08 | −23.27 | 0.36 | 0.08 | 10.54 | 0.21 | 0.32 | 0.00 | 0.25 |
| SEQID-01199 | 0.01 | 0.09 | 0.03 | 0.04 | 0.03 | 0.05 | 0.06 | −20.99 | 0.33 | 0.00 | 7.18 | 0.23 | 0.32 | 0.25 | 0.25 |
| SEQID-01200 | 0.03 | 0.04 | 0.04 | 0.05 | 0.04 | 0.02 | 0.07 | −25.01 | 0.35 | −0.07 | 4.28 | 0.37 | 0.58 | 0.00 | 0.00 |
| SEQID-01201 | 0.04 | 0.04 | 0.01 | 0.03 | 0.04 | 0.02 | 0.07 | −25.72 | 0.31 | 0.13 | 11.26 | 0.25 | 0.31 | 0.22 | 0.21 |
| SEQID-01202 | 0.05 | 0.07 | 0.03 | 0.04 | 0.05 | 0.00 | 0.08 | −17.45 | 0.56 | 0.00 | 6.68 | 0.00 | 0.33 | 0.00 | 0.20 |
| SEQID-01203 | 0.03 | 0.05 | 0.03 | 0.05 | 0.06 | 0.04 | 0.07 | −19.45 | 0.37 | −0.01 | 5.34 | 0.22 | 0.33 | 0.00 | 0.21 |
| SEQID-01204 | 0.03 | 0.03 | 0.07 | 0.07 | 0.05 | 0.03 | 0.12 | −27.72 | 0.21 | 0.16 | 11.65 | 0.24 | 0.29 | 0.00 | 0.23 |
| SEQID-01205 | 0.03 | 0.05 | 0.03 | 0.06 | 0.07 | 0.07 | 0.04 | −20.53 | 0.39 | 0.03 | 9.09 | 0.22 | 0.32 | 0.00 | 0.00 |
| SEQID-01206 | 0.02 | 0.06 | 0.04 | 0.04 | 0.06 | 0.01 | 0.06 | −22.28 | 0.33 | 0.00 | 10.05 | 0.00 | 0.31 | 0.00 | 0.24 |
| SEQID-01207 | 0.02 | 0.05 | 0.04 | 0.04 | 0.09 | 0.03 | 0.08 | −20.11 | 0.56 | 0.05 | 8.63 | 0.39 | 0.57 | 0.19 | 0.22 |
| SEQID-01208 | 0.03 | 0.04 | 0.04 | 0.05 | 0.01 | 0.02 | 0.07 | −18.22 | 0.38 | 0.02 | 6.41 | 0.19 | 0.33 | 0.00 | 0.21 |
| SEQID-01209 | 0.02 | 0.06 | 0.02 | 0.04 | 0.04 | 0.04 | 0.08 | −28.13 | 0.37 | −0.03 | 5.77 | 0.21 | 0.34 | 0.00 | 0.21 |
| SEQID-01210 | 0.04 | 0.02 | 0.05 | 0.06 | 0.04 | 0.05 | 0.06 | −21.37 | 0.55 | −0.01 | 6.45 | 0.21 | 0.34 | 0.00 | 0.22 |
| SEQID-01211 | 0.02 | 0.12 | 0.02 | 0.02 | 0.04 | 0.00 | 0.09 | −21.54 | 0.57 | 0.11 | 9.35 | 0.28 | 0.26 | 0.32 | 0.29 |
| SEQID-01212 | 0.03 | 0.04 | 0.05 | 0.06 | 0.05 | 0.04 | 0.05 | −16.48 | 0.54 | 0.01 | 8.30 | 0.53 | 0.74 | 0.00 | 0.23 |
| SEQID-01213 | 0.03 | 0.05 | 0.07 | 0.04 | 0.04 | 0.04 | 0.10 | −21.02 | 0.30 | 0.00 | 6.94 | 0.71 | 0.81 | 0.00 | 0.22 |
| SEQID-01214 | 0.02 | 0.06 | 0.04 | 0.02 | 0.06 | 0.02 | 0.06 | −22.28 | 0.35 | −0.01 | 5.81 | 0.78 | 0.33 | 0.00 | 0.21 |
| SEQID-01215 | 0.02 | 0.05 | 0.04 | 0.06 | 0.07 | 0.04 | 0.08 | −20.11 | 0.52 | 0.00 | 7.40 | 0.21 | 0.31 | 0.00 | 0.21 |
| SEQID-01216 | 0.03 | 0.04 | 0.04 | 0.05 | 0.01 | 0.03 | 0.09 | −18.22 | 0.67 | −0.01 | 6.95 | 0.21 | 0.36 | 0.00 | 0.22 |
| SEQID-01217 | 0.02 | 0.06 | 0.02 | 0.04 | 0.01 | 0.02 | 0.05 | −28.13 | 0.27 | 0.00 | 4.64 | 0.43 | 0.69 | 0.20 | 0.20 |
| SEQID-01218 | 0.04 | 0.08 | 0.07 | 0.11 | 0.09 | 0.04 | 0.07 | −13.96 | 0.43 | −0.05 | 9.02 | 0.20 | 0.96 | 0.00 | 0.21 |
| SEQID-01219 | 0.05 | 0.02 | 0.05 | 0.07 | 0.06 | 0.01 | 0.09 | −19.87 | 0.53 | 0.03 | 6.56 | 0.20 | 0.37 | 0.00 | 0.00 |
| SEQID-01220 | 0.03 | 0.06 | 0.03 | 0.04 | 0.05 | 0.02 | 0.08 | −18.51 | 0.48 | −0.01 | 7.07 | 0.21 | 0.34 | 0.17 | 0.20 |
| SEQID-01221 | 0.01 | 0.04 | 0.05 | 0.04 | 0.03 | 0.04 | 0.05 | −27.59 | 0.24 | 0.16 | 11.39 | 0.21 | 0.34 | 0.22 | 0.00 |
| SEQID-01222 | 0.03 | 0.04 | 0.04 | 0.05 | 0.07 | 0.01 | 0.06 | −23.57 | 0.34 | 0.09 | 11.50 | 0.22 | 0.29 | 0.18 | 0.22 |

TABLE 1-continued

| SEQID | | | | | | | | | | | | | | | | |
|---|---|---|---|---|---|---|---|---|---|---|---|---|---|---|---|---|
| SEQID-01223 | 0.03 | 0.04 | 0.04 | 0.07 | 0.04 | 0.02 | 0.06 | 0.06 | -21.05 | 0.23 | 0.10 | 10.83 | 0.22 | 0.23 | 0.00 | 0.20 |
| SEQID-01224 | 0.05 | 0.03 | 0.03 | 0.05 | 0.02 | 0.00 | 0.03 | 0.07 | -22.77 | 0.40 | 0.09 | 10.51 | 0.22 | 0.30 | 0.00 | 0.21 |
| SEQID-01225 | 0.01 | 0.07 | 0.07 | 0.03 | 0.03 | 0.00 | 0.04 | 0.08 | -21.61 | 0.44 | 0.15 | 11.36 | 0.26 | 0.30 | 0.00 | 0.27 |
| SEQID-01226 | 0.02 | 0.04 | 0.06 | 0.05 | 0.04 | 0.01 | 0.02 | 0.09 | -20.11 | 0.58 | -0.02 | 5.23 | 0.40 | 0.43 | 0.24 | 0.00 |
| SEQID-01227 | 0.05 | 0.07 | 0.07 | 0.04 | 0.03 | 0.00 | 0.03 | 0.06 | -22.82 | 0.40 | 0.10 | 11.11 | 0.00 | 0.29 | 0.00 | 0.23 |
| SEQID-01228 | 0.07 | 0.01 | 0.01 | 0.05 | 0.02 | 0.00 | 0.06 | 0.08 | -18.17 | 0.45 | -0.02 | 6.08 | 0.26 | 0.30 | 0.24 | 0.24 |
| SEQID-01229 | 0.03 | 0.05 | 0.05 | 0.04 | 0.07 | 0.01 | 0.02 | 0.09 | -24.32 | 0.28 | 0.06 | 10.25 | 0.21 | 0.33 | 0.00 | 0.24 |
| SEQID-01230 | 0.02 | 0.05 | 0.04 | 0.04 | 0.04 | 0.00 | 0.05 | 0.09 | -27.23 | 0.33 | 0.07 | 10.42 | 0.23 | 0.32 | 0.00 | 0.22 |
| SEQID-01231 | 0.01 | 0.06 | 0.06 | 0.03 | 0.02 | 0.01 | 0.06 | 0.06 | -21.84 | 0.51 | 0.12 | 10.79 | 0.20 | 0.32 | 0.00 | 0.00 |
| SEQID-01232 | 0.03 | 0.05 | 0.04 | 0.04 | 0.04 | 0.00 | 0.04 | 0.06 | -20.35 | 0.32 | 0.01 | 8.31 | 0.20 | 0.30 | 0.00 | 0.22 |
| SEQID-01233 | 0.03 | 0.05 | 0.06 | 0.04 | 0.05 | 0.02 | 0.03 | 0.07 | -25.82 | 0.25 | 0.08 | 10.50 | 0.20 | 0.30 | 0.00 | 0.00 |
| SEQID-01234 | 0.02 | 0.02 | 0.02 | 0.05 | 0.05 | 0.01 | 0.00 | 0.11 | -23.74 | 0.48 | 0.03 | 9.63 | 0.29 | 0.32 | 0.00 | 0.25 |
| SEQID-01235 | 0.02 | 0.10 | 0.10 | 0.03 | 0.03 | 0.02 | 0.07 | 0.02 | -20.74 | 0.19 | 0.05 | 10.10 | 0.22 | 0.45 | 0.00 | 0.29 |
| SEQID-01236 | 0.02 | 0.03 | 0.05 | 0.07 | 0.05 | 0.03 | 0.05 | 0.07 | -16.99 | 0.43 | -0.06 | 6.77 | 0.41 | 0.34 | 0.22 | 0.21 |
| SEQID-01237 | 0.01 | 0.06 | 0.06 | 0.05 | 0.02 | 0.04 | 0.05 | 0.04 | -26.99 | 0.40 | 0.00 | 4.51 | 0.22 | 0.71 | 0.00 | 0.22 |
| SEQID-01238 | 0.03 | 0.04 | 0.04 | 0.06 | 0.06 | 0.02 | 0.05 | 0.07 | -20.81 | 0.36 | 0.02 | 7.00 | 0.42 | 0.21 | 0.22 | 0.23 |
| SEQID-01239 | 0.06 | 0.04 | 0.05 | 0.04 | 0.08 | 0.01 | 0.02 | 0.08 | -9.86 | 0.97 | -0.02 | 8.55 | 0.22 | 0.55 | 0.00 | 0.23 |
| SEQID-01240 | 0.03 | 0.04 | 0.03 | 0.06 | 0.06 | 0.03 | 0.07 | 0.09 | -15.50 | 0.47 | 0.00 | 5.23 | 0.22 | 0.35 | 0.00 | 0.21 |
| SEQID-01241 | 0.03 | 0.05 | 0.04 | 0.05 | 0.05 | 0.01 | 0.06 | 0.07 | -19.27 | 0.43 | 0.00 | 6.91 | 0.20 | 0.31 | 0.19 | 0.20 |
| SEQID-01242 | 0.02 | 0.07 | 0.07 | 0.09 | 0.07 | 0.01 | 0.06 | 0.08 | -12.30 | 0.51 | 0.01 | 8.06 | 0.37 | 0.55 | 0.00 | 0.22 |
| SEQID-01243 | 0.04 | 0.05 | 0.05 | 0.05 | 0.06 | 0.02 | 0.06 | 0.07 | -19.43 | 0.38 | -0.02 | 5.16 | 0.21 | 0.33 | 0.00 | 0.21 |
| SEQID-01244 | 0.01 | 0.06 | 0.08 | 0.06 | 0.05 | 0.03 | 0.04 | 0.06 | -16.02 | 0.43 | -0.01 | 6.23 | 0.22 | 0.34 | 0.22 | 0.23 |
| SEQID-01245 | 0.01 | 0.04 | 0.02 | 0.06 | 0.09 | 0.02 | 0.09 | 0.04 | -16.05 | 0.52 | 0.00 | 6.94 | 0.23 | 0.32 | 0.21 | 0.24 |
| SEQID-01246 | 0.00 | 0.08 | 0.08 | 0.05 | 0.02 | 0.00 | 0.03 | 0.05 | -27.51 | 0.35 | 0.05 | 10.27 | 0.21 | 0.34 | 0.00 | 0.19 |
| SEQID-01247 | 0.02 | 0.01 | 0.01 | 0.04 | 0.07 | 0.02 | 0.05 | 0.05 | -31.20 | 0.10 | 0.00 | 6.28 | 0.22 | 0.36 | 0.23 | 0.22 |
| SEQID-01248 | 0.01 | 0.06 | 0.07 | 0.06 | 0.04 | 0.03 | 0.04 | 0.10 | -19.05 | 0.58 | -0.01 | 6.40 | 0.29 | 0.39 | 0.00 | 0.22 |
| SEQID-01249 | 0.03 | 0.05 | 0.04 | 0.11 | 0.04 | 0.02 | 0.01 | 0.06 | -16.73 | 0.49 | 0.01 | 9.15 | 0.23 | 0.32 | 0.00 | 0.21 |
| SEQID-01250 | 0.04 | 0.09 | 0.03 | 0.06 | 0.03 | 0.00 | 0.06 | 0.07 | -25.26 | 0.42 | -0.08 | 4.21 | 0.27 | 0.36 | 0.24 | 0.26 |
| SEQID-01251 | 0.02 | 0.07 | 0.07 | 0.05 | 0.05 | 0.02 | 0.04 | 0.07 | -18.30 | 0.43 | 0.00 | 7.16 | 0.51 | 0.78 | 0.20 | 0.23 |
| SEQID-01252 | 0.03 | 0.04 | 0.05 | 0.04 | 0.04 | 0.02 | 0.06 | 0.06 | -20.96 | 0.44 | -0.01 | 5.63 | 0.21 | 0.33 | 0.21 | 0.22 |
| SEQID-01253 | 0.02 | 0.02 | 0.06 | 0.06 | 0.06 | 0.04 | 0.09 | 0.05 | -14.18 | 0.42 | -0.03 | 4.68 | 0.36 | 0.59 | 0.00 | 0.18 |
| SEQID-01254 | 0.02 | 0.07 | 0.05 | 0.07 | 0.07 | 0.00 | 0.03 | 0.04 | -20.46 | 0.18 | -0.03 | 9.81 | 0.35 | 0.57 | 0.22 | 0.25 |
| SEQID-01255 | 0.03 | 0.06 | 0.05 | 0.03 | 0.11 | 0.04 | 0.08 | 0.07 | -18.03 | 0.39 | -0.02 | 5.40 | 0.20 | 0.32 | 0.00 | 0.19 |
| SEQID-01256 | 0.01 | 0.06 | 0.06 | 0.05 | 0.04 | 0.01 | 0.03 | 0.08 | -21.42 | 0.48 | 0.00 | 7.81 | 0.22 | 0.34 | 0.20 | 0.20 |
| SEQID-01257 | 0.03 | 0.04 | 0.06 | 0.06 | 0.07 | 0.01 | 0.05 | 0.10 | -19.33 | 0.45 | 0.00 | 6.96 | 0.67 | 0.90 | 0.00 | 0.72 |
| SEQID-01258 | 0.03 | 0.04 | 0.04 | 0.04 | 0.04 | 0.00 | 0.04 | 0.09 | -20.05 | 0.47 | 0.00 | 7.78 | 0.21 | 0.31 | 0.19 | 0.21 |
| SEQID-01259 | 0.03 | 0.05 | 0.05 | 0.04 | 0.02 | 0.00 | 0.06 | 0.10 | -19.34 | 0.46 | 0.00 | 6.96 | 0.67 | 0.90 | 0.23 | 0.00 |
| SEQID-01260 | 0.02 | 0.06 | 0.04 | 0.04 | 0.07 | 0.01 | 0.02 | 0.06 | -22.84 | 0.34 | -0.03 | 4.73 | 0.76 | 0.93 | 0.19 | 0.21 |
| SEQID-01261 | 0.03 | 0.07 | 0.04 | 0.05 | 0.05 | 0.02 | 0.05 | 0.10 | -19.20 | 0.47 | 0.01 | 8.57 | 0.67 | 0.90 | 0.19 | 0.00 |
| SEQID-01262 | 0.02 | 0.04 | 0.04 | 0.04 | 0.04 | 0.00 | 0.02 | 0.06 | -22.96 | 0.34 | -0.03 | 4.68 | 0.77 | 0.93 | 0.19 | 0.00 |
| SEQID-01263 | 0.00 | 0.06 | 0.06 | 0.05 | 0.07 | 0.02 | 0.05 | 0.10 | -20.31 | 0.47 | -0.01 | 5.81 | 0.50 | 0.60 | 0.00 | 0.23 |
| SEQID-01264 | 0.02 | 0.05 | 0.04 | 0.04 | 0.06 | 0.02 | 0.03 | 0.09 | -21.72 | 0.43 | 0.03 | 9.58 | 0.22 | 0.34 | 0.00 | 0.21 |
| SEQID-01265 | 0.03 | 0.06 | 0.04 | 0.04 | 0.07 | 0.02 | 0.05 | 0.06 | -16.92 | 0.48 | -0.01 | 6.11 | 0.21 | 0.33 | 0.00 | 0.22 |
| SEQID-01266 | 0.02 | 0.03 | 0.02 | 0.06 | 0.02 | 0.00 | 0.04 | 0.06 | -29.53 | 0.07 | -0.03 | 5.00 | 0.29 | 0.33 | 0.00 | 0.26 |
| SEQID-01267 | 0.03 | 0.06 | 0.04 | 0.04 | 0.06 | 0.01 | 0.06 | 0.06 | -20.53 | 0.36 | 0.00 | 5.59 | 0.21 | 0.31 | 0.19 | 0.21 |
| SEQID-01268 | 0.01 | 0.07 | 0.07 | 0.05 | 0.05 | 0.02 | 0.05 | 0.07 | -21.13 | 0.39 | -0.03 | 6.41 | 0.47 | 0.79 | 0.23 | 0.20 |
| SEQID-01269 | 0.02 | 0.04 | 0.04 | 0.04 | 0.04 | 0.00 | 0.04 | 0.05 | -24.71 | 0.37 | -0.01 | 5.10 | 0.19 | 0.35 | 0.19 | 0.00 |
| SEQID-01270 | 0.02 | 0.06 | 0.03 | 0.05 | 0.04 | 0.01 | 0.04 | 0.05 | -27.58 | 0.30 | -0.02 | 4.43 | 0.76 | 0.93 | 0.00 | 0.35 |
| SEQID-01271 | 0.03 | 0.06 | 0.06 | 0.11 | 0.04 | 0.02 | 0.03 | 0.09 | -21.10 | 0.46 | -0.06 | 6.23 | 0.19 | 0.59 | 0.19 | 0.00 |
| SEQID-01272 | 0.02 | 0.02 | 0.02 | 0.09 | 0.05 | 0.00 | 0.05 | 0.04 | -22.42 | 0.06 | -0.01 | 6.36 | 0.18 | 0.32 | 0.00 | 0.20 |
| SEQID-01273 | 0.02 | 0.02 | 0.03 | 0.05 | 0.05 | 0.01 | 0.05 | 0.04 | -23.40 | 0.25 | -0.02 | 4.54 | 0.21 | 0.34 | 0.19 | 0.20 |
| SEQID-01274 | 0.02 | 0.06 | 0.02 | 0.05 | 0.03 | 0.01 | 0.04 | 0.05 | -27.83 | 0.30 | -0.05 | 4.54 | 0.75 | 0.89 | 0.00 | 0.21 |
| SEQID-01275 | 0.01 | 0.05 | 0.02 | 0.05 | 0.07 | 0.06 | 0.06 | 0.01 | -25.21 | 0.03 | -0.07 | 4.34 | 0.27 | 0.33 | 0.23 | 0.22 |

TABLE 1-continued

| | | | | | | | | | | | | | | | | |
|---|---|---|---|---|---|---|---|---|---|---|---|---|---|---|---|---|
| SEQID-01276 | 0.02 | 0.06 | 0.04 | 0.06 | 0.05 | 0.05 | 0.02 | 0.05 | 0.07 | -18.75 | 0.39 | 0.00 | 6.72 | 0.54 | 0.69 | 0.18 | 0.12 |
| SEQID-01277 | 0.01 | 0.03 | 0.06 | 0.05 | 0.03 | 0.03 | 0.03 | 0.03 | 0.06 | -22.75 | 0.33 | 0.02 | 9.34 | 0.20 | 0.38 | 0.00 | 0.00 |
| SEQID-01278 | 0.02 | 0.05 | 0.03 | 0.04 | 0.06 | 0.03 | 0.03 | 0.04 | 0.08 | -23.46 | 0.33 | 0.11 | 10.96 | 0.76 | 0.36 | 0.00 | 0.16 |
| SEQID-01279 | 0.01 | 0.08 | 0.04 | 0.05 | 0.05 | 0.06 | 0.02 | 0.07 | 0.07 | -17.43 | 0.40 | -0.01 | 6.41 | 0.22 | 0.33 | 0.22 | 0.22 |
| SEQID-01280 | 0.03 | 0.05 | 0.04 | 0.05 | 0.07 | 0.04 | 0.01 | 0.04 | 0.06 | -20.24 | 0.42 | -0.02 | 6.13 | 0.22 | 0.33 | 0.00 | 0.21 |
| SEQID-01281 | 0.02 | 0.09 | 0.04 | 0.06 | 0.05 | 0.06 | 0.05 | 0.06 | 0.03 | -23.17 | 0.27 | -0.02 | 5.44 | 0.21 | 0.33 | 0.00 | 0.20 |
| SEQID-01282 | 0.02 | 0.03 | 0.04 | 0.06 | 0.04 | 0.04 | 0.05 | 0.05 | 0.06 | -25.53 | 0.22 | -0.08 | 4.34 | 0.21 | 0.35 | 0.00 | 0.21 |
| SEQID-01283 | 0.01 | 0.04 | 0.03 | 0.06 | 0.05 | 0.05 | 0.01 | 0.04 | 0.07 | -18.54 | 0.48 | 0.01 | 9.50 | 0.22 | 0.36 | 0.00 | 0.22 |
| SEQID-01284 | 0.02 | 0.06 | 0.03 | 0.06 | 0.07 | 0.04 | 0.00 | 0.02 | 0.08 | -21.88 | 0.41 | -0.02 | 5.08 | 0.59 | 0.81 | 0.00 | 0.21 |
| SEQID-01285 | 0.01 | 0.01 | 0.00 | 0.00 | 0.03 | 0.05 | 0.01 | 0.01 | 0.03 | -37.09 | 0.07 | -0.12 | 4.28 | 0.28 | 0.40 | 0.27 | 0.25 |
| SEQID-01286 | 0.05 | 0.05 | 0.04 | 0.06 | 0.05 | 0.05 | 0.02 | 0.05 | 0.06 | -19.01 | 0.47 | -0.02 | 5.43 | 0.20 | 0.30 | 0.00 | 0.20 |
| SEQID-01287 | 0.02 | 0.08 | 0.03 | 0.05 | 0.07 | 0.04 | 0.03 | 0.04 | 0.06 | -17.74 | 0.39 | -0.01 | 6.43 | 0.20 | 0.34 | 0.00 | 0.20 |
| SEQID-01288 | 0.02 | 0.06 | 0.03 | 0.05 | 0.08 | 0.03 | 0.00 | 0.03 | 0.05 | -22.82 | 0.33 | -0.03 | 4.79 | 0.74 | 0.93 | 0.21 | 0.21 |
| SEQID-01289 | 0.02 | 0.05 | 0.05 | 0.04 | 0.06 | 0.04 | 0.04 | 0.04 | 0.05 | -20.52 | 0.37 | 0.01 | 8.25 | 0.19 | 0.33 | 0.00 | 0.11 |
| SEQID-01290 | 0.03 | 0.05 | 0.04 | 0.06 | 0.05 | 0.06 | 0.02 | 0.06 | 0.07 | -20.89 | 0.37 | -0.01 | 6.05 | 0.20 | 0.33 | 0.20 | 0.19 |
| SEQID-01291 | 0.02 | 0.03 | 0.05 | 0.04 | 0.06 | 0.05 | 0.02 | 0.05 | 0.08 | -21.70 | 0.46 | -0.02 | 4.95 | 0.21 | 0.32 | 0.00 | 0.22 |
| SEQID-01292 | 0.03 | 0.05 | 0.04 | 0.04 | 0.07 | 0.02 | 0.02 | 0.05 | 0.07 | -17.32 | 0.48 | -0.01 | 6.40 | 0.20 | 0.32 | 0.00 | 0.21 |
| SEQID-01293 | 0.01 | 0.08 | 0.05 | 0.05 | 0.05 | 0.05 | 0.02 | 0.08 | 0.06 | -20.30 | 0.23 | 0.01 | 6.51 | 0.30 | 0.50 | 0.20 | 0.21 |
| SEQID-01294 | 0.02 | 0.05 | 0.03 | 0.05 | 0.04 | 0.04 | 0.03 | 0.04 | 0.08 | -18.83 | 0.47 | -0.03 | 5.16 | 0.21 | 0.31 | 0.00 | 0.21 |
| SEQID-01295 | 0.03 | 0.05 | 0.05 | 0.04 | 0.05 | 0.04 | 0.01 | 0.05 | 0.05 | -21.84 | 0.41 | -0.02 | 5.10 | 0.21 | 0.33 | 0.00 | 0.22 |
| SEQID-01296 | 0.03 | 0.04 | 0.04 | 0.06 | 0.06 | 0.05 | 0.02 | 0.05 | 0.06 | -18.84 | 0.41 | 0.00 | 6.65 | 0.20 | 0.32 | 0.00 | 0.20 |
| SEQID-01297 | 0.01 | 0.05 | 0.04 | 0.02 | 0.05 | 0.01 | 0.01 | 0.01 | 0.08 | -23.48 | 0.33 | 0.09 | 10.73 | 0.19 | 0.33 | 0.00 | 0.00 |
| SEQID-01298 | 0.01 | 0.03 | 0.04 | 0.07 | 0.04 | 0.04 | 0.01 | 0.01 | 0.03 | -26.76 | 0.21 | -0.09 | 4.26 | 0.22 | 0.33 | 0.00 | 0.24 |
| SEQID-01299 | 0.02 | 0.05 | 0.04 | 0.05 | 0.07 | 0.05 | 0.01 | 0.05 | 0.08 | -18.91 | 0.51 | -0.01 | 5.41 | 0.22 | 0.35 | 0.20 | 0.22 |
| SEQID-01300 | 0.02 | 0.05 | 0.03 | 0.04 | 0.06 | 0.03 | 0.00 | 0.03 | 0.07 | -20.35 | 0.44 | -0.01 | 6.35 | 0.19 | 0.34 | 0.19 | 0.20 |
| SEQID-01301 | 0.03 | 0.05 | 0.04 | 0.05 | 0.06 | 0.06 | 0.02 | 0.03 | 0.06 | -22.18 | 0.42 | -0.01 | 5.91 | 0.20 | 0.34 | 0.19 | 0.19 |
| SEQID-01302 | 0.03 | 0.05 | 0.05 | 0.05 | 0.05 | 0.05 | 0.02 | 0.03 | 0.08 | -20.21 | 0.40 | -0.01 | 6.15 | 0.19 | 0.33 | 0.20 | 0.20 |
| SEQID-01303 | 0.06 | 0.05 | 0.03 | 0.07 | 0.06 | 0.06 | 0.01 | 0.06 | 0.06 | -23.96 | 0.40 | -0.06 | 4.56 | 0.26 | 0.29 | 0.00 | 0.00 |
| SEQID-01304 | 0.02 | 0.06 | 0.04 | 0.04 | 0.06 | 0.02 | 0.01 | 0.02 | 0.06 | -24.23 | 0.28 | 0.10 | 10.63 | 0.23 | 0.32 | 0.00 | 0.00 |
| SEQID-01305 | 0.02 | 0.03 | 0.04 | 0.06 | 0.05 | 0.04 | 0.03 | 0.04 | 0.09 | -16.90 | 0.51 | 0.00 | 6.73 | 0.73 | 0.90 | 0.00 | 0.21 |
| SEQID-01306 | 0.04 | 0.06 | 0.03 | 0.06 | 0.04 | 0.06 | 0.00 | 0.04 | 0.07 | -21.66 | 0.45 | -0.03 | 4.75 | 0.22 | 0.31 | 0.00 | 0.19 |
| SEQID-01307 | 0.01 | 0.02 | 0.00 | 0.21 | 0.21 | 0.00 | 0.00 | 0.15 | 0.01 | -21.89 | 0.01 | -0.06 | 4.06 | 0.23 | 0.43 | 0.23 | 0.26 |
| SEQID-01308 | 0.01 | 0.06 | 0.04 | 0.09 | 0.03 | 0.03 | 0.03 | 0.05 | 0.06 | -20.01 | 0.29 | -0.03 | 5.00 | 0.21 | 0.33 | 0.00 | 0.22 |
| SEQID-01309 | 0.02 | 0.05 | 0.03 | 0.05 | 0.05 | 0.06 | 0.00 | 0.04 | 0.07 | -21.77 | 0.36 | -0.01 | 6.25 | 0.22 | 0.34 | 0.20 | 0.21 |
| SEQID-01310 | 0.01 | 0.04 | 0.05 | 0.07 | 0.04 | 0.06 | 0.01 | 0.06 | 0.07 | -18.68 | 0.38 | -0.01 | 5.39 | 0.22 | 0.33 | 0.22 | 0.22 |
| SEQID-01311 | 0.03 | 0.04 | 0.04 | 0.05 | 0.05 | 0.07 | 0.02 | 0.07 | 0.06 | -15.91 | 0.35 | 0.01 | 7.47 | 0.21 | 0.33 | 0.00 | 0.21 |
| SEQID-01312 | 0.01 | 0.08 | 0.03 | 0.06 | 0.07 | 0.05 | 0.01 | 0.01 | 0.05 | -20.58 | 0.42 | -0.07 | 8.65 | 0.22 | 0.34 | 0.00 | 0.22 |
| SEQID-01313 | 0.03 | 0.06 | 0.02 | 0.05 | 0.04 | 0.05 | 0.02 | 0.01 | 0.05 | -19.18 | 0.46 | 0.03 | 6.60 | 0.21 | 0.33 | 0.00 | 0.22 |
| SEQID-01314 | 0.02 | 0.06 | 0.02 | 0.05 | 0.04 | 0.05 | 0.02 | 0.01 | 0.07 | -17.18 | 0.47 | 0.03 | 10.78 | 0.21 | 0.33 | 0.00 | 0.22 |
| SEQID-01315 | 0.02 | 0.06 | 0.04 | 0.04 | 0.07 | 0.06 | 0.02 | 0.06 | 0.06 | -19.03 | 0.36 | -0.01 | 6.11 | 0.22 | 0.34 | 0.21 | 0.22 |
| SEQID-01316 | 0.02 | 0.07 | 0.05 | 0.05 | 0.07 | 0.04 | 0.01 | 0.06 | 0.07 | -19.19 | 0.43 | 0.00 | 6.05 | 0.19 | 0.34 | 0.00 | 0.22 |
| SEQID-01317 | 0.01 | 0.07 | 0.07 | 0.07 | 0.05 | 0.04 | 0.03 | 0.01 | 0.09 | -19.96 | 0.34 | 0.17 | 5.73 | 0.18 | 0.35 | 0.18 | 0.19 |
| SEQID-01318 | 0.01 | 0.07 | 0.06 | 0.07 | 0.03 | 0.06 | 0.01 | 0.06 | 0.07 | -23.65 | 0.27 | -0.02 | 11.44 | 0.23 | 0.30 | 0.00 | 0.22 |
| SEQID-01319 | 0.02 | 0.04 | 0.03 | 0.06 | 0.03 | 0.05 | 0.02 | 0.05 | 0.09 | -22.45 | 0.39 | 0.01 | 5.15 | 0.00 | 0.45 | 0.00 | 0.00 |
| SEQID-01320 | 0.01 | 0.08 | 0.04 | 0.03 | 0.04 | 0.06 | 0.01 | 0.02 | 0.05 | -29.34 | 0.21 | -0.07 | 9.04 | 0.22 | 0.31 | 0.00 | 0.00 |
| SEQID-01321 | 0.01 | 0.06 | 0.03 | 0.06 | 0.05 | 0.07 | 0.01 | 0.01 | 0.08 | -24.62 | 0.30 | 0.03 | 4.40 | 0.22 | 0.32 | 0.00 | 0.00 |
| SEQID-01322 | 0.02 | 0.06 | 0.02 | 0.05 | 0.04 | 0.05 | 0.01 | 0.01 | 0.09 | -24.64 | 0.30 | 0.03 | 10.75 | 0.24 | 0.32 | 0.00 | 0.22 |
| SEQID-01323 | 0.03 | 0.04 | 0.02 | 0.07 | 0.04 | 0.07 | 0.06 | 0.03 | 0.07 | -17.42 | 0.43 | -0.01 | 10.78 | 0.00 | 0.30 | 0.00 | 0.22 |
| SEQID-01324 | 0.01 | 0.06 | 0.03 | 0.06 | 0.04 | 0.06 | 0.01 | 0.05 | 0.07 | -22.79 | 0.46 | 0.00 | 6.16 | 0.22 | 0.36 | 0.21 | 0.22 |
| SEQID-01325 | 0.02 | 0.05 | 0.03 | 0.06 | 0.06 | 0.07 | 0.02 | 0.02 | 0.08 | -21.39 | 0.39 | -0.01 | 6.05 | 0.20 | 0.34 | 0.00 | 0.22 |
| SEQID-01326 | 0.02 | 0.05 | 0.04 | 0.04 | 0.04 | 0.04 | 0.04 | 0.04 | 0.06 | -21.70 | 0.31 | 0.01 | 5.24 | 0.49 | 0.78 | 0.00 | 0.20 |
| SEQID-01327 | 0.01 | 0.05 | 0.03 | 0.04 | 0.04 | 0.04 | 0.01 | 0.04 | 0.08 | -24.49 | 0.35 | 0.11 | 8.29 | 0.19 | 0.33 | 0.00 | 0.27 |
| SEQID-01328 | 0.01 | 0.04 | 0.06 | 0.04 | 0.07 | 0.07 | 0.02 | 0.02 | 0.08 | -18.01 | 0.47 | 0.08 | 10.81/11.13 | 0.22 | 0.33 | 0.19 | 0.20 |

TABLE 1-continued

| | | | | | | | | | | | | | | | |
|---|---|---|---|---|---|---|---|---|---|---|---|---|---|---|---|
| SEQID-01329 | 0.03 | 0.04 | 0.04 | 0.03 | 0.05 | 0.00 | 0.04 | 0.09 | -22.67 | 0.45 | 0.03 | 9.94 | 0.23 | 0.34 | 0.00 | 0.00 |
| SEQID-01330 | 0.02 | 0.07 | 0.04 | 0.06 | 0.04 | 0.01 | 0.04 | 0.10 | -19.25 | 0.55 | -0.05 | 4.46 | 0.00 | 0.45 | 0.00 | 0.21 |
| SEQID-01331 | 0.01 | 0.05 | 0.05 | 0.06 | 0.04 | 0.02 | 0.06 | 0.07 | -19.89 | 0.43 | -0.01 | 6.52 | 0.27 | 0.34 | 0.00 | 0.21 |
| SEQID-01332 | 0.01 | 0.00 | 0.02 | 0.07 | 0.02 | 0.02 | 0.08 | 0.07 | -23.86 | 0.20 | 0.16 | 5.85 | 0.22 | 0.29 | 0.00 | 0.26 |
| SEQID-01333 | 0.01 | 0.09 | 0.04 | 0.04 | 0.04 | 0.01 | 0.04 | 0.11 | -24.55 | 0.35 | -0.09 | 11.08 | 0.56 | 0.31 | 0.25 | 0.00 |
| SEQID-01334 | 0.05 | 0.07 | 0.03 | 0.03 | 0.03 | 0.01 | 0.06 | 0.08 | -24.22 | 0.34 | 0.14 | 4.17 | 0.23 | 0.61 | 0.00 | 0.00 |
| SEQID-01335 | 0.01 | 0.05 | 0.04 | 0.02 | 0.04 | 0.01 | 0.02 | 0.06 | -25.90 | 0.30 | 0.10 | 11.76 | 0.20 | 0.31 | 0.00 | 0.26 |
| SEQID-01336 | 0.01 | 0.03 | 0.04 | 0.06 | 0.07 | 0.03 | 0.03 | 0.09 | -18.37 | 0.41 | -0.01 | 11.33 | 0.22 | 0.33 | 0.00 | 0.21 |
| SEQID-01337 | 0.03 | 0.05 | 0.03 | 0.04 | 0.07 | 0.02 | 0.06 | 0.06 | -22.66 | 0.39 | -0.04 | 6.08 | 0.21 | 0.32 | 0.18 | 0.21 |
| SEQID-01338 | 0.03 | 0.05 | 0.05 | 0.05 | 0.05 | 0.00 | 0.05 | 0.05 | -22.25 | 0.33 | -0.01 | 4.69 | 0.20 | 0.31 | 0.20 | 0.21 |
| SEQID-01339 | 0.03 | 0.05 | 0.05 | 0.06 | 0.06 | 0.02 | 0.06 | 0.05 | -18.50 | 0.38 | 0.00 | 6.31 | 0.23 | 0.31 | 0.19 | 0.20 |
| SEQID-01340 | 0.02 | 0.07 | 0.04 | 0.05 | 0.05 | 0.02 | 0.07 | 0.01 | -20.27 | 0.35 | 0.00 | 6.59 | 0.20 | 0.35 | 0.19 | 0.22 |
| SEQID-01341 | 0.02 | 0.06 | 0.05 | 0.07 | 0.05 | 0.02 | 0.06 | 0.06 | -17.18 | 0.38 | 0.12 | 7.01 | 0.21 | 0.33 | 0.19 | 0.21 |
| SEQID-01342 | 0.01 | 0.06 | 0.04 | 0.06 | 0.04 | 0.00 | 0.06 | 0.09 | -21.26 | 0.41 | 0.13 | 10.91 | 0.23 | 0.29 | 0.23 | 0.00 |
| SEQID-01343 | 0.01 | 0.03 | 0.02 | 0.04 | 0.06 | 0.00 | 0.06 | 0.07 | -25.42 | 0.31 | 0.13 | 10.52 | 0.23 | 0.35 | 0.00 | 0.27 |
| SEQID-01344 | 0.03 | 0.07 | 0.03 | 0.05 | 0.04 | 0.02 | 0.07 | 0.07 | -23.79 | 0.20 | -0.03 | 10.92 | 0.00 | 0.31 | 0.00 | 0.22 |
| SEQID-01345 | 0.01 | 0.07 | 0.05 | 0.03 | 0.06 | 0.03 | 0.04 | 0.08 | -19.47 | 0.58 | 0.12 | 4.77 | 0.29 | 0.37 | 0.00 | 0.24 |
| SEQID-01346 | 0.01 | 0.03 | 0.04 | 0.05 | 0.04 | 0.01 | 0.04 | 0.07 | -20.01 | 0.36 | -0.06 | 11.68 | 0.23 | 0.34 | 0.22 | 0.00 |
| SEQID-01347 | 0.01 | 0.04 | 0.06 | 0.03 | 0.05 | 0.02 | 0.04 | 0.08 | -20.44 | 0.47 | 0.00 | 4.40 | 0.00 | 0.33 | 0.00 | 0.00 |
| SEQID-01348 | 0.01 | 0.06 | 0.04 | 0.08 | 0.07 | 0.01 | 0.04 | 0.09 | -18.50 | 0.53 | -0.01 | 7.71 | 0.22 | 0.32 | 0.00 | 0.00 |
| SEQID-01349 | 0.02 | 0.05 | 0.05 | 0.04 | 0.04 | 0.01 | 0.05 | 0.07 | -20.33 | 0.50 | -0.03 | 6.12 | 0.23 | 0.36 | 0.00 | 0.22 |
| SEQID-01350 | 0.02 | 0.05 | 0.04 | 0.05 | 0.06 | 0.02 | 0.06 | 0.06 | -21.78 | 0.39 | 0.02 | 4.93 | 0.23 | 0.31 | 0.00 | 0.21 |
| SEQID-01351 | 0.02 | 0.05 | 0.04 | 0.04 | 0.03 | 0.03 | 0.07 | 0.05 | -20.92 | 0.30 | 0.01 | 9.42 | 0.22 | 0.31 | 0.00 | 0.22 |
| SEQID-01352 | 0.01 | 0.06 | 0.05 | 0.04 | 0.05 | 0.02 | 0.07 | 0.05 | -20.99 | 0.27 | 0.01 | 6.53 | 0.22 | 0.31 | 0.00 | 0.21 |
| SEQID-01353 | 0.03 | 0.05 | 0.03 | 0.04 | 0.04 | 0.03 | 0.04 | 0.07 | -18.95 | 0.51 | -0.02 | 6.20 | 0.20 | 0.36 | 0.00 | 0.21 |
| SEQID-01354 | 0.02 | 0.06 | 0.03 | 0.05 | 0.05 | 0.03 | 0.06 | 0.08 | -18.88 | 0.42 | -0.02 | 6.00 | 0.20 | 0.32 | 0.00 | 0.21 |
| SEQID-01355 | 0.02 | 0.08 | 0.04 | 0.03 | 0.03 | 0.03 | 0.07 | 0.07 | -22.02 | 0.40 | -0.09 | 4.13 | 0.26 | 0.51 | 0.00 | 0.22 |
| SEQID-01356 | 0.02 | 0.06 | 0.04 | 0.04 | 0.04 | 0.00 | 0.05 | 0.05 | -25.30 | 0.31 | -0.01 | 6.53 | 0.22 | 0.33 | 0.20 | 0.23 |
| SEQID-01357 | 0.03 | 0.01 | 0.01 | 0.04 | 0.05 | 0.02 | 0.00 | 0.15 | -22.84 | 0.58 | -0.07 | 4.39 | 0.23 | 0.31 | 0.00 | 0.24 |
| SEQID-01358 | 0.02 | 0.10 | 0.06 | 0.05 | 0.05 | 0.01 | 0.05 | 0.09 | -17.80 | 0.34 | 0.01 | 7.57 | 0.73 | 0.90 | 0.00 | 0.26 |
| SEQID-01359 | 0.01 | 0.01 | 0.01 | 0.03 | 0.05 | 0.02 | 0.03 | 0.06 | -28.98 | 0.20 | 0.18 | 11.91 | 0.25 | 0.31 | 0.00 | 0.22 |
| SEQID-01360 | 0.01 | 0.05 | 0.02 | 0.04 | 0.05 | 0.02 | 0.04 | 0.04 | -24.31 | 0.18 | 0.14 | 11.33 | 0.18 | 0.29 | 0.00 | 0.21 |
| SEQID-01361 | 0.01 | 0.06 | 0.05 | 0.03 | 0.04 | 0.00 | 0.02 | 0.08 | -22.96 | 0.37 | 0.06 | 10.53 | 0.19 | 0.30 | 0.00 | 0.24 |
| SEQID-01362 | 0.01 | 0.05 | 0.04 | 0.04 | 0.03 | 0.01 | 0.06 | 0.05 | -21.23 | 0.30 | 0.10 | 10.79 | 0.21 | 0.33 | 0.20 | 0.20 |
| SEQID-01363 | 0.01 | 0.04 | 0.04 | 0.03 | 0.06 | 0.02 | 0.03 | 0.07 | -22.07 | 0.39 | 0.10 | 10.72 | 0.23 | 0.33 | 0.18 | 0.00 |
| SEQID-01364 | 0.01 | 0.10 | 0.03 | 0.04 | 0.05 | 0.03 | 0.03 | 0.05 | -23.63 | 0.37 | -0.03 | 4.88 | 0.00 | 0.32 | 0.00 | 0.23 |
| SEQID-01365 | 0.01 | 0.05 | 0.06 | 0.04 | 0.06 | 0.03 | 0.05 | 0.04 | -22.68 | 0.28 | -0.02 | 5.25 | 0.18 | 0.32 | 0.00 | 0.22 |
| SEQID-01366 | 0.04 | 0.09 | 0.03 | 0.06 | 0.04 | 0.02 | 0.06 | 0.06 | -16.35 | 0.58 | 0.06 | 10.33 | 0.21 | 0.32 | 0.00 | 0.22 |
| SEQID-01367 | 0.01 | 0.06 | 0.04 | 0.04 | 0.05 | 0.01 | 0.08 | 0.04 | -24.70 | 0.29 | 0.00 | 6.81 | 0.22 | 0.32 | 0.00 | 0.23 |
| SEQID-01368 | 0.02 | 0.05 | 0.05 | 0.06 | 0.06 | 0.00 | 0.01 | 0.08 | -19.00 | 0.47 | 0.01 | 8.96 | 0.58 | 0.76 | 0.20 | 0.21 |
| SEQID-01369 | 0.00 | 0.07 | 0.03 | 0.03 | 0.05 | 0.01 | 0.06 | 0.08 | -20.78 | 0.37 | 0.00 | 8.30 | 0.00 | 0.35 | 0.00 | 0.18 |
| SEQID-01370 | 0.01 | 0.05 | 0.04 | 0.04 | 0.07 | 0.01 | 0.04 | 0.07 | -17.38 | 0.42 | -0.01 | 6.51 | 0.23 | 0.32 | 0.00 | 0.25 |
| SEQID-01371 | 0.02 | 0.04 | 0.04 | 0.03 | 0.06 | 0.02 | 0.07 | 0.06 | -20.40 | 0.42 | -0.02 | 4.87 | 0.21 | 0.34 | 0.20 | 0.00 |
| SEQID-01372 | 0.02 | 0.06 | 0.03 | 0.08 | 0.05 | 0.03 | 0.03 | 0.07 | -17.92 | 0.37 | 0.00 | 7.35 | 0.21 | 0.34 | 0.00 | 0.23 |
| SEQID-01373 | 0.03 | 0.06 | 0.04 | 0.05 | 0.04 | 0.03 | 0.05 | 0.05 | -19.21 | 0.48 | 0.00 | 7.32 | 0.20 | 0.33 | 0.21 | 0.22 |
| SEQID-01374 | 0.03 | 0.06 | 0.04 | 0.04 | 0.04 | 0.01 | 0.03 | 0.07 | -19.45 | 0.41 | -0.02 | 5.08 | 0.49 | 0.60 | 0.00 | 0.22 |
| SEQID-01375 | 0.02 | 0.06 | 0.04 | 0.06 | 0.05 | 0.01 | 0.05 | 0.06 | -20.98 | 0.35 | 0.01 | 7.50 | 0.21 | 0.31 | 0.00 | 0.23 |
| SEQID-01376 | 0.03 | 0.06 | 0.04 | 0.05 | 0.06 | 0.02 | 0.04 | 0.07 | -18.69 | 0.42 | 0.01 | 3.01 | 0.20 | 0.32 | 0.20 | 0.21 |
| SEQID-01377 | 0.03 | 0.05 | 0.04 | 0.04 | 0.06 | 0.02 | 0.04 | 0.06 | -20.70 | 0.39 | -0.02 | 5.11 | 0.18 | 0.37 | 0.18 | 0.19 |
| SEQID-01378 | 0.01 | 0.05 | 0.04 | 0.04 | 0.07 | 0.00 | 0.02 | 0.08 | -16.90 | 0.49 | 0.08 | 9.51 | 0.29 | 0.29 | 0.28 | 0.29 |
| SEQID-01379 | 0.01 | 0.07 | 0.02 | 0.02 | 0.11 | 0.00 | 0.04 | 0.10 | -26.89 | 0.28 | 0.14 | 11.20 | 0.24 | 0.32 | 0.00 | 0.21 |
| SEQID-01380 | 0.03 | 0.05 | 0.02 | 0.05 | 0.03 | 0.01 | 0.04 | 0.07 | -19.88 | 0.52 | 0.08 | 10.55 | 0.23 | 0.33 | 0.20 | 0.23 |
| SEQID-01381 | 0.03 | 0.03 | 0.03 | 0.05 | 0.03 | 0.00 | 0.02 | 0.09 | -21.31 | 0.33 | 0.08 | 11.20 | 0.27 | 0.33 | 0.18 | 0.26 |

TABLE 1-continued

| | | | | | | | | | | | | | | | |
|---|---|---|---|---|---|---|---|---|---|---|---|---|---|---|---|
| SEQID-01382 | 0.02 | 0.06 | 0.03 | 0.06 | 0.04 | 0.04 | 0.03 | 0.03 | 0.32 | 0.02 | -22.43 | 9.05 | 0.23 | 0.30 | 0.00 | 0.00 |
| SEQID-01383 | 0.03 | 0.04 | 0.03 | 0.04 | 0.04 | 0.04 | 0.07 | 0.09 | 0.27 | 0.13 | -21.66 | 11.00 | 0.20 | 0.30 | 0.00 | 0.24 |
| SEQID-01384 | 0.01 | 0.09 | 0.07 | 0.05 | 0.01 | 0.01 | 0.04 | 0.01 | 0.17 | 0.01 | -12.40 | 7.89 | 0.32 | 0.46 | 0.25 | 0.33 |
| SEQID-01385 | 0.01 | 0.05 | 0.04 | 0.05 | 0.03 | 0.00 | 0.04 | 0.05 | 0.27 | 0.08 | -27.28 | 10.72 | 0.23 | 0.33 | 0.00 | 0.00 |
| SEQID-01386 | 0.04 | 0.05 | 0.05 | 0.07 | 0.05 | 0.02 | 0.03 | 0.07 | 0.53 | 0.01 | -18.11 | 8.21 | 0.23 | 0.31 | 0.00 | 0.22 |
| SEQID-01387 | 0.01 | 0.09 | 0.05 | 0.04 | 0.07 | 0.01 | 0.04 | 0.05 | 0.38 | -0.02 | -21.39 | 5.14 | 0.62 | 0.74 | 0.20 | 0.00 |
| SEQID-01388 | 0.00 | 0.03 | 0.04 | 0.06 | 0.06 | 0.01 | 0.05 | 0.07 | 0.10 | 0.04 | -27.26 | 10.39 | 0.21 | 0.33 | 0.22 | 0.00 |
| SEQID-01389 | 0.02 | 0.10 | 0.05 | 0.04 | 0.04 | 0.02 | 0.04 | 0.05 | 0.41 | 0.02 | -20.63 | 9.11 | 0.22 | 0.31 | 0.00 | 0.00 |
| SEQID-01390 | 0.03 | 0.05 | 0.03 | 0.05 | 0.05 | 0.00 | 0.06 | 0.06 | 0.37 | -0.01 | -23.89 | 6.33 | 0.23 | 0.32 | 0.00 | 0.21 |
| SEQID-01391 | 0.02 | 0.07 | 0.04 | 0.05 | 0.05 | 0.01 | 0.04 | 0.08 | 0.53 | 0.01 | -16.70 | 8.14 | 0.22 | 0.33 | 0.20 | 0.21 |
| SEQID-01392 | 0.02 | 0.04 | 0.03 | 0.04 | 0.04 | 0.01 | 0.03 | 0.09 | 0.54 | 0.00 | -17.38 | 7.46 | 0.22 | 0.34 | 0.22 | 0.21 |
| SEQID-01393 | 0.02 | 0.05 | 0.03 | 0.06 | 0.06 | 0.01 | 0.08 | 0.06 | 0.33 | 0.01 | -20.13 | 8.32 | 0.20 | 0.33 | 0.00 | 0.22 |
| SEQID-01394 | 0.03 | 0.06 | 0.04 | 0.04 | 0.04 | 0.03 | 0.04 | 0.05 | 0.39 | -0.01 | -20.20 | 6.61 | 0.19 | 0.33 | 0.20 | 0.20 |
| SEQID-01395 | 0.01 | 0.05 | 0.05 | 0.06 | 0.06 | 0.03 | 0.06 | 0.07 | 0.44 | -0.01 | -19.55 | 6.60 | 0.20 | 0.34 | 0.00 | 0.21 |
| SEQID-01396 | 0.03 | 0.04 | 0.04 | 0.04 | 0.04 | 0.01 | 0.03 | 0.07 | 0.38 | -0.05 | -23.63 | 4.56 | 0.20 | 0.33 | 0.00 | 0.21 |
| SEQID-01397 | 0.03 | 0.02 | 0.02 | 0.06 | 0.06 | 0.01 | 0.03 | 0.04 | 0.19 | -0.01 | -26.82 | 6.26 | 0.19 | 0.35 | 0.00 | 0.20 |
| SEQID-01398 | 0.02 | 0.05 | 0.05 | 0.05 | 0.05 | 0.02 | 0.04 | 0.05 | 0.35 | -0.01 | -18.87 | 6.61 | 0.18 | 0.35 | 0.19 | 0.20 |
| SEQID-01399 | 0.03 | 0.05 | 0.04 | 0.06 | 0.05 | 0.01 | 0.05 | 0.08 | 0.45 | -0.02 | -19.41 | 5.60 | 0.19 | 0.36 | 0.18 | 0.19 |
| SEQID-01400 | 0.03 | 0.06 | 0.02 | 0.04 | 0.04 | 0.00 | 0.02 | 0.03 | 0.09 | 0.07 | -29.69 | 10.79 | 0.27 | 0.36 | 0.00 | 0.31 |
| SEQID-01401 | 0.03 | 0.08 | 0.04 | 0.03 | 0.03 | 0.08 | 0.05 | 0.04 | 0.20 | -0.04 | -23.31 | 5.02 | 0.26 | 0.28 | 0.00 | 0.25 |
| SEQID-01402 | 0.01 | 0.06 | 0.02 | 0.06 | 0.07 | 0.00 | 0.05 | 0.07 | 0.35 | -0.03 | -22.73 | 4.74 | 0.26 | 0.33 | 0.25 | 0.27 |
| SEQID-01403 | 0.01 | 0.02 | 0.03 | 0.07 | 0.02 | 0.00 | 0.03 | 0.08 | 0.33 | 0.14 | -26.26 | 11.18 | 0.25 | 0.31 | 0.24 | 0.00 |
| SEQID-01404 | 0.02 | 0.02 | 0.02 | 0.05 | 0.05 | 0.00 | 0.05 | 0.06 | 0.28 | 0.13 | -26.18 | 11.15 | 0.24 | 0.31 | 0.26 | 0.00 |
| SEQID-01405 | 0.02 | 0.05 | 0.06 | 0.06 | 0.07 | 0.02 | 0.05 | 0.06 | 0.26 | 0.00 | -20.21 | 6.92 | 0.22 | 0.32 | 0.00 | 0.20 |
| SEQID-01406 | 0.01 | 0.08 | 0.04 | 0.04 | 0.04 | 0.00 | 0.08 | 0.06 | 0.22 | -0.01 | -26.17 | 5.86 | 0.25 | 0.31 | 0.19 | 0.25 |
| SEQID-01407 | 0.04 | 0.03 | 0.03 | 0.05 | 0.05 | 0.03 | 0.06 | 0.03 | 0.09 | 0.03 | -21.91 | 7.88 | 0.25 | 0.31 | 0.28 | 0.26 |
| SEQID-01408 | 0.01 | 0.07 | 0.02 | 0.04 | 0.05 | 0.00 | 0.04 | 0.04 | 0.17 | 0.22 | -29.09 | 11.90 | 0.17 | 0.33 | 0.21 | 0.26 |
| SEQID-01409 | 0.01 | 0.05 | 0.04 | 0.06 | 0.06 | 0.04 | 0.05 | 0.10 | 0.45 | -0.03 | -17.79 | 4.78 | 0.37 | 0.44 | 0.00 | 0.20 |
| SEQID-01410 | 0.01 | 0.04 | 0.02 | 0.05 | 0.05 | 0.02 | 0.05 | 0.06 | 0.18 | 0.13 | -21.71 | 11.53 | 0.20 | 0.32 | 0.00 | 0.23 |
| SEQID-01411 | 0.01 | 0.06 | 0.04 | 0.06 | 0.06 | 0.00 | 0.02 | 0.08 | 0.43 | 0.17 | -21.92 | 12.23 | 0.21 | 0.31 | 0.00 | 0.25 |
| SEQID-01412 | 0.02 | 0.05 | 0.02 | 0.04 | 0.03 | 0.00 | 0.05 | 0.12 | 0.33 | 0.06 | -22.05 | 10.34 | 0.23 | 0.30 | 0.26 | 0.22 |
| SEQID-01413 | 0.01 | 0.06 | 0.03 | 0.03 | 0.03 | 0.04 | 0.05 | 0.05 | 0.33 | 0.01 | -17.44 | 8.87 | 0.48 | 0.55 | 0.00 | 0.20 |
| SEQID-01414 | 0.01 | 0.05 | 0.05 | 0.04 | 0.04 | 0.00 | 0.03 | 0.07 | 0.28 | 0.12 | -27.84 | 11.14 | 0.20 | 0.31 | 0.00 | 0.00 |
| SEQID-01415 | 0.02 | 0.02 | 0.03 | 0.04 | 0.04 | 0.03 | 0.04 | 0.03 | 0.14 | -0.06 | -28.18 | 4.54 | 0.23 | 0.33 | 0.00 | 0.22 |
| SEQID-01416 | 0.01 | 0.06 | 0.04 | 0.05 | 0.04 | 0.00 | 0.04 | 0.05 | 0.35 | 0.00 | -20.77 | 7.09 | 0.21 | 0.31 | 0.00 | 0.18 |
| SEQID-01417 | 0.03 | 0.05 | 0.03 | 0.06 | 0.06 | 0.00 | 0.04 | 0.05 | 0.23 | -0.04 | -23.05 | 4.62 | 0.23 | 0.33 | 0.00 | 0.00 |
| SEQID-01418 | 0.03 | 0.04 | 0.04 | 0.06 | 0.08 | 0.01 | 0.04 | 0.06 | 0.40 | 0.02 | -19.66 | 9.54 | 0.00 | 0.33 | 0.00 | 0.22 |
| SEQID-01419 | 0.02 | 0.04 | 0.05 | 0.04 | 0.06 | 0.02 | 0.04 | 0.10 | 0.49 | -0.01 | -19.31 | 6.27 | 0.22 | 0.32 | 0.21 | 0.20 |
| SEQID-01420 | 0.01 | 0.05 | 0.03 | 0.05 | 0.05 | 0.01 | 0.04 | 0.07 | 0.45 | 0.00 | -16.80 | 9.01 | 0.00 | 0.31 | 0.20 | 0.21 |
| SEQID-01421 | 0.03 | 0.05 | 0.05 | 0.04 | 0.04 | 0.02 | 0.04 | 0.09 | 0.50 | -0.01 | -19.36 | 6.55 | 0.21 | 0.33 | 0.00 | 0.26 |
| SEQID-01422 | 0.02 | 0.05 | 0.04 | 0.07 | 0.07 | 0.02 | 0.05 | 0.05 | 0.40 | 0.03 | -20.93 | 9.71 | 0.22 | 0.33 | 0.00 | 0.23 |
| SEQID-01423 | 0.01 | 0.08 | 0.04 | 0.06 | 0.06 | 0.02 | 0.08 | 0.04 | 0.41 | -0.05 | -17.98 | 4.45 | 0.37 | 0.54 | 0.00 | 0.25 |
| SEQID-01424 | 0.02 | 0.07 | 0.05 | 0.03 | 0.03 | 0.04 | 0.06 | 0.06 | 0.41 | 0.01 | -22.06 | 8.13 | 0.21 | 0.35 | 0.00 | 0.21 |
| SEQID-01425 | 0.02 | 0.05 | 0.03 | 0.06 | 0.06 | 0.01 | 0.05 | 0.05 | 0.40 | -0.01 | -20.51 | 6.21 | 0.21 | 0.33 | 0.00 | 0.21 |
| SEQID-01426 | 0.05 | 0.05 | 0.03 | 0.06 | 0.06 | 0.01 | 0.04 | 0.06 | 0.46 | 0.00 | -17.68 | 7.46 | 0.20 | 0.34 | 0.21 | 0.22 |
| SEQID-01427 | 0.03 | 0.06 | 0.05 | 0.05 | 0.05 | 0.02 | 0.04 | 0.06 | 0.32 | -0.04 | -20.62 | 6.77 | 0.20 | 0.32 | 0.20 | 0.21 |
| SEQID-01428 | 0.02 | 0.07 | 0.04 | 0.04 | 0.04 | 0.01 | 0.04 | 0.08 | 0.36 | 0.00 | -20.04 | 4.95 | 0.21 | 0.31 | 0.00 | 0.26 |
| SEQID-01429 | 0.02 | 0.05 | 0.02 | 0.05 | 0.05 | 0.02 | 0.06 | 0.05 | 0.19 | -0.01 | -24.14 | 7.83 | 0.20 | 0.34 | 0.00 | 0.21 |
| SEQID-01430 | 0.03 | 0.03 | 0.04 | 0.03 | 0.04 | 0.01 | 0.06 | 0.03 | 0.21 | -0.02 | -25.39 | 5.26 | 0.21 | 0.34 | 0.00 | 0.21 |
| SEQID-01431 | 0.03 | 0.04 | 0.05 | 0.04 | 0.05 | 0.02 | 0.05 | 0.06 | 0.35 | 0.01 | -19.82 | 7.53 | 0.19 | 0.35 | 0.00 | 0.19 |
| SEQID-01432 | 0.03 | 0.05 | 0.05 | 0.05 | 0.07 | 0.01 | 0.03 | 0.09 | 0.51 | -0.03 | -17.16 | 4.89 | 0.28 | 0.31 | 0.00 | 0.21 |
| SEQID-01433 | 0.02 | 0.09 | 0.01 | 0.02 | 0.03 | 0.03 | 0.05 | 0.01 | 0.10 | 0.16 | -24.24 | 10.56 | 0.28 | 0.20 | 0.34 | 0.32 |
| SEQID-01434 | 0.01 | 0.03 | 0.01 | 0.05 | 0.05 | 0.00 | 0.06 | 0.07 | 0.28 | 0.18 | -23.87 | 11.91 | 0.28 | 0.32 | 0.00 | 0.27 |

TABLE 1-continued

| | | | | | | | | | | | | | | | | |
|---|---|---|---|---|---|---|---|---|---|---|---|---|---|---|---|---|
| SEQID-01435 | 0.05 | 0.07 | 0.03 | 0.07 | 0.04 | 0.04 | 0.02 | 0.06 | 0.11 | −18.32 | 0.50 | −0.03 | 4.54 | 0.42 | 0.50 | 0.00 | 0.21 |
| SEQID-01436 | 0.01 | 0.06 | 0.08 | 0.05 | 0.06 | 0.06 | 0.04 | 0.04 | 0.09 | −16.92 | 0.35 | −0.01 | 5.83 | 0.26 | 0.32 | 0.22 | 0.33 |
| SEQID-01437 | 0.04 | 0.04 | 0.04 | 0.09 | 0.02 | 0.02 | 0.01 | 0.05 | 0.06 | −25.69 | 0.12 | 0.00 | 6.81 | 0.25 | 0.29 | 0.00 | 0.20 |
| SEQID-01438 | 0.02 | 0.02 | 0.03 | 0.12 | 0.08 | 0.01 | 0.00 | 0.06 | 0.05 | −22.27 | 0.21 | 0.11 | 10.74 | 0.24 | 0.29 | 0.22 | 0.25 |
| SEQID-01439 | 0.02 | 0.01 | 0.03 | 0.04 | 0.07 | 0.01 | 0.01 | 0.02 | 0.10 | −23.95 | 0.29 | 0.05 | 10.21 | 0.25 | 0.29 | 0.00 | 0.00 |
| SEQID-01440 | 0.02 | 0.04 | 0.03 | 0.05 | 0.05 | 0.03 | 0.01 | 0.03 | 0.06 | −23.29 | 0.31 | 0.19 | 11.79 | 0.21 | 0.31 | 0.00 | 0.23 |
| SEQID-01441 | 0.03 | 0.08 | 0.01 | 0.06 | 0.07 | 0.06 | 0.06 | 0.05 | 0.05 | −22.02 | 0.27 | 0.01 | 8.81 | 0.24 | 0.29 | 0.24 | 0.23 |
| SEQID-01442 | 0.02 | 0.03 | 0.03 | 0.04 | 0.05 | 0.05 | 0.01 | 0.01 | 0.10 | −20.71 | 0.50 | 0.14 | 11.62 | 0.23 | 0.32 | 0.24 | 0.00 |
| SEQID-01443 | 0.02 | 0.07 | 0.02 | 0.09 | 0.05 | 0.05 | 0.01 | 0.07 | 0.07 | −22.98 | 0.32 | −0.03 | 4.81 | 0.23 | 0.30 | 0.00 | 0.20 |
| SEQID-01444 | 0.07 | 0.06 | 0.05 | 0.04 | 0.05 | 0.05 | 0.00 | 0.04 | 0.07 | −20.84 | 0.29 | 0.11 | 11.34 | 0.00 | 0.28 | 0.00 | 0.25 |
| SEQID-01445 | 0.01 | 0.03 | 0.06 | 0.05 | 0.03 | 0.03 | 0.00 | 0.02 | 0.07 | −22.28 | 0.39 | 0.04 | 10.10 | 0.22 | 0.34 | 0.24 | 0.25 |
| SEQID-01446 | 0.02 | 0.01 | 0.00 | 0.07 | 0.02 | 0.03 | 0.02 | 0.03 | 0.01 | −36.22 | 0.05 | −0.12 | 4.18 | 0.32 | 0.38 | 0.22 | 0.27 |
| SEQID-01447 | 0.03 | 0.05 | 0.02 | 0.04 | 0.06 | 0.04 | 0.01 | 0.04 | 0.08 | −24.67 | 0.26 | 0.07 | 10.55 | 0.22 | 0.31 | 0.00 | 0.24 |
| SEQID-01448 | 0.02 | 0.08 | 0.03 | 0.07 | 0.06 | 0.09 | 0.03 | 0.09 | 0.06 | −14.24 | 0.78 | 0.02 | 9.33 | 0.22 | 0.30 | 0.00 | 0.00 |
| SEQID-01449 | 0.01 | 0.06 | 0.06 | 0.05 | 0.03 | 0.05 | 0.03 | 0.05 | 0.06 | −17.40 | 0.41 | 0.00 | 6.97 | 0.20 | 0.35 | 0.00 | 0.20 |
| SEQID-01450 | 0.03 | 0.03 | 0.03 | 0.07 | 0.02 | 0.02 | 0.03 | 0.06 | 0.07 | −30.33 | 0.30 | −0.12 | 4.11 | 0.00 | 0.31 | 0.00 | 0.22 |
| SEQID-01451 | 0.01 | 0.06 | 0.03 | 0.05 | 0.04 | 0.06 | 0.01 | 0.02 | 0.03 | −22.94 | 0.32 | 0.15 | 11.21 | 0.00 | 0.32 | 0.00 | 0.00 |
| SEQID-01452 | 0.02 | 0.07 | 0.03 | 0.06 | 0.04 | 0.02 | 0.03 | 0.03 | 0.05 | −25.66 | 0.28 | −0.11 | 4.05 | 0.54 | 0.78 | 0.22 | 0.23 |
| SEQID-01453 | 0.03 | 0.03 | 0.04 | 0.04 | 0.06 | 0.04 | 0.04 | 0.04 | 0.08 | −23.36 | 0.37 | −0.02 | 6.23 | 0.23 | 0.31 | 0.20 | 0.00 |
| SEQID-01454 | 0.02 | 0.07 | 0.05 | 0.02 | 0.05 | 0.05 | 0.02 | 0.07 | 0.07 | −20.72 | 0.37 | −0.01 | 6.52 | 0.21 | 0.30 | 0.00 | 0.00 |
| SEQID-01455 | 0.00 | 0.07 | 0.02 | 0.05 | 0.03 | 0.04 | 0.01 | 0.01 | 0.02 | −33.66 | 0.11 | −0.13 | 4.03 | 0.23 | 0.32 | 0.00 | 0.21 |
| SEQID-01456 | 0.03 | 0.04 | 0.02 | 0.03 | 0.04 | 0.04 | 0.01 | 0.04 | 0.03 | −20.05 | 0.44 | 0.02 | 9.63 | 0.21 | 0.33 | 0.00 | 0.00 |
| SEQID-01457 | 0.01 | 0.07 | 0.05 | 0.05 | 0.03 | 0.03 | 0.03 | 0.05 | 0.06 | −22.23 | 0.41 | −0.01 | 6.05 | 0.22 | 0.33 | 0.20 | 0.00 |
| SEQID-01458 | 0.01 | 0.05 | 0.04 | 0.07 | 0.06 | 0.03 | 0.01 | 0.03 | 0.05 | −23.62 | 0.34 | −0.01 | 5.74 | 0.21 | 0.34 | 0.00 | 0.21 |
| SEQID-01459 | 0.02 | 0.07 | 0.04 | 0.05 | 0.05 | 0.05 | 0.03 | 0.06 | 0.03 | −17.88 | 0.50 | −0.03 | 4.77 | 0.00 | 0.32 | 0.00 | 0.21 |
| SEQID-01460 | 0.03 | 0.03 | 0.04 | 0.06 | 0.05 | 0.06 | 0.01 | 0.03 | 0.06 | −18.90 | 0.42 | 0.00 | 6.94 | 0.21 | 0.33 | 0.00 | 0.21 |
| SEQID-01461 | 0.01 | 0.04 | 0.05 | 0.05 | 0.04 | 0.04 | 0.03 | 0.05 | 0.07 | −15.76 | 0.57 | 0.00 | 6.71 | 0.22 | 0.34 | 0.00 | 0.21 |
| SEQID-01462 | 0.02 | 0.06 | 0.03 | 0.04 | 0.06 | 0.07 | 0.04 | 0.01 | 0.08 | −19.62 | 0.49 | 0.00 | 6.76 | 0.29 | 0.40 | 0.22 | 0.23 |
| SEQID-01463 | 0.04 | 0.05 | 0.04 | 0.04 | 0.04 | 0.05 | 0.03 | 0.03 | 0.04 | −21.36 | 0.25 | −0.01 | 6.29 | 0.20 | 0.30 | 0.00 | 0.20 |
| SEQID-01464 | 0.02 | 0.05 | 0.03 | 0.04 | 0.04 | 0.05 | 0.00 | 0.00 | 0.08 | −20.94 | 0.43 | 0.02 | 8.22 | 0.22 | 0.36 | 0.00 | 0.21 |
| SEQID-01465 | 0.03 | 0.06 | 0.03 | 0.05 | 0.05 | 0.03 | 0.02 | 0.03 | 0.06 | −21.35 | 0.43 | −0.01 | 6.39 | 0.21 | 0.31 | 0.00 | 0.21 |
| SEQID-01466 | 0.02 | 0.08 | 0.04 | 0.05 | 0.06 | 0.05 | 0.02 | 0.06 | 0.07 | −19.43 | 0.41 | 0.01 | 5.42 | 0.50 | 0.70 | 0.18 | 0.21 |
| SEQID-01467 | 0.01 | 0.04 | 0.03 | 0.06 | 0.03 | 0.03 | 0.02 | 0.05 | 0.06 | −22.02 | 0.39 | 0.00 | 6.65 | 0.21 | 0.35 | 0.00 | 0.22 |
| SEQID-01468 | 0.01 | 0.04 | 0.10 | 0.07 | 0.03 | 0.02 | 0.05 | 0.03 | 0.06 | −27.18 | 0.16 | −0.08 | 4.31 | 0.21 | 0.36 | 0.19 | 0.23 |
| SEQID-01469 | 0.02 | 0.08 | 0.04 | 0.06 | 0.06 | 0.05 | 0.05 | 0.07 | 0.03 | −23.56 | 0.24 | −0.03 | 5.13 | 0.21 | 0.36 | 0.00 | 0.20 |
| SEQID-01470 | 0.01 | 0.06 | 0.03 | 0.07 | 0.05 | 0.01 | 0.03 | 0.05 | 0.05 | −23.15 | 0.32 | −0.02 | 6.36 | 0.42 | 0.89 | 0.20 | 0.21 |
| SEQID-01471 | 0.02 | 0.04 | 0.05 | 0.05 | 0.04 | 0.00 | 0.00 | 0.07 | 0.08 | −19.05 | 0.43 | −0.01 | 6.67 | 0.20 | 0.32 | 0.00 | 0.21 |
| SEQID-01472 | 0.02 | 0.06 | 0.05 | 0.05 | 0.06 | 0.02 | 0.03 | 0.03 | 0.06 | −21.68 | 0.36 | −0.02 | 5.69 | 0.20 | 0.34 | 0.00 | 0.21 |
| SEQID-01473 | 0.04 | 0.05 | 0.04 | 0.05 | 0.04 | 0.00 | 0.02 | 0.03 | 0.05 | −25.57 | 0.35 | 0.01 | 8.24 | 0.20 | 0.34 | 0.43 | 0.22 |
| SEQID-01474 | 0.03 | 0.05 | 0.03 | 0.09 | 0.10 | 0.03 | 0.00 | 0.10 | 0.10 | −14.48 | 0.26 | 0.06 | 10.19 | 0.30 | 0.40 | 0.00 | 0.34 |
| SEQID-01475 | 0.02 | 0.02 | 0.03 | 0.04 | 0.06 | 0.02 | 0.00 | 0.06 | 0.03 | −27.25 | 0.23 | −0.04 | 6.80 | 0.32 | 0.23 | 0.00 | 1.00 |
| SEQID-01476 | 0.03 | 0.05 | 0.02 | 0.00 | 0.09 | 0.06 | 0.02 | 0.09 | 0.08 | −21.28 | 0.30 | 0.19 | 11.06 | 0.26 | 0.29 | 0.23 | 0.23 |
| SEQID-01477 | 0.02 | 0.03 | 0.02 | 0.05 | 0.06 | 0.06 | 0.00 | 0.06 | 0.08 | −17.20 | 0.58 | 0.08 | 10.35 | 0.25 | 0.30 | 0.00 | 0.23 |
| SEQID-01478 | 0.02 | 0.02 | 0.03 | 0.02 | 0.04 | 0.04 | 0.00 | 0.05 | 0.06 | −21.71 | 0.38 | −0.02 | 4.72 | 0.22 | 0.30 | 0.00 | 0.25 |
| SEQID-01479 | 0.02 | 0.00 | 0.00 | 0.07 | 0.03 | 0.05 | 0.02 | 0.05 | 0.05 | −24.75 | 0.38 | −0.05 | 11.02 | 0.22 | 0.26 | 0.00 | 0.24 |
| SEQID-01480 | 0.04 | 0.05 | 0.04 | 0.06 | 0.04 | 0.06 | 0.02 | 0.04 | 0.10 | −16.44 | 0.61 | 0.15 | 5.10 | 0.24 | 0.36 | 0.20 | 0.00 |
| SEQID-01481 | 0.03 | 0.05 | 0.05 | 0.09 | 0.05 | 0.05 | 0.01 | 0.04 | 0.08 | −21.68 | 0.30 | −0.03 | 4.57 | 0.24 | 0.29 | 0.24 | 0.25 |
| SEQID-01482 | 0.02 | 0.03 | 0.03 | 0.04 | 0.03 | 0.02 | 0.01 | 0.07 | 0.03 | −22.78 | 0.33 | −0.04 | 5.70 | 0.24 | 0.32 | 0.00 | 0.34 |
| SEQID-01483 | 0.02 | 0.03 | 0.05 | 0.05 | 0.03 | 0.03 | 0.01 | 0.06 | 0.07 | −22.48 | 0.28 | −0.02 | 10.19 | 0.23 | 0.31 | 0.00 | 0.00 |
| SEQID-01484 | 0.02 | 0.03 | 0.03 | 0.03 | 0.01 | 0.03 | 0.01 | 0.08 | 0.07 | −22.18 | 0.26 | 0.04 | 10.12 | 0.00 | 0.31 | 0.27 | 0.24 |
| SEQID-01485 | 0.03 | 0.02 | 0.04 | 0.04 | 0.06 | 0.04 | 0.00 | 0.04 | 0.09 | −27.22 | 0.22 | 0.13 | 10.75 | 0.21 | 0.31 | 0.22 | 0.00 |
| SEQID-01486 | 0.02 | 0.02 | 0.02 | 0.07 | 0.03 | 0.03 | 0.02 | 0.07 | 0.05 | −20.48 | 0.39 | −0.08 | 4.33 | 0.24 | 0.29 | 0.26 | 0.27 |
| SEQID-01487 | 0.03 | 0.02 | 0.04 | 0.06 | 0.08 | 0.03 | 0.03 | 0.06 | 0.08 | −19.96 | 0.23 | −0.06 | 4.38 | 0.00 | 0.30 | 0.00 | 0.24 |

TABLE 1-continued

| | | | | | | | | | | | | | | |
|---|---|---|---|---|---|---|---|---|---|---|---|---|---|---|
| SEQID-01488 | 0.01 | 0.05 | 0.08 | 0.02 | 0.05 | 0.00 | 0.06 | 0.07 | -19.31 | 0.54 | -0.08 | 4.08 | 0.00 | 0.33 | 0.00 | 0.22 | 0.24 |
| SEQID-01489 | 0.01 | 0.08 | 0.03 | 0.02 | 0.06 | 0.00 | 0.04 | 0.07 | -29.68 | 0.20 | -0.04 | 6.14 | 0.00 | 0.31 | 0.00 | 0.18 |
| SEQID-01490 | 0.03 | 0.06 | 0.04 | 0.06 | 0.05 | 0.00 | 0.01 | 0.05 | -20.53 | 0.46 | -0.06 | 4.45 | 0.21 | 0.32 | 0.21 | 0.21 |
| SEQID-01491 | 0.02 | 0.11 | 0.05 | 0.06 | 0.07 | 0.04 | 0.07 | 0.05 | -12.60 | 0.73 | 0.04 | 9.74 | 0.00 | 0.31 | 0.00 | 0.22 |
| SEQID-01492 | 0.01 | 0.06 | 0.04 | 0.05 | 0.05 | 0.02 | 0.07 | 0.05 | -20.65 | 0.33 | -0.01 | 6.07 | 0.19 | 0.30 | 0.00 | 0.00 |
| SEQID-01493 | 0.02 | 0.08 | 0.04 | 0.05 | 0.04 | 0.06 | 0.06 | 0.04 | -22.18 | 0.31 | 0.00 | 6.84 | 0.32 | 0.43 | 0.00 | 0.00 |
| SEQID-01494 | 0.02 | 0.04 | 0.06 | 0.06 | 0.05 | 0.02 | 0.02 | 0.07 | -19.30 | 0.51 | -0.02 | 5.48 | 0.00 | 0.33 | 0.00 | 0.20 |
| SEQID-01495 | 0.05 | 0.10 | 0.03 | 0.05 | 0.04 | 0.02 | 0.07 | 0.03 | -23.42 | 0.33 | -0.03 | 4.86 | 0.19 | 0.32 | 0.00 | 0.21 |
| SEQID-01496 | 0.02 | 0.04 | 0.04 | 0.05 | 0.06 | 0.00 | 0.04 | 0.07 | -19.57 | 0.43 | 0.01 | 8.18 | 0.19 | 0.33 | 0.00 | 0.20 |
| SEQID-01497 | 0.02 | 0.06 | 0.02 | 0.05 | 0.04 | 0.02 | 0.08 | 0.05 | -23.62 | 0.41 | -0.02 | 5.11 | 0.22 | 0.33 | 0.00 | 0.19 |
| SEQID-01498 | 0.02 | 0.05 | 0.04 | 0.04 | 0.04 | 0.03 | 0.07 | 0.06 | -22.22 | 0.37 | -0.01 | 6.62 | 0.21 | 0.31 | 0.00 | 0.21 |
| SEQID-01499 | 0.01 | 0.03 | 0.08 | 0.05 | 0.04 | 0.00 | 0.09 | 0.04 | -24.80 | 0.18 | -0.05 | 4.73 | 0.21 | 0.36 | 0.00 | 0.22 |
| SEQID-01500 | 0.02 | 0.05 | 0.04 | 0.04 | 0.04 | 0.01 | 0.04 | 0.06 | -23.45 | 0.41 | 0.00 | 7.50 | 0.22 | 0.36 | 0.00 | 0.23 |
| SEQID-01501 | 0.02 | 0.05 | 0.06 | 0.03 | 0.07 | 0.03 | 0.06 | 0.05 | -17.52 | 0.36 | 0.02 | 9.27 | 0.21 | 0.34 | 0.00 | 0.20 |
| SEQID-01502 | 0.03 | 0.10 | 0.03 | 0.05 | 0.03 | 0.02 | 0.04 | 0.04 | -24.51 | 0.40 | -0.04 | 4.90 | 0.22 | 0.33 | 0.00 | 0.20 |
| SEQID-01503 | 0.02 | 0.05 | 0.05 | 0.05 | 0.04 | 0.02 | 0.04 | 0.06 | -17.28 | 0.56 | 0.00 | 6.95 | 0.21 | 0.31 | 0.00 | 0.00 |
| SEQID-01504 | 0.03 | 0.08 | 0.06 | 0.05 | 0.03 | 0.01 | 0.04 | 0.04 | -22.29 | 0.34 | -0.02 | 5.83 | 0.21 | 0.31 | 0.19 | 0.22 |
| SEQID-01505 | 0.03 | 0.04 | 0.03 | 0.07 | 0.06 | 0.01 | 0.04 | 0.07 | -16.42 | 0.49 | -0.02 | 5.28 | 0.21 | 0.33 | 0.20 | 0.22 |
| SEQID-01506 | 0.02 | 0.04 | 0.05 | 0.04 | 0.05 | 0.01 | 0.02 | 0.07 | -21.58 | 0.44 | 0.00 | 6.78 | 0.21 | 0.33 | 0.18 | 0.21 |
| SEQID-01507 | 0.01 | 0.06 | 0.05 | 0.05 | 0.04 | 0.04 | 0.05 | 0.06 | -20.35 | 0.44 | -0.02 | 5.62 | 0.20 | 0.34 | 0.00 | 0.19 |
| SEQID-01508 | 0.02 | 0.05 | 0.04 | 0.07 | 0.04 | 0.02 | 0.05 | 0.07 | -20.70 | 0.35 | -0.01 | 5.85 | 0.21 | 0.31 | 0.00 | 0.21 |
| SEQID-01509 | 0.03 | 0.05 | 0.04 | 0.03 | 0.05 | 0.03 | 0.05 | 0.06 | -24.81 | 0.31 | 0.00 | 7.62 | 0.21 | 0.33 | 0.00 | 0.20 |
| SEQID-01510 | 0.03 | 0.07 | 0.03 | 0.05 | 0.05 | 0.03 | 0.05 | 0.05 | -23.53 | 0.29 | -0.02 | 7.03 | 0.20 | 0.35 | 0.00 | 0.20 |
| SEQID-01511 | 0.02 | 0.05 | 0.04 | 0.06 | 0.04 | 0.01 | 0.03 | 0.08 | -20.83 | 0.44 | -0.03 | 4.94 | 0.20 | 0.32 | 0.21 | 0.21 |
| SEQID-01512 | 0.02 | 0.03 | 0.03 | 0.04 | 0.03 | 0.01 | 0.04 | 0.06 | -27.97 | 0.35 | -0.02 | 5.45 | 0.20 | 0.37 | 0.00 | 0.19 |
| SEQID-01513 | 0.02 | 0.08 | 0.04 | 0.06 | 0.05 | 0.01 | 0.04 | 0.07 | -21.63 | 0.39 | -0.04 | 4.72 | 0.20 | 0.34 | 0.19 | 0.20 |
| SEQID-01514 | 0.03 | 0.05 | 0.04 | 0.05 | 0.05 | 0.00 | 0.04 | 0.06 | -20.51 | 0.39 | -0.01 | 6.21 | 0.17 | 0.33 | 0.20 | 0.19 |
| SEQID-01515 | 0.05 | 0.07 | 0.08 | 0.06 | 0.08 | 0.04 | 0.06 | 0.01 | -15.18 | 0.44 | 0.02 | 9.00 | 0.26 | 0.25 | 0.00 | 0.26 |
| SEQID-01516 | 0.16 | 0.02 | 0.00 | 0.00 | 0.02 | 0.02 | 0.02 | 0.00 | -26.95 | 0.02 | 0.02 | 9.05 | 0.30 | 0.24 | 0.25 | 0.26 |
| SEQID-01517 | 0.01 | 0.03 | 0.04 | 0.04 | 0.01 | 0.00 | 0.05 | 0.02 | -27.30 | 0.13 | 0.09 | 10.47 | 0.22 | 0.32 | 0.00 | 0.27 |
| SEQID-01518 | 0.04 | 0.05 | 0.05 | 0.05 | 0.05 | 0.03 | 0.03 | 0.02 | -30.06 | 0.12 | 0.06 | 10.32 | 0.25 | 0.31 | 0.25 | 0.25 |
| SEQID-01519 | 0.04 | 0.03 | 0.03 | 0.06 | 0.06 | 0.05 | 0.03 | 0.05 | -24.45 | 0.32 | 0.20 | 12.14 | 0.25 | 0.27 | 0.00 | 0.25 |
| SEQID-01520 | 0.01 | 0.05 | 0.05 | 0.06 | 0.04 | 0.01 | 0.08 | 0.08 | -18.79 | 0.42 | 0.03 | 9.40 | 0.23 | 0.28 | 0.00 | 0.29 |
| SEQID-01521 | 0.02 | 0.04 | 0.04 | 0.04 | 0.04 | 0.00 | 0.01 | 0.11 | -19.76 | 0.50 | 0.02 | 9.69 | 0.27 | 0.31 | 0.00 | 0.26 |
| SEQID-01522 | 0.02 | 0.05 | 0.04 | 0.06 | 0.06 | 0.00 | 0.08 | 0.09 | -18.64 | 0.27 | 0.16 | 11.63 | 0.24 | 0.30 | 0.00 | 0.71 |
| SEQID-01523 | 0.02 | 0.01 | 0.06 | 0.05 | 0.04 | 0.00 | 0.05 | 0.07 | -25.54 | 0.24 | 0.20 | 11.55 | 0.18 | 0.30 | 0.21 | 0.22 |
| SEQID-01524 | 0.01 | 0.02 | 0.01 | 0.03 | 0.01 | 0.00 | 0.00 | 0.05 | -31.23 | 0.13 | -0.02 | 5.11 | 0.29 | 0.33 | 0.00 | 0.25 |
| SEQID-01525 | 0.03 | 0.01 | 0.03 | 0.06 | 0.05 | 0.00 | 0.03 | 0.04 | -18.10 | 0.37 | 0.10 | 11.34 | 0.26 | 0.30 | 0.00 | 0.25 |
| SEQID-01526 | 0.05 | 0.03 | 0.04 | 0.05 | 0.04 | 0.03 | 0.02 | 0.10 | -17.41 | 0.58 | 0.09 | 11.03 | 0.25 | 0.29 | 0.27 | 0.00 |
| SEQID-01527 | 0.02 | 0.02 | 0.05 | 0.04 | 0.05 | 0.03 | 0.07 | 0.08 | -16.35 | 0.41 | -0.02 | 5.59 | 0.37 | 0.37 | 0.23 | 0.19 |
| SEQID-01528 | 0.03 | 0.04 | 0.03 | 0.04 | 0.04 | 0.04 | 0.06 | 0.07 | -19.64 | 0.29 | -0.01 | 6.35 | 0.21 | 0.30 | 0.22 | 0.00 |
| SEQID-01529 | 0.03 | 0.06 | 0.05 | 0.10 | 0.07 | 0.00 | 0.04 | 0.11 | -15.90 | 0.43 | 0.03 | 9.76 | 0.23 | 0.30 | 0.24 | 0.00 |
| SEQID-01530 | 0.03 | 0.03 | 0.03 | 0.04 | 0.05 | 0.05 | 0.02 | 0.07 | -22.46 | 0.32 | -0.04 | 4.57 | 0.38 | 0.44 | 0.21 | 0.21 |
| SEQID-01531 | 0.04 | 0.06 | 0.01 | 0.05 | 0.06 | 0.04 | 0.04 | 0.06 | -19.58 | 0.45 | 0.00 | 7.51 | 0.00 | 0.32 | 0.00 | 0.22 |
| SEQID-01532 | 0.01 | 0.11 | 0.05 | 0.03 | 0.02 | 0.00 | 0.05 | 0.05 | -18.49 | 0.53 | -0.03 | 4.75 | 0.00 | 0.31 | 0.00 | 0.26 |
| SEQID-01533 | 0.03 | 0.05 | 0.03 | 0.06 | 0.04 | 0.00 | 0.08 | 0.07 | -22.34 | 0.40 | -0.01 | 6.13 | 0.24 | 0.31 | 0.00 | 0.22 |
| SEQID-01534 | 0.01 | 0.06 | 0.05 | 0.06 | 0.06 | 0.06 | 0.01 | 0.06 | -24.06 | 0.27 | -0.03 | 5.17 | 0.22 | 0.34 | 0.00 | 0.22 |
| SEQID-01535 | 0.02 | 0.05 | 0.02 | 0.06 | 0.04 | 0.01 | 0.05 | 0.09 | -20.98 | 0.45 | -0.01 | 5.45 | 0.22 | 0.33 | 0.24 | 0.00 |
| SEQID-01536 | 0.03 | 0.05 | 0.04 | 0.04 | 0.05 | 0.01 | 0.03 | 0.06 | -23.96 | 0.38 | -0.01 | 6.30 | 0.23 | 0.31 | 0.00 | 0.21 |
| SEQID-01537 | 0.01 | 0.03 | 0.03 | 0.07 | 0.08 | 0.00 | 0.04 | 0.09 | -16.54 | 0.54 | -0.06 | 4.27 | 0.23 | 0.31 | 0.21 | 0.00 |
| SEQID-01538 | 0.03 | 0.08 | 0.05 | 0.07 | 0.01 | 0.02 | 0.07 | 0.04 | -21.18 | 0.36 | -0.01 | 6.64 | 0.23 | 0.34 | 0.00 | 0.00 |
| SEQID-01539 | 0.05 | 0.02 | 0.02 | 0.07 | 0.04 | 0.01 | 0.00 | 0.04 | -27.29 | 0.18 | -0.08 | 4.37 | 0.24 | 0.35 | 0.00 | 0.00 |
| SEQID-01540 | 0.02 | 0.07 | 0.03 | 0.03 | 0.03 | 0.02 | 0.02 | 0.05 | -28.85 | 0.29 | -0.09 | 4.76 | 0.23 | 0.30 | 0.00 | 0.22 |

TABLE 1-continued

| SEQID | | | | | | | | | | | | | | | | |
|---|---|---|---|---|---|---|---|---|---|---|---|---|---|---|---|---|
| SEQID-01541 | 0.04 | 0.06 | 0.04 | 0.06 | 0.04 | 0.03 | 0.08 | 0.07 | -15.44 | 0.75 | -0.06 | 4.20 | 0.21 | 0.32 | 0.00 | 0.20 |
| SEQID-01542 | 0.03 | 0.09 | 0.03 | 0.07 | 0.03 | 0.02 | 0.05 | 0.04 | -22.95 | 0.51 | -0.08 | 4.18 | 0.23 | 0.32 | 0.00 | 0.22 |
| SEQID-01543 | 0.03 | 0.04 | 0.02 | 0.07 | 0.05 | 0.01 | 0.06 | 0.05 | -23.39 | 0.40 | -0.08 | 4.38 | 0.00 | 0.33 | 0.22 | 0.00 |
| SEQID-01544 | 0.04 | 0.03 | 0.04 | 0.05 | 0.06 | 0.02 | 0.06 | 0.03 | -18.90 | 0.44 | 0.05 | 8.97 | 0.22 | 0.31 | 0.00 | 0.20 |
| SEQID-01545 | 0.02 | 0.06 | 0.02 | 0.06 | 0.05 | 0.04 | 0.06 | 0.06 | -18.02 | 0.41 | -0.01 | 6.16 | 0.20 | 0.32 | 0.00 | 0.20 |
| SEQID-01546 | 0.00 | 0.02 | 0.03 | 0.07 | 0.06 | 0.08 | 0.03 | 0.08 | -20.14 | 0.42 | -0.03 | 5.54 | 0.21 | 0.32 | 0.00 | 0.20 |
| SEQID-01547 | 0.02 | 0.05 | 0.06 | 0.07 | 0.06 | 0.03 | 0.07 | 0.05 | -18.75 | 0.39 | 0.01 | 8.29 | 0.21 | 0.35 | 0.00 | 0.22 |
| SEQID-01548 | 0.03 | 0.07 | 0.05 | 0.06 | 0.03 | 0.02 | 0.08 | 0.04 | -22.52 | 0.29 | -0.02 | 5.16 | 0.22 | 0.32 | 0.20 | 0.25 |
| SEQID-01549 | 0.03 | 0.02 | 0.02 | 0.05 | 0.07 | 0.00 | 0.06 | 0.07 | -19.16 | 0.29 | 0.00 | 7.40 | 0.22 | 0.31 | 0.22 | 0.18 |
| SEQID-01550 | 0.01 | 0.03 | 0.05 | 0.04 | 0.04 | 0.04 | 0.04 | 0.07 | -20.54 | 0.32 | 0.01 | 8.22 | 0.21 | 0.31 | 0.00 | 0.20 |
| SEQID-01551 | 0.03 | 0.06 | 0.05 | 0.05 | 0.05 | 0.00 | 0.03 | 0.06 | -17.15 | 0.48 | 0.01 | 8.76 | 0.21 | 0.31 | 0.00 | 0.20 |
| SEQID-01552 | 0.02 | 0.04 | 0.04 | 0.07 | 0.07 | 0.00 | 0.04 | 0.06 | -23.14 | 0.35 | -0.06 | 4.51 | 0.21 | 0.31 | 0.00 | 0.20 |
| SEQID-01553 | 0.02 | 0.08 | 0.03 | 0.06 | 0.04 | 0.01 | 0.03 | 0.07 | -22.22 | 0.40 | -0.01 | 6.06 | 0.22 | 0.32 | 0.00 | 0.20 |
| SEQID-01554 | 0.02 | 0.05 | 0.05 | 0.04 | 0.05 | 0.02 | 0.06 | 0.05 | -21.32 | 0.33 | -0.02 | 5.83 | 0.23 | 0.32 | 0.00 | 0.22 |
| SEQID-01555 | 0.02 | 0.05 | 0.05 | 0.04 | 0.05 | 0.01 | 0.02 | 0.08 | -21.34 | 0.43 | -0.01 | 6.30 | 0.21 | 0.32 | 0.23 | 0.22 |
| SEQID-01556 | 0.03 | 0.06 | 0.02 | 0.05 | 0.06 | 0.02 | 0.09 | 0.03 | -20.12 | 0.32 | -0.07 | 4.22 | 0.19 | 0.35 | 0.00 | 0.18 |
| SEQID-01557 | 0.01 | 0.07 | 0.03 | 0.05 | 0.04 | 0.03 | 0.05 | 0.08 | -18.69 | 0.55 | 0.01 | 8.39 | 0.20 | 0.35 | 0.00 | 0.20 |
| SEQID-01558 | 0.03 | 0.04 | 0.05 | 0.04 | 0.04 | 0.03 | 0.08 | 0.04 | -21.38 | 0.36 | -0.01 | 6.19 | 0.20 | 0.32 | 0.00 | 0.20 |
| SEQID-01559 | 0.03 | 0.04 | 0.04 | 0.06 | 0.06 | 0.00 | 0.02 | 0.06 | -20.66 | 0.33 | -0.10 | 3.97 | 0.21 | 0.35 | 0.00 | 0.22 |
| SEQID-01560 | 0.02 | 0.07 | 0.05 | 0.08 | 0.08 | 0.01 | 0.04 | 0.05 | -15.08 | 0.37 | -0.01 | 5.18 | 0.22 | 0.33 | 0.21 | 0.21 |
| SEQID-01561 | 0.03 | 0.07 | 0.03 | 0.03 | 0.03 | 0.03 | 0.04 | 0.05 | -19.53 | 0.40 | -0.02 | 5.49 | 0.20 | 0.33 | 0.00 | 0.20 |
| SEQID-01562 | 0.01 | 0.05 | 0.03 | 0.17 | 0.03 | 0.01 | 0.02 | 0.03 | -38.73 | 0.13 | -0.05 | 4.58 | 0.26 | 0.57 | 0.21 | 0.22 |
| SEQID-01563 | 0.02 | 0.03 | 0.04 | 0.09 | 0.04 | 0.00 | 0.02 | 0.04 | -29.57 | 0.18 | -0.11 | 4.19 | 0.22 | 0.35 | 0.23 | 0.22 |
| SEQID-01564 | 0.02 | 0.06 | 0.04 | 0.05 | 0.06 | 0.02 | 0.05 | 0.08 | -17.13 | 0.41 | 0.01 | 8.55 | 0.22 | 0.32 | 0.00 | 0.20 |
| SEQID-01565 | 0.01 | 0.03 | 0.06 | 0.07 | 0.05 | 0.02 | 0.01 | 0.04 | -30.23 | 0.14 | -0.08 | 4.43 | 0.21 | 0.34 | 0.00 | 0.22 |
| SEQID-01566 | 0.03 | 0.05 | 0.04 | 0.03 | 0.05 | 0.00 | 0.03 | 0.04 | -25.47 | 0.32 | -0.02 | 5.45 | 0.22 | 0.32 | 0.00 | 0.22 |
| SEQID-01567 | 0.03 | 0.04 | 0.05 | 0.07 | 0.03 | 0.00 | 0.04 | 0.07 | -21.91 | 0.33 | 0.01 | 9.44 | 0.21 | 0.34 | 0.22 | 0.21 |
| SEQID-01568 | 0.04 | 0.07 | 0.03 | 0.06 | 0.05 | 0.02 | 0.04 | 0.06 | -19.23 | 0.32 | -0.06 | 4.37 | 0.40 | 0.54 | 0.00 | 0.21 |
| SEQID-01569 | 0.03 | 0.06 | 0.02 | 0.05 | 0.06 | 0.02 | 0.05 | 0.04 | -21.49 | 0.37 | -0.02 | 5.48 | 0.22 | 0.32 | 0.00 | 0.22 |
| SEQID-01570 | 0.01 | 0.06 | 0.03 | 0.05 | 0.02 | 0.02 | 0.06 | 0.05 | -25.30 | 0.30 | -0.01 | 5.94 | 0.21 | 0.34 | 0.19 | 0.21 |
| SEQID-01571 | 0.01 | 0.06 | 0.05 | 0.05 | 0.03 | 0.02 | 0.07 | 0.04 | -21.09 | 0.35 | 0.00 | 6.79 | 0.21 | 0.37 | 0.00 | 0.21 |
| SEQID-01572 | 0.03 | 0.06 | 0.06 | 0.04 | 0.05 | 0.01 | 0.02 | 0.06 | -17.35 | 0.38 | 0.02 | 8.40 | 0.21 | 0.31 | 0.00 | 0.21 |
| SEQID-01573 | 0.02 | 0.08 | 0.03 | 0.06 | 0.06 | 0.01 | 0.05 | 0.05 | -20.75 | 0.36 | -0.01 | 5.30 | 0.22 | 0.14 | 0.00 | 0.21 |
| SEQID-01574 | 0.01 | 0.07 | 0.04 | 0.05 | 0.05 | 0.02 | 0.04 | 0.06 | -20.80 | 0.41 | -0.01 | 5.63 | 0.20 | 0.33 | 0.00 | 0.21 |
| SEQID-01575 | 0.03 | 0.05 | 0.04 | 0.04 | 0.03 | 0.02 | 0.05 | 0.07 | -20.18 | 0.41 | -0.01 | 6.47 | 0.21 | 0.33 | 0.00 | 0.21 |
| SEQID-01576 | 0.03 | 0.05 | 0.05 | 0.05 | 0.06 | 0.02 | 0.06 | 0.06 | -19.53 | 0.33 | 0.00 | 7.20 | 0.20 | 0.32 | 0.00 | 0.21 |
| SEQID-01577 | 0.03 | 0.04 | 0.04 | 0.04 | 0.05 | 0.00 | 0.04 | 0.07 | -21.89 | 0.35 | 0.00 | 6.82 | 0.20 | 0.32 | 0.20 | 0.21 |
| SEQID-01578 | 0.04 | 0.09 | 0.03 | 0.06 | 0.06 | 0.03 | 0.07 | 0.06 | -14.76 | 0.73 | 0.00 | 7.66 | 0.20 | 0.33 | 0.00 | 0.22 |
| SEQID-01579 | 0.03 | 0.06 | 0.04 | 0.06 | 0.05 | 0.04 | 0.04 | 0.05 | -22.28 | 0.11 | 0.00 | 5.55 | 0.19 | 0.34 | 0.00 | 0.21 |
| SEQID-01580 | 0.02 | 0.05 | 0.04 | 0.05 | 0.06 | 0.01 | 0.04 | 0.07 | -24.31 | 0.46 | -0.02 | 5.29 | 0.46 | 0.61 | 0.00 | 0.20 |
| SEQID-01581 | 0.03 | 0.08 | 0.04 | 0.05 | 0.04 | 0.03 | 0.08 | 0.05 | -20.71 | 0.31 | -0.02 | 6.10 | 0.21 | 0.31 | 0.00 | 0.21 |
| SEQID-01582 | 0.01 | 0.02 | 0.03 | 0.07 | 0.08 | 0.01 | 0.03 | 0.04 | -28.38 | 0.10 | -0.05 | 4.68 | 0.21 | 0.40 | 0.00 | 0.20 |
| SEQID-01583 | 0.02 | 0.06 | 0.04 | 0.05 | 0.05 | 0.02 | 0.06 | 0.07 | -24.33 | 0.25 | 0.01 | 8.67 | 0.20 | 0.33 | 0.00 | 0.20 |
| SEQID-01584 | 0.02 | 0.05 | 0.05 | 0.04 | 0.06 | 0.00 | 0.03 | 0.07 | -18.52 | 0.45 | 0.00 | 6.83 | 0.19 | 0.34 | 0.00 | 0.20 |
| SEQID-01585 | 0.01 | 0.07 | 0.03 | 0.04 | 0.05 | 0.01 | 0.05 | 0.05 | -23.50 | 0.29 | -0.02 | 5.39 | 0.20 | 0.35 | 0.19 | 0.20 |
| SEQID-01586 | 0.01 | 0.06 | 0.04 | 0.06 | 0.06 | 0.03 | 0.05 | 0.06 | -20.61 | 0.30 | 0.00 | 7.23 | 0.19 | 0.33 | 0.20 | 0.20 |
| SEQID-01587 | 0.02 | 0.07 | 0.04 | 0.06 | 0.05 | 0.01 | 0.04 | 0.07 | -21.13 | 0.26 | 0.00 | 7.26 | 0.19 | 0.32 | 0.19 | 0.20 |
| SEQID-01588 | 0.04 | 0.04 | 0.04 | 0.04 | 0.07 | 0.00 | 0.04 | 0.08 | -22.28 | 0.46 | -0.02 | 5.25 | 0.21 | 0.34 | 0.21 | 0.21 |
| SEQID-01589 | 0.03 | 0.04 | 0.03 | 0.04 | 0.04 | 0.01 | 0.04 | 0.07 | -24.31 | 0.34 | 0.00 | 7.14 | 0.19 | 0.35 | 0.19 | 0.19 |
| SEQID-01590 | 0.02 | 0.01 | 0.04 | 0.05 | 0.05 | 0.03 | 0.08 | 0.05 | -20.71 | 0.27 | 0.11 | 11.06 | 0.21 | 0.34 | 0.17 | 0.23 |
| SEQID-01591 | 0.04 | 0.04 | 0.03 | 0.05 | 0.09 | 0.01 | 0.05 | 0.07 | -18.50 | 0.40 | -0.01 | 6.10 | 0.42 | 0.59 | 0.00 | 0.20 |
| SEQID-01592 | 0.04 | 0.04 | 0.03 | 0.05 | 0.05 | 0.00 | 0.05 | 0.06 | -22.72 | 0.32 | -0.06 | 4.52 | 0.49 | 0.68 | 0.00 | 0.20 |
| SEQID-01593 | 0.03 | 0.04 | 0.04 | 0.01 | 0.08 | 0.00 | 0.04 | 0.09 | -22.55 | 0.42 | -0.06 | 4.66 | 0.22 | 0.35 | 0.00 | 0.21 |

TABLE 1-continued

| | | | | | | | | | | | | | | | |
|---|---|---|---|---|---|---|---|---|---|---|---|---|---|---|---|
| SEQID-01594 | 0.01 | 0.05 | 0.02 | 0.07 | 0.03 | 0.00 | 0.02 | 0.10 | -25.27 | 0.36 | -0.02 | 5.08 | 0.21 | 0.21 | 0.31 | 0.23 |
| SEQID-01595 | 0.05 | 0.05 | 0.04 | 0.02 | 0.05 | 0.00 | 0.03 | 0.08 | -23.32 | 0.48 | -0.05 | 4.51 | 0.21 | 0.23 | 0.33 | 0.00 |
| SEQID-01596 | 0.06 | 0.05 | 0.01 | 0.04 | 0.03 | 0.01 | 0.06 | 0.04 | -24.98 | 0.25 | 0.21 | 11.84 | 0.00 | 0.00 | 0.27 | 0.22 |
| SEQID-01597 | 0.04 | 0.04 | 0.05 | 0.04 | 0.05 | 0.03 | 0.04 | 0.10 | -19.93 | 0.37 | 0.02 | 9.66 | 0.21 | 0.00 | 0.32 | 0.00 |
| SEQID-01598 | 0.04 | 0.04 | 0.03 | 0.03 | 0.04 | 0.01 | 0.04 | 0.04 | -25.91 | 0.31 | -0.01 | 6.52 | 0.20 | 0.00 | 0.32 | 0.20 |
| SEQID-01599 | 0.02 | 0.03 | 0.04 | 0.05 | 0.05 | 0.03 | 0.05 | 0.06 | -21.91 | 0.32 | -0.01 | 6.39 | 0.21 | 0.00 | 0.33 | 0.20 |
| SEQID-01600 | 0.04 | 0.03 | 0.04 | 0.04 | 0.04 | 0.02 | 0.06 | 0.03 | -20.96 | 0.45 | -0.03 | 5.00 | 0.24 | 0.20 | 0.30 | 0.00 |
| SEQID-01601 | 0.01 | 0.03 | 0.02 | 0.05 | 0.07 | 0.00 | 0.06 | 0.10 | -23.64 | 0.26 | 0.04 | 9.92 | 0.21 | 0.00 | 0.32 | 0.24 |
| SEQID-01602 | 0.04 | 0.05 | 0.02 | 0.03 | 0.05 | 0.00 | 0.05 | 0.07 | -20.74 | 0.48 | -0.03 | 5.74 | 0.21 | 0.22 | 0.33 | 0.22 |
| SEQID-01603 | 0.03 | 0.03 | 0.04 | 0.04 | 0.04 | 0.00 | 0.02 | 0.08 | -25.70 | 0.29 | 0.04 | 10.27 | 0.19 | 0.00 | 0.33 | 0.20 |
| SEQID-01604 | 0.01 | 0.04 | 0.03 | 0.07 | 0.13 | 0.00 | 0.08 | 0.10 | -16.36 | 0.36 | 0.03 | 9.90 | 0.23 | 0.23 | 0.36 | 0.23 |
| SEQID-01605 | 0.04 | 0.01 | 0.05 | 0.06 | 0.05 | 0.00 | 0.07 | 0.09 | -21.11 | 0.22 | 0.15 | 11.42 | 0.19 | 0.00 | 0.31 | 0.00 |
| SEQID-01606 | 0.04 | 0.05 | 0.04 | 0.04 | 0.06 | 0.01 | 0.04 | 0.07 | -22.99 | 0.36 | -0.04 | 4.73 | 0.00 | 0.00 | 0.35 | 0.21 |
| SEQID-01607 | 0.04 | 0.02 | 0.03 | 0.04 | 0.04 | 0.01 | 0.01 | 0.11 | -23.44 | 0.40 | 0.07 | 10.98 | 0.21 | 0.00 | 0.30 | 0.24 |
| SEQID-01608 | 0.03 | 0.02 | 0.04 | 0.08 | 0.06 | 0.01 | 0.04 | 0.13 | -22.45 | 0.33 | 0.08 | 10.62 | 0.24 | 0.00 | 0.33 | 0.21 |
| SEQID-01609 | 0.03 | 0.02 | 0.04 | 0.03 | 0.04 | 0.04 | 0.09 | 0.06 | -23.54 | 0.22 | 0.07 | 10.93 | 0.00 | 0.00 | 0.33 | 0.25 |
| SEQID-01610 | 0.03 | 0.04 | 0.04 | 0.04 | 0.06 | 0.01 | 0.04 | 0.07 | -22.98 | 0.34 | -0.02 | 5.30 | 0.21 | 0.00 | 0.37 | 0.22 |
| SEQID-01611 | 0.03 | 0.02 | 0.04 | 0.05 | 0.05 | 0.02 | 0.05 | 0.06 | -23.03 | 0.35 | -0.05 | 4.54 | 0.42 | 0.00 | 0.59 | 0.00 |
| SEQID-01612 | 0.05 | 0.03 | 0.05 | 0.05 | 0.06 | 0.00 | 0.05 | 0.06 | -18.79 | 0.54 | -0.02 | 5.06 | 0.21 | 0.00 | 0.32 | 0.00 |
| SEQID-01613 | 0.03 | 0.04 | 0.02 | 0.03 | 0.04 | 0.04 | 0.04 | 0.05 | -23.26 | 0.34 | -0.05 | 4.63 | 0.21 | 0.24 | 0.34 | 0.23 |
| SEQID-01614 | 0.02 | 0.05 | 0.03 | 0.07 | 0.03 | 0.04 | 0.07 | 0.06 | -19.94 | 0.27 | 0.05 | 10.11 | 0.21 | 0.00 | 0.33 | 0.00 |
| SEQID-01615 | 0.03 | 0.08 | 0.04 | 0.04 | 0.06 | 0.01 | 0.04 | 0.09 | -15.06 | 0.74 | 0.00 | 6.63 | 0.21 | 0.00 | 0.35 | 0.21 |
| SEQID-01616 | 0.02 | 0.03 | 0.03 | 0.08 | 0.11 | 0.01 | 0.09 | 0.07 | -15.18 | 0.29 | 0.04 | 9.91 | 0.21 | 0.22 | 0.33 | 0.20 |
| SEQID-01617 | 0.03 | 0.05 | 0.01 | 0.03 | 0.04 | 0.00 | 0.07 | 0.08 | -29.91 | 0.24 | -0.02 | 5.24 | 0.23 | 0.00 | 0.32 | 0.21 |
| SEQID-01618 | 0.03 | 0.03 | 0.05 | 0.04 | 0.03 | 0.02 | 0.06 | 0.06 | -23.87 | 0.26 | 0.05 | 10.31 | 0.00 | 0.00 | 0.30 | 0.17 |
| SEQID-01619 | 0.03 | 0.05 | 0.03 | 0.04 | 0.04 | 0.01 | 0.02 | 0.08 | -21.83 | 0.44 | -0.02 | 5.34 | 0.23 | 0.24 | 0.35 | 0.23 |
| SEQID-01620 | 0.03 | 0.06 | 0.03 | 0.04 | 0.05 | 0.00 | 0.08 | 0.05 | -21.00 | 0.36 | -0.04 | 4.69 | 0.21 | 0.21 | 0.33 | 0.21 |
| SEQID-01621 | 0.01 | 0.06 | 0.04 | 0.04 | 0.04 | 0.00 | 0.00 | 0.08 | -24.08 | 0.36 | 0.05 | 10.32 | 0.30 | 0.00 | 0.31 | 0.22 |
| SEQID-01622 | 0.04 | 0.05 | 0.03 | 0.01 | 0.04 | 0.01 | 0.07 | 0.06 | -20.44 | 0.39 | 0.01 | 7.92 | 0.20 | 0.00 | 0.31 | 0.21 |
| SEQID-01623 | 0.01 | 0.03 | 0.04 | 0.04 | 0.06 | 0.00 | 0.04 | 0.11 | -26.56 | 0.28 | 0.10 | 11.20 | 0.23 | 0.00 | 0.33 | 0.00 |
| SEQID-01624 | 0.03 | 0.05 | 0.03 | 0.06 | 0.06 | 0.03 | 0.09 | 0.06 | -19.40 | 0.27 | 0.06 | 10.13 | 0.20 | 0.20 | 0.34 | 0.20 |
| SEQID-01625 | 0.03 | 0.03 | 0.01 | 0.10 | 0.06 | 0.01 | 0.07 | 0.06 | -20.45 | 0.28 | 0.09 | 10.47 | 0.22 | 0.00 | 0.31 | 0.22 |
| SEQID-01626 | 0.05 | 0.07 | 0.05 | 0.05 | 0.04 | 0.02 | 0.03 | 0.06 | -16.88 | 0.71 | -0.01 | 6.08 | 0.19 | 0.20 | 0.35 | 0.20 |
| SEQID-01627 | 0.03 | 0.04 | 0.03 | 0.04 | 0.06 | 0.03 | 0.05 | 0.06 | -23.61 | 0.26 | -0.03 | 6.28 | 0.21 | 0.00 | 0.34 | 0.22 |
| SEQID-01628 | 0.05 | 0.03 | 0.06 | 0.06 | 0.08 | 0.00 | 0.01 | 0.04 | -23.11 | 0.37 | -0.03 | 10.15 | 0.25 | 0.00 | 0.27 | 0.00 |
| SEQID-01629 | 0.04 | 0.01 | 0.02 | 0.04 | 0.04 | 0.00 | 0.11 | 0.12 | -28.97 | 0.26 | -0.16 | 10.65 | 0.19 | 0.00 | 0.27 | 0.21 |
| SEQID-01630 | 0.02 | 0.04 | 0.01 | 0.05 | 0.05 | 0.01 | 0.01 | 0.12 | -23.06 | 0.57 | 0.07 | 10.72 | 0.27 | 0.25 | 0.33 | 0.25 |
| SEQID-01631 | 0.03 | 0.02 | 0.03 | 0.05 | 0.03 | 0.01 | 0.06 | 0.08 | -21.94 | 0.44 | 0.03 | 9.85 | 0.24 | 0.20 | 0.30 | 0.18 |
| SEQID-01632 | 0.03 | 0.00 | 0.02 | 0.03 | 0.05 | 0.00 | 0.05 | 0.08 | -29.33 | 0.29 | 0.11 | 10.97 | 0.24 | 0.29 | 0.33 | 0.24 |
| SEQID-01633 | 0.05 | 0.02 | 0.02 | 0.02 | 0.06 | 0.00 | 0.03 | 0.08 | -27.40 | 0.39 | 0.09 | 10.88 | 0.27 | 0.23 | 0.32 | 0.24 |
| SEQID-01634 | 0.03 | 0.05 | 0.03 | 0.04 | 0.04 | 0.02 | 0.04 | 0.05 | -19.86 | 0.54 | -0.01 | 6.70 | 0.20 | 0.00 | 0.34 | 0.21 |
| SEQID-01635 | 0.03 | 0.04 | 0.05 | 0.05 | 0.04 | 0.01 | 0.05 | 0.07 | -18.51 | 0.45 | -0.03 | 4.81 | 0.21 | 0.20 | 0.33 | 0.12 |
| SEQID-01636 | 0.02 | 0.01 | 0.02 | 0.03 | 0.07 | 0.00 | 0.02 | 0.08 | -22.43 | 0.41 | -0.03 | 4.70 | 0.21 | 0.23 | 0.35 | 0.12 |
| SEQID-01637 | 0.01 | 0.05 | 0.04 | 0.04 | 0.01 | 0.00 | 0.01 | 0.07 | -31.55 | 0.39 | -0.16 | 3.88 | 0.24 | 0.24 | 0.30 | 0.25 |
| SEQID-01638 | 0.03 | 0.04 | 0.01 | 0.04 | 0.04 | 0.01 | 0.01 | 0.04 | -28.30 | 0.24 | -0.02 | 5.58 | 0.19 | 0.19 | 0.55 | 0.00 |
| SEQID-01639 | 0.03 | 0.04 | 0.01 | 0.04 | 0.04 | 0.01 | 0.06 | 0.04 | -28.28 | 0.23 | -0.02 | 5.65 | 0.19 | 0.18 | 0.55 | 0.17 |
| SEQID-01640 | 0.03 | 0.04 | 0.01 | 0.04 | 0.04 | 0.01 | 0.05 | 0.04 | -28.28 | 0.23 | -0.02 | 5.64 | 0.18 | 0.18 | 0.54 | 0.00 |
| SEQID-01641 | 0.03 | 0.04 | 0.01 | 0.04 | 0.04 | 0.01 | 0.03 | 0.04 | -28.15 | 0.21 | -0.02 | 5.68 | 0.18 | 0.18 | 0.34 | 0.00 |
| SEQID-01642 | 0.05 | 0.02 | 0.03 | 0.05 | 0.06 | 0.02 | 0.08 | 0.05 | -25.06 | 0.30 | 0.03 | 9.44 | 0.00 | 0.00 | 0.32 | 0.00 |
| SEQID-01643 | 0.02 | 0.04 | 0.02 | 0.04 | 0.04 | 0.02 | 0.05 | 0.08 | -22.60 | 0.41 | -0.01 | 6.25 | 0.19 | 0.19 | 0.30 | 0.18 |
| SEQID-01644 | 0.05 | 0.04 | 0.04 | 0.05 | 0.04 | 0.02 | 0.06 | 0.05 | -19.69 | 0.30 | -0.03 | 5.05 | 0.43 | 0.00 | 0.66 | 0.20 |
| SEQID-01645 | 0.04 | 0.06 | 0.05 | 0.04 | 0.06 | 0.02 | 0.03 | 0.05 | -24.11 | 0.30 | 0.00 | 7.00 | 0.21 | 0.00 | 0.30 | 0.20 |
| SEQID-01646 | 0.05 | 0.04 | 0.03 | 0.04 | 0.04 | 0.01 | 0.02 | 0.08 | -21.25 | 0.45 | 0.01 | 7.66 | 0.21 | 0.00 | 0.35 | 0.21 |

TABLE 1-continued

| | | | | | | | | | | | | | | | | |
|---|---|---|---|---|---|---|---|---|---|---|---|---|---|---|---|---|
| SEQID-01647 | 0.02 | 0.04 | 0.06 | 0.04 | 0.05 | 0.03 | 0.03 | 0.03 | 0.09 | -24.19 | 0.30 | 0.00 | 6.53 | 0.18 | 0.34 | 0.20 | 0.21 |
| SEQID-01648 | 0.05 | 0.05 | 0.04 | 0.05 | 0.06 | 0.02 | 0.06 | 0.05 | 0.05 | -19.52 | 0.43 | -0.03 | 5.16 | 0.21 | 0.31 | 0.00 | 0.22 |
| SEQID-01649 | 0.04 | 0.06 | 0.03 | 0.05 | 0.04 | 0.02 | 0.01 | 0.04 | 0.10 | -20.59 | 0.46 | 0.01 | 8.29 | 0.23 | 0.36 | 0.00 | 0.22 |
| SEQID-01650 | 0.03 | 0.05 | 0.03 | 0.04 | 0.04 | 0.01 | 0.03 | 0.03 | 0.07 | -21.15 | 0.42 | 0.01 | 7.67 | 0.81 | 0.98 | 0.21 | 0.21 |
| SEQID-01651 | 0.04 | 0.04 | 0.03 | 0.04 | 0.04 | 0.03 | 0.04 | 0.04 | 0.03 | -24.31 | 0.28 | -0.08 | 5.06 | 0.20 | 0.36 | 0.00 | 0.19 |
| SEQID-01652 | 0.03 | 0.05 | 0.03 | 0.04 | 0.06 | 0.04 | 0.06 | 0.03 | 0.08 | -18.95 | 0.64 | -0.02 | 5.08 | 0.19 | 0.35 | 0.15 | 0.20 |
| SEQID-01653 | 0.04 | 0.05 | 0.03 | 0.05 | 0.06 | 0.06 | 0.02 | 0.04 | 0.10 | -17.92 | 0.49 | -0.02 | 8.82 | 0.70 | 0.86 | 0.00 | 0.20 |
| SEQID-01654 | 0.02 | 0.03 | 0.07 | 0.04 | 0.05 | 0.02 | 0.03 | 0.05 | 0.09 | -23.26 | 0.28 | -0.01 | 6.41 | 0.21 | 0.34 | 0.00 | 0.23 |
| SEQID-01655 | 0.03 | 0.07 | 0.04 | 0.04 | 0.07 | 0.03 | 0.05 | 0.05 | 0.06 | -19.82 | 0.43 | 0.02 | 9.18 | 0.20 | 0.36 | 0.19 | 0.21 |
| SEQID-01656 | 0.04 | 0.07 | 0.04 | 0.05 | 0.05 | 0.00 | 0.03 | 0.03 | 0.05 | -22.74 | 0.38 | -0.02 | 5.47 | 1.00 | 1.00 | 0.00 | 0.20 |
| SEQID-01657 | 0.03 | 0.05 | 0.05 | 0.04 | 0.04 | 0.03 | 0.06 | 0.06 | 0.05 | -19.55 | 0.37 | 0.00 | 6.98 | 0.18 | 0.34 | 0.19 | 0.22 |
| SEQID-01658 | 0.01 | 0.04 | 0.03 | 0.04 | 0.04 | 0.05 | 0.06 | 0.05 | 0.08 | -19.93 | 0.45 | 0.00 | 7.24 | 0.67 | 0.30 | 0.23 | 0.00 |
| SEQID-01659 | 0.01 | 0.04 | 0.05 | 0.05 | 0.07 | 0.02 | 0.02 | 0.04 | 0.07 | -23.94 | 0.29 | -0.02 | 5.25 | 0.19 | 0.37 | 0.19 | 0.19 |
| SEQID-01660 | 0.03 | 0.06 | 0.04 | 0.03 | 0.04 | 0.02 | 0.06 | 0.06 | 0.06 | -22.25 | 0.32 | -0.01 | 6.28 | 0.19 | 0.32 | 0.00 | 0.21 |
| SEQID-01661 | 0.01 | 0.05 | 0.04 | 0.06 | 0.05 | 0.03 | 0.03 | 0.06 | 0.08 | -22.31 | 0.32 | -0.01 | 6.28 | 0.19 | 0.34 | 0.19 | 0.20 |
| SEQID-01662 | 0.03 | 0.03 | 0.03 | 0.06 | 0.04 | 0.03 | 0.02 | 0.02 | 0.10 | -19.92 | 0.55 | 0.02 | 8.02 | 0.23 | 0.32 | 0.20 | 0.19 |
| SEQID-01663 | 0.01 | 0.04 | 0.03 | 0.06 | 0.07 | 0.02 | 0.04 | 0.04 | 0.07 | -24.15 | 0.31 | -0.02 | 5.47 | 0.00 | 0.33 | 0.00 | 0.00 |
| SEQID-01664 | 0.05 | 0.09 | 0.04 | 0.03 | 0.05 | 0.01 | 0.02 | 0.02 | 0.05 | -25.42 | 0.34 | -0.05 | 4.48 | 0.41 | 0.59 | 0.23 | 0.23 |
| SEQID-01665 | 0.03 | 0.07 | 0.04 | 0.04 | 0.06 | 0.04 | 0.04 | 0.04 | 0.05 | -19.34 | 0.41 | 0.01 | 8.10 | 0.21 | 0.32 | 0.00 | 0.20 |
| SEQID-01666 | 0.03 | 0.03 | 0.03 | 0.04 | 0.06 | 0.00 | 0.03 | 0.06 | 0.07 | -25.16 | 0.32 | 0.02 | 8.95 | 0.22 | 0.33 | 0.00 | 0.22 |
| SEQID-01667 | 0.05 | 0.02 | 0.02 | 0.04 | 0.02 | 0.01 | 0.01 | 0.02 | 0.04 | -32.61 | 0.15 | 0.04 | 9.81 | 0.25 | 0.33 | 0.26 | 0.24 |
| SEQID-01668 | 0.03 | 0.05 | 0.05 | 0.04 | 0.05 | 0.02 | 0.02 | 0.04 | 0.07 | -22.22 | 0.37 | 0.02 | 8.84 | 0.38 | 0.60 | 0.00 | 0.22 |
| SEQID-01669 | 0.03 | 0.05 | 0.03 | 0.04 | 0.07 | 0.04 | 0.04 | 0.04 | 0.06 | -23.34 | 0.33 | -0.01 | 5.34 | 0.71 | 0.89 | 0.00 | 0.21 |
| SEQID-01670 | 0.02 | 0.03 | 0.19 | 0.03 | 0.03 | 0.01 | 0.00 | 0.03 | 0.03 | -14.79 | 0.16 | -0.01 | 5.27 | 0.61 | 0.78 | 0.21 | 0.39 |
| SEQID-01671 | 0.04 | 0.07 | 0.07 | 0.02 | 0.04 | 0.00 | 0.01 | 0.05 | 0.05 | -23.56 | 0.32 | -0.04 | 4.68 | 0.31 | 0.49 | 0.00 | 0.22 |
| SEQID-01672 | 0.03 | 0.04 | 0.05 | 0.03 | 0.04 | 0.05 | 0.03 | 0.05 | 0.05 | -22.65 | 0.31 | 0.01 | 7.60 | 0.23 | 0.30 | 0.20 | 0.20 |
| SEQID-01673 | 0.02 | 0.03 | 0.11 | 0.03 | 0.04 | 0.01 | 0.06 | 0.06 | 0.06 | -21.53 | 0.26 | 0.01 | 7.60 | 0.21 | 0.41 | 0.21 | 0.22 |
| SEQID-01674 | 0.02 | 0.05 | 0.04 | 0.06 | 0.05 | 0.03 | 0.03 | 0.05 | 0.08 | -22.52 | 0.31 | -0.02 | 5.83 | 0.19 | 0.33 | 0.19 | 0.19 |
| SEQID-01675 | 0.02 | 0.05 | 0.03 | 0.04 | 0.04 | 0.01 | 0.01 | 0.04 | 0.08 | -21.06 | 0.43 | 0.00 | 6.53 | 0.85 | 0.96 | 0.21 | 0.22 |
| SEQID-01676 | 0.02 | 0.05 | 0.04 | 0.04 | 0.07 | 0.03 | 0.03 | 0.03 | 0.06 | -22.28 | 0.54 | -0.02 | 5.31 | 0.73 | 0.91 | 0.20 | 0.22 |
| SEQID-01677 | 0.02 | 0.06 | 0.05 | 0.05 | 0.05 | 0.00 | 0.00 | 0.04 | 0.08 | -18.73 | 0.43 | -0.01 | 6.68 | 0.00 | 0.52 | 0.18 | 1.00 |
| SEQID-01678 | 0.01 | 0.03 | 0.19 | 0.03 | 0.03 | 0.01 | 0.01 | 0.02 | 0.03 | -13.57 | 0.17 | 0.00 | 9.57 | 0.84 | 0.96 | 0.22 | 0.39 |
| SEQID-01679 | 0.00 | 0.02 | 0.02 | 0.02 | 0.02 | 0.00 | 0.03 | 0.03 | 0.02 | -36.28 | 0.11 | 0.01 | 7.24 | 0.24 | 0.37 | 0.23 | 0.23 |
| SEQID-01680 | 0.02 | 0.03 | 0.06 | 0.07 | 0.06 | 0.03 | 0.06 | 0.03 | 0.06 | -14.89 | 0.38 | 0.00 | 6.51 | 0.23 | 0.33 | 0.24 | 0.24 |
| SEQID-01681 | 0.03 | 0.08 | 0.03 | 0.03 | 0.03 | 0.03 | 0.03 | 0.05 | 0.07 | -17.57 | 0.56 | 0.06 | 10.24 | 0.20 | 0.31 | 0.22 | 0.00 |
| SEQID-01682 | 0.03 | 0.08 | 0.03 | 0.08 | 0.08 | 0.02 | 0.03 | 0.03 | 0.05 | -31.94 | 0.40 | -0.19 | 3.81 | 0.21 | 0.33 | 0.00 | 0.23 |
| SEQID-01683 | 0.03 | 0.04 | 0.03 | 0.02 | 0.03 | 0.03 | 0.02 | 0.04 | 0.08 | -20.68 | 0.41 | 0.08 | 9.50 | 0.21 | 0.34 | 0.00 | 0.22 |
| SEQID-01684 | 0.02 | 0.05 | 0.05 | 0.06 | 0.04 | 0.02 | 0.05 | 0.05 | 0.04 | -20.28 | 0.38 | 0.01 | 8.43 | 0.22 | 0.32 | 0.19 | 0.23 |
| SEQID-01685 | 0.04 | 0.07 | 0.06 | 0.05 | 0.04 | 0.03 | 0.01 | 0.07 | 0.06 | -19.87 | 0.58 | -0.05 | 8.17 | 0.22 | 0.34 | 0.00 | 0.21 |
| SEQID-01686 | 0.03 | 0.04 | 0.04 | 0.04 | 0.04 | 0.01 | 0.05 | 0.04 | 0.05 | -25.43 | 0.13 | 0.02 | 5.27 | 0.29 | 0.46 | 0.00 | 0.21 |
| SEQID-01687 | 0.03 | 0.06 | 0.03 | 0.05 | 0.06 | 0.00 | 0.00 | 0.04 | 0.05 | -21.38 | 0.46 | -0.02 | 5.37 | 0.00 | 0.34 | 0.00 | 0.16 |
| SEQID-01688 | 0.03 | 0.05 | 0.06 | 0.05 | 0.06 | 0.04 | 0.02 | 0.02 | 0.08 | -16.80 | 0.55 | 0.02 | 8.74 | 0.51 | 0.70 | 0.00 | 0.00 |
| SEQID-01689 | 0.04 | 0.04 | 0.03 | 0.05 | 0.05 | 0.04 | 0.04 | 0.04 | 0.07 | -18.64 | 0.49 | 0.01 | 7.89 | 0.19 | 0.34 | 0.00 | 0.21 |
| SEQID-01690 | 0.02 | 0.04 | 0.04 | 0.10 | 0.07 | 0.01 | 0.04 | 0.06 | 0.06 | -22.89 | 0.22 | 0.01 | 3.52 | 0.59 | 0.40 | 0.20 | 0.20 |
| SEQID-01691 | 0.02 | 0.00 | 0.00 | 0.04 | 0.03 | 0.00 | 0.03 | 0.03 | 0.03 | -36.78 | 0.12 | -0.09 | 4.39 | 0.21 | 0.70 | 0.26 | 0.22 |
| SEQID-01692 | 0.04 | 0.05 | 0.03 | 0.05 | 0.04 | 0.03 | 0.05 | 0.05 | 0.05 | -19.60 | 0.40 | 0.04 | 9.78 | 0.21 | 0.32 | 0.00 | 0.20 |
| SEQID-01693 | 0.05 | 0.07 | 0.04 | 0.03 | 0.06 | 0.01 | 0.05 | 0.06 | 0.06 | -19.49 | 0.81 | -0.05 | 4.52 | 0.40 | 0.54 | 0.00 | 0.22 |
| SEQID-01694 | 0.03 | 0.04 | 0.03 | 0.04 | 0.05 | 0.00 | 0.03 | 0.04 | 0.08 | -18.98 | 0.46 | 0.02 | 9.56 | 0.21 | 0.34 | 0.20 | 0.22 |
| SEQID-01695 | 0.02 | 0.04 | 0.08 | 0.04 | 0.05 | 0.01 | 0.01 | 0.04 | 0.05 | -20.77 | 0.84 | -0.01 | 5.62 | 0.26 | 0.54 | 0.00 | 0.30 |
| SEQID-01696 | 0.00 | 0.05 | 0.03 | 0.06 | 0.11 | 0.03 | 0.02 | 0.03 | 0.07 | -23.51 | 0.85 | -0.02 | 4.88 | 0.30 | 0.19 | 0.20 | 0.36 |
| SEQID-01697 | 0.01 | 0.07 | 0.02 | 0.08 | 0.09 | 0.02 | 0.06 | 0.06 | 0.05 | -17.82 | 0.80 | 0.01 | 8.88 | 0.20 | 0.32 | 0.00 | 0.00 |
| SEQID-01698 | 0.04 | 0.05 | 0.08 | 0.06 | 0.05 | 0.01 | 0.01 | 0.04 | 0.04 | -20.82 | 0.18 | 0.08 | 9.60 | 0.18 | 0.33 | 0.00 | 0.23 |
| SEQID-01699 | 0.02 | 0.04 | 0.04 | 0.06 | 0.07 | 0.01 | 0.01 | 0.05 | 0.05 | -17.51 | 0.40 | 0.02 | 8.79 | 0.10 | 0.33 | 0.00 | 0.21 |

TABLE 1-continued

| | | | | | | | | | | | | | | | |
|---|---|---|---|---|---|---|---|---|---|---|---|---|---|---|---|
| SEQID-01700 | 0.03 | 0.03 | 0.02 | 0.05 | 0.04 | 0.00 | 0.07 | 0.04 | -25.38 | 0.85 | 0.00 | 7.40 | 0.21 | 0.33 | 0.00 | 0.00 |
| SEQID-01701 | 0.04 | 0.09 | 0.05 | 0.05 | 0.04 | 0.03 | 0.07 | 0.05 | -16.01 | 0.54 | 0.04 | 9.63 | 0.19 | 0.30 | 0.00 | 0.21 |
| SEQID-01702 | 0.02 | 0.06 | 0.04 | 0.05 | 0.06 | 0.01 | 0.06 | 0.06 | -20.11 | 0.87 | -0.05 | 4.74 | 0.95 | 1.00 | 0.20 | 0.22 |
| SEQID-01703 | 0.04 | 0.06 | 0.03 | 0.06 | 0.04 | 0.02 | 0.07 | 0.05 | -21.59 | 0.82 | 0.00 | 7.30 | 0.20 | 0.31 | 0.00 | 0.21 |
| SEQID-01704 | 0.02 | 0.02 | 0.03 | 0.04 | 0.03 | 0.02 | 0.02 | 0.03 | -24.91 | 0.22 | -0.08 | 5.14 | 0.20 | 0.37 | 0.00 | 0.21 |
| SEQID-01705 | 0.04 | 0.05 | 0.05 | 0.04 | 0.04 | 0.02 | 0.03 | 0.08 | -18.71 | 0.48 | 0.00 | 7.01 | 0.20 | 0.32 | 0.19 | 0.21 |
| SEQID-01706 | 0.04 | 0.05 | 0.04 | 0.04 | 0.04 | 0.02 | 0.04 | 0.08 | -19.28 | 0.44 | -0.01 | 5.54 | 0.20 | 0.36 | 0.00 | 0.23 |
| SEQID-01707 | 0.03 | 0.04 | 0.06 | 0.04 | 0.05 | 0.02 | 0.02 | 0.08 | -19.01 | 0.52 | 0.04 | 9.77 | 0.21 | 0.34 | 0.22 | 0.23 |
| SEQID-01708 | 0.04 | 0.05 | 0.04 | 0.04 | 0.05 | 0.03 | 0.04 | 0.07 | -19.00 | 0.45 | -0.01 | 5.91 | 0.20 | 0.33 | 0.00 | 0.21 |
| SEQID-01709 | 0.03 | 0.05 | 0.03 | 0.06 | 0.06 | 0.02 | 0.02 | 0.11 | -19.75 | 0.48 | 0.00 | 7.59 | 0.88 | 0.98 | 0.20 | 0.00 |
| SEQID-01710 | 0.03 | 0.03 | 0.06 | 0.05 | 0.04 | 0.02 | 0.04 | 0.05 | -20.59 | 0.40 | -0.01 | 6.34 | 0.20 | 0.34 | 0.00 | 0.21 |
| SEQID-01711 | 0.04 | 0.05 | 0.05 | 0.04 | 0.03 | 0.01 | 0.07 | 0.12 | -19.29 | 0.53 | 0.00 | 6.72 | 0.27 | 0.33 | 0.00 | 0.20 |
| SEQID-01712 | 0.05 | 0.05 | 0.05 | 0.03 | 0.03 | 0.01 | 0.02 | 0.12 | -19.24 | 0.54 | 0.00 | 6.72 | 0.27 | 0.33 | 0.00 | 0.18 |
| SEQID-01713 | 0.03 | 0.05 | 0.03 | 0.06 | 0.06 | 0.02 | 0.05 | 0.06 | -24.64 | 0.80 | 0.18 | 10.78 | 0.67 | 0.76 | 0.00 | 0.20 |
| SEQID-01714 | 0.03 | 0.08 | 0.03 | 0.06 | 0.06 | 0.02 | 0.04 | 0.08 | -12.35 | 0.97 | -0.01 | 5.13 | 0.20 | 0.34 | 0.19 | 0.20 |
| SEQID-01715 | 0.05 | 0.02 | 0.04 | 0.04 | 0.02 | 0.01 | 0.03 | 0.04 | -29.46 | 0.20 | 0.22 | 11.90 | 0.25 | 0.32 | 0.00 | 0.22 |
| SEQID-01716 | 0.04 | 0.02 | 0.03 | 0.05 | 0.03 | 0.02 | 0.03 | 0.04 | -29.79 | 0.14 | 0.22 | 11.90 | 0.26 | 0.31 | 0.18 | 0.10 |
| SEQID-01717 | 0.03 | 0.08 | 0.03 | 0.03 | 0.06 | 0.02 | 0.05 | 0.08 | -12.15 | 0.97 | -0.01 | 5.37 | 0.20 | 0.34 | 0.20 | 0.21 |
| SEQID-01718 | 0.01 | 0.03 | 0.04 | 0.04 | 0.04 | 0.04 | 0.07 | 0.07 | -25.61 | 0.22 | 0.21 | 12.15 | 0.23 | 0.31 | 0.00 | 0.22 |
| SEQID-01719 | 0.03 | 0.07 | 0.03 | 0.06 | 0.05 | 0.01 | 0.05 | 0.09 | -12.62 | 0.98 | -0.02 | 5.14 | 0.20 | 0.34 | 0.21 | 0.21 |
| SEQID-01720 | 0.02 | 0.05 | 0.05 | 0.04 | 0.03 | 0.06 | 0.03 | 0.08 | -20.31 | 0.88 | 0.00 | 7.19 | 0.22 | 0.33 | 0.22 | 0.22 |
| SEQID-01721 | 0.03 | 0.05 | 0.04 | 0.04 | 0.07 | 0.01 | 0.04 | 0.08 | -22.00 | 0.41 | 0.04 | 9.79 | 0.22 | 0.35 | 0.21 | 0.22 |
| SEQID-01722 | 0.03 | 0.06 | 0.04 | 0.04 | 0.02 | 0.01 | 0.05 | 0.08 | -16.23 | 0.49 | 0.00 | 6.79 | 0.37 | 0.58 | 0.00 | 0.22 |
| SEQID-01723 | 0.02 | 0.04 | 0.03 | 0.05 | 0.05 | 0.00 | 0.03 | 0.05 | -27.65 | 0.24 | 0.16 | 11.39 | 0.20 | 0.34 | 0.19 | 0.00 |
| SEQID-01724 | 0.05 | 0.04 | 0.05 | 0.06 | 0.05 | 0.02 | 0.06 | 0.06 | -19.93 | 0.44 | -0.08 | 5.06 | 0.21 | 0.34 | 0.00 | 0.19 |
| SEQID-01725 | 0.05 | 0.04 | 0.04 | 0.05 | 0.05 | 0.02 | 0.06 | 0.05 | -19.69 | 0.41 | -0.08 | 5.05 | 0.20 | 0.31 | 0.00 | 0.21 |
| SEQID-01726 | 0.04 | 0.02 | 0.04 | 0.05 | 0.03 | 0.02 | 0.02 | 0.05 | -29.76 | 0.17 | 0.22 | 12.00 | 0.26 | 0.32 | 0.20 | 0.23 |
| SEQID-01727 | 0.01 | 0.01 | 0.13 | 0.04 | 0.04 | 0.00 | 0.01 | 0.07 | -23.43 | 0.24 | 0.21 | 11.50 | 0.29 | 0.39 | 0.24 | 0.26 |
| SEQID-01728 | 0.03 | 0.04 | 0.04 | 0.05 | 0.06 | 0.01 | 0.06 | 0.06 | -20.62 | 0.42 | 0.01 | 7.71 | 0.22 | 0.33 | 0.22 | 0.21 |
| SEQID-01729 | 0.05 | 0.04 | 0.05 | 0.05 | 0.06 | 0.02 | 0.06 | 0.06 | -19.71 | 0.44 | -0.03 | 5.16 | 0.20 | 0.33 | 0.00 | 0.21 |
| SEQID-01730 | 0.04 | 0.05 | 0.07 | 0.07 | 0.05 | 0.01 | 0.05 | 0.06 | -16.27 | 0.44 | -0.01 | 8.56 | 0.21 | 0.34 | 0.00 | 0.22 |
| SEQID-01731 | 0.04 | 0.09 | 0.05 | 0.04 | 0.06 | 0.01 | 0.03 | 0.10 | -17.51 | 0.37 | 0.03 | 8.95 | 0.80 | 0.34 | 0.00 | 0.24 |
| SEQID-01732 | 0.01 | 0.04 | 0.02 | 0.01 | 0.07 | 0.00 | 0.06 | 0.06 | -25.48 | 0.31 | 0.12 | 10.46 | 0.25 | 0.31 | 0.22 | 0.00 |
| SEQID-01733 | 0.03 | 0.03 | 0.05 | 0.05 | 0.04 | 0.03 | 0.03 | 0.08 | -23.98 | 0.34 | 0.11 | 11.32 | 0.22 | 0.37 | 0.00 | 0.19 |
| SEQID-01734 | 0.04 | 0.07 | 0.04 | 0.04 | 0.05 | 0.01 | 0.02 | 0.07 | -21.67 | 0.43 | -1.02 | 5.11 | 0.21 | 0.33 | 0.00 | 0.21 |
| SEQID-01735 | 0.03 | 0.05 | 0.00 | 0.04 | 0.04 | 0.02 | 0.09 | 0.03 | -16.81 | 0.18 | 0.00 | 6.53 | 0.33 | 0.50 | 0.26 | 0.35 |
| SEQID-01736 | 0.01 | 0.04 | 0.05 | 0.12 | 0.04 | 0.02 | 0.03 | 0.04 | -31.20 | 0.13 | 0.00 | 4.73 | 0.18 | 0.23 | 0.20 | 0.23 |
| SEQID-01737 | 0.02 | 0.03 | 0.06 | 0.03 | 0.03 | 0.00 | 0.01 | 0.06 | -20.06 | 0.33 | -0.04 | 4.86 | 0.19 | 0.43 | 0.19 | 0.18 |
| SEQID-01738 | 0.02 | 0.04 | 0.07 | 0.07 | 0.03 | 0.01 | 0.02 | 0.05 | -29.01 | 0.23 | -0.04 | 4.37 | 0.28 | 0.35 | 0.26 | 0.27 |
| SEQID-01739 | 0.04 | 0.02 | 0.07 | 0.03 | 0.04 | 0.02 | 0.05 | 0.02 | -22.79 | 0.35 | 0.12 | 12.25 | 0.36 | 0.32 | 0.24 | 0.25 |
| SEQID-01740 | 0.01 | 0.04 | 0.04 | 0.05 | 0.02 | 0.04 | 0.07 | 0.07 | -16.56 | 0.51 | 0.03 | 8.54 | 0.88 | 0.53 | 0.00 | 0.25 |
| SEQID-01741 | 0.01 | 0.01 | 0.14 | 0.05 | 0.05 | 0.00 | 0.02 | 0.13 | -17.37 | 0.14 | -0.01 | 5.39 | 0.26 | 0.94 | 0.00 | 0.00 |
| SEQID-01742 | 0.03 | 0.03 | 0.02 | 0.04 | 0.05 | 0.01 | 0.07 | 0.03 | -23.90 | 0.32 | 0.23 | 11.53 | 0.23 | 0.40 | 0.27 | 0.23 |
| SEQID-01743 | 0.02 | 0.05 | 0.03 | 0.06 | 0.03 | 0.02 | 0.03 | 0.04 | -26.09 | 0.48 | -0.06 | 4.46 | 0.22 | 0.31 | 0.00 | 0.00 |
| SEQID-01744 | 0.02 | 0.04 | 0.04 | 0.05 | 0.04 | 0.02 | 0.03 | 0.09 | -18.35 | 0.30 | 0.00 | 6.53 | 0.22 | 0.35 | 0.23 | 0.23 |
| SEQID-01745 | 0.02 | 0.02 | 0.02 | 0.06 | 0.03 | 0.00 | 0.05 | 0.04 | -12.99 | 0.31 | 0.00 | 7.03 | 0.37 | 0.54 | 0.21 | 0.22 |
| SEQID-01746 | 0.02 | 0.06 | 0.02 | 0.01 | 0.05 | 0.06 | 0.04 | 0.07 | -20.06 | 0.19 | -0.01 | 6.79 | 0.21 | 0.32 | 0.23 | 0.18 |
| SEQID-01747 | 0.04 | 0.02 | 0.04 | 0.06 | 0.03 | 0.00 | 0.02 | 0.04 | -29.01 | 0.13 | -0.09 | 4.37 | 0.22 | 0.39 | 0.18 | 0.18 |
| SEQID-01748 | 0.01 | 0.01 | 0.01 | 0.21 | 0.07 | 0.02 | 0.05 | 0.02 | -22.79 | 0.48 | 0.25 | 12.25 | 0.25 | 0.23 | 0.25 | 0.25 |
| SEQID-01749 | 0.03 | 0.04 | 0.04 | 0.04 | 0.04 | 0.00 | 0.03 | 0.07 | -6.36 | 0.20 | 0.03 | 3.03 | 0.33 | 0.41 | 0.29 | 0.24 |
| SEQID-01750 | 0.04 | 0.04 | 0.03 | 0.02 | 0.05 | 0.02 | 0.03 | 0.06 | -25.48 | 0.49 | 0.17 | 11.40 | 0.21 | 0.32 | 0.23 | 0.20 |
| SEQID-01751 | 0.03 | 0.05 | 0.03 | 0.06 | 0.04 | 0.01 | 0.04 | 0.05 | -20.83 | 0.31 | -0.02 | 5.70 | 0.21 | 0.35 | 0.20 | 0.21 |
| SEQID-01752 | 0.03 | 0.05 | 0.05 | 0.03 | 0.05 | 0.04 | 0.06 | 0.04 | -20.99 | 0.33 | 0.02 | 9.01 | 0.16 | 0.35 | 0.17 | 0.18 |

TABLE 1-continued

| | | | | | | | | | | | | | | | | | | |
|---|---|---|---|---|---|---|---|---|---|---|---|---|---|---|---|---|---|---|
| SEQID-01753 | 0.02 | 0.01 | 0.03 | 0.02 | 0.06 | 0.00 | 0.06 | 0.07 | -23.82 | 0.31 | 0.18 | 12.01 | 0.00 | 0.23 | 0.00 | 0.29 |
| SEQID-01754 | 0.01 | 0.08 | 0.03 | 0.02 | 0.05 | 0.01 | 0.04 | 0.07 | -24.56 | 0.26 | 0.17 | 11.38 | 0.24 | 0.23 | 0.25 | 0.25 |
| SEQID-01755 | 0.02 | 0.09 | 0.01 | 0.08 | 0.03 | 0.05 | 0.02 | 0.04 | -14.26 | 0.60 | 0.01 | 7.87 | 0.49 | 0.59 | 0.25 | 1.00 |
| SEQID-01756 | 0.02 | 0.05 | 0.07 | 0.06 | 0.06 | 0.05 | 0.04 | 0.07 | -19.52 | 0.43 | 0.00 | 6.81 | 0.23 | 0.33 | 0.24 | 0.21 |
| SEQID-01757 | 0.02 | 0.05 | 0.06 | 0.01 | 0.06 | 0.01 | 0.07 | 0.07 | -21.11 | 0.37 | 0.00 | 7.15 | 0.20 | 0.34 | 0.00 | 0.00 |
| SEQID-01758 | 0.01 | 0.14 | 0.04 | 0.04 | 0.06 | 0.00 | 0.04 | 0.04 | -23.91 | 0.15 | 0.22 | 11.47 | 0.27 | 0.38 | 0.28 | 0.27 |
| SEQID-01759 | 0.03 | 0.04 | 0.01 | 0.03 | 0.05 | 0.01 | 0.02 | 0.06 | -23.80 | 0.35 | 0.10 | 10.82 | 0.22 | 0.31 | 0.00 | 0.00 |
| SEQID-01760 | 0.04 | 0.05 | 0.05 | 0.03 | 0.07 | 0.03 | 0.04 | 0.07 | -21.26 | 0.39 | 0.00 | 6.69 | 0.21 | 0.34 | 1.00 | 0.00 |
| SEQID-01761 | 0.02 | 0.06 | 0.07 | 0.03 | 0.05 | 0.03 | 0.02 | 0.09 | -15.03 | 0.55 | 0.00 | 6.67 | 0.27 | 0.46 | 0.21 | 0.22 |
| SEQID-01762 | 0.03 | 0.05 | 0.04 | 0.08 | 0.05 | 0.03 | 0.03 | 0.09 | -17.42 | 0.45 | 0.02 | 8.86 | 0.61 | 0.88 | 0.00 | 0.21 |
| SEQID-01763 | 0.02 | 0.03 | 0.03 | 0.05 | 0.05 | 0.01 | 0.03 | 0.04 | -26.38 | 0.34 | 0.02 | 9.46 | 0.21 | 0.36 | 0.22 | 0.22 |
| SEQID-01764 | 0.03 | 0.08 | 0.05 | 0.05 | 0.06 | 0.00 | 0.00 | 0.07 | -17.92 | 0.64 | 0.12 | 10.11 | 0.32 | 0.32 | 0.30 | 0.31 |
| SEQID-01765 | 0.02 | 0.05 | 0.04 | 0.03 | 0.07 | 0.00 | 0.02 | 0.04 | -23.97 | 0.30 | 0.15 | 11.86 | 0.23 | 0.31 | 0.26 | 0.00 |
| SEQID-01766 | 0.01 | 0.05 | 0.03 | 0.06 | 0.06 | 0.06 | 0.05 | 0.08 | -23.42 | 0.37 | -0.03 | 5.87 | 0.25 | 0.30 | 0.00 | 0.21 |
| SEQID-01767 | 0.04 | 0.07 | 0.05 | 0.04 | 0.02 | 0.06 | 0.04 | 0.08 | -19.94 | 0.40 | 0.00 | 7.76 | 0.27 | 0.32 | 0.00 | 0.24 |
| SEQID-01768 | 0.01 | 0.03 | 0.04 | 0.04 | 0.05 | 0.02 | 0.05 | 0.04 | -29.34 | 0.19 | 0.22 | 11.43 | 0.23 | 0.31 | 0.23 | 0.24 |
| SEQID-01769 | 0.02 | 0.07 | 0.06 | 0.04 | 0.04 | 0.01 | 0.04 | 0.04 | -20.43 | 0.34 | -0.03 | 5.16 | 0.26 | 0.33 | 0.22 | 0.21 |
| SEQID-01770 | 0.02 | 0.04 | 0.05 | 0.04 | 0.04 | 0.01 | 0.04 | 0.08 | -19.28 | 0.34 | 0.13 | 11.66 | 0.00 | 0.35 | 0.22 | 0.24 |
| SEQID-01771 | 0.04 | 0.03 | 0.01 | 0.03 | 0.05 | 0.02 | 0.03 | 0.10 | -17.25 | 0.53 | -0.01 | 5.98 | 0.25 | 0.34 | 0.19 | 0.22 |
| SEQID-01772 | 0.03 | 0.07 | 0.05 | 0.06 | 0.04 | 0.03 | 0.06 | 0.08 | -22.03 | 0.34 | -0.01 | 6.42 | 0.22 | 0.36 | 0.00 | 0.20 |
| SEQID-01773 | 0.03 | 0.04 | 0.03 | 0.05 | 0.04 | 0.02 | 0.05 | 0.07 | -19.84 | 0.40 | -0.02 | 4.95 | 0.89 | 0.98 | 0.22 | 0.22 |
| SEQID-01774 | 0.02 | 0.05 | 0.05 | 0.05 | 0.03 | 0.01 | 0.06 | 0.05 | -18.41 | 0.45 | 0.00 | 6.62 | 0.21 | 0.33 | 0.00 | 0.22 |
| SEQID-01775 | 0.05 | 0.05 | 0.04 | 0.04 | 0.04 | 0.02 | 0.04 | 0.07 | -20.94 | 0.40 | -0.01 | 6.28 | 0.19 | 0.33 | 0.00 | 0.21 |
| SEQID-01776 | 0.05 | 0.02 | 0.05 | 0.03 | 0.06 | 0.00 | 0.01 | 0.06 | -28.61 | 0.28 | 0.24 | 12.14 | 0.26 | 0.31 | 0.21 | 0.20 |
| SEQID-01777 | 0.03 | 0.06 | 0.04 | 0.05 | 0.05 | 0.01 | 0.01 | 0.11 | -19.18 | 0.65 | -0.01 | 6.67 | 0.60 | 0.69 | 0.00 | 0.20 |
| SEQID-01778 | 0.02 | 0.02 | 0.07 | 0.02 | 0.03 | 0.04 | 0.05 | 0.10 | -14.55 | 0.53 | 0.05 | 10.62 | 0.37 | 0.41 | 0.25 | 1.00 |
| SEQID-01779 | 0.03 | 0.08 | 0.01 | 0.08 | 0.03 | 0.01 | 0.05 | 0.06 | -24.77 | 0.26 | -0.01 | 5.29 | 0.22 | 0.29 | 0.28 | 0.23 |
| SEQID-01780 | 0.03 | 0.06 | 0.05 | 0.02 | 0.06 | 0.02 | 0.05 | 0.07 | -21.15 | 0.33 | 0.18 | 11.37 | 0.23 | 0.30 | 0.21 | 0.19 |
| SEQID-01781 | 0.01 | 0.07 | 0.04 | 0.05 | 0.04 | 0.01 | 0.04 | 0.06 | -21.09 | 0.35 | 0.17 | 11.28 | 0.25 | 0.30 | 0.00 | 0.22 |
| SEQID-01782 | 0.04 | 0.05 | 0.05 | 0.03 | 0.05 | 0.02 | 0.02 | 0.06 | -26.59 | 0.30 | 0.13 | 11.42 | 0.25 | 0.33 | 0.20 | 0.20 |
| SEQID-01783 | 0.13 | 0.00 | 0.07 | 0.05 | 0.03 | 0.01 | 0.12 | 0.04 | -6.89 | 0.52 | 0.01 | 8.00 | 0.26 | 0.34 | 0.00 | 0.23 |
| SEQID-01784 | 0.04 | 0.07 | 0.04 | 0.07 | 0.06 | 0.03 | 0.08 | 0.05 | -21.92 | 0.25 | 0.15 | 11.07 | 0.23 | 0.28 | 0.00 | 0.00 |
| SEQID-01785 | 0.02 | 0.05 | 0.03 | 0.04 | 0.02 | 0.01 | 0.05 | 0.06 | -25.46 | 0.28 | 0.10 | 10.94 | 0.21 | 0.33 | 0.20 | 0.00 |
| SEQID-01786 | 0.02 | 0.06 | 0.02 | 0.05 | 0.06 | 0.02 | 0.04 | 0.03 | -22.05 | 0.39 | 0.01 | 8.44 | 0.00 | 0.30 | 0.20 | 0.24 |
| SEQID-01787 | 0.03 | 0.05 | 0.04 | 0.05 | 0.04 | 0.01 | 0.05 | 0.06 | -23.74 | 0.25 | 0.13 | 10.91 | 0.21 | 0.31 | 0.00 | 0.25 |
| SEQID-01788 | 0.02 | 0.08 | 0.04 | 0.08 | 0.05 | 0.01 | 0.02 | 0.08 | -17.07 | 0.47 | 0.03 | 9.88 | 0.24 | 0.81 | 0.26 | 0.24 |
| SEQID-01789 | 0.04 | 0.04 | 0.04 | 0.04 | 0.04 | 0.00 | 0.03 | 0.05 | -11.71 | 0.93 | 0.04 | 10.01 | 0.23 | 0.35 | 0.00 | 0.24 |
| SEQID-01790 | 0.03 | 0.05 | 0.02 | 0.02 | 0.03 | 0.01 | 0.04 | 0.06 | -25.32 | 0.30 | 0.08 | 10.48 | 0.21 | 0.31 | 0.00 | 0.00 |
| SEQID-01791 | 0.04 | 0.07 | 0.04 | 0.05 | 0.05 | 0.01 | 0.03 | 0.10 | -18.66 | 0.49 | 0.00 | 6.72 | 0.24 | 0.32 | 0.23 | 0.22 |
| SEQID-01792 | 0.03 | 0.03 | 0.03 | 0.04 | 0.04 | 0.00 | 0.05 | 0.09 | -21.19 | 0.46 | 0.01 | 5.90 | 0.21 | 0.37 | 0.22 | 0.23 |
| SEQID-01793 | 0.02 | 0.04 | 0.03 | 0.04 | 0.05 | 0.00 | 0.02 | 0.07 | -19.85 | 0.47 | -0.01 | 6.37 | 0.22 | 0.33 | 0.00 | 0.22 |
| SEQID-01794 | 0.04 | 0.08 | 0.05 | 0.05 | 0.04 | 0.00 | 0.04 | 0.08 | -18.17 | 0.32 | -0.02 | 6.31 | 0.19 | 0.32 | 0.00 | 0.21 |
| SEQID-01795 | 0.01 | 0.01 | 0.04 | 0.04 | 0.07 | 0.03 | 0.07 | 0.06 | -19.95 | 0.20 | 0.25 | 11.95 | 0.25 | 0.30 | 0.26 | 0.25 |
| SEQID-01796 | 0.02 | 0.02 | 0.03 | 0.05 | 0.04 | 0.00 | 0.03 | 0.08 | -25.22 | 0.26 | 0.24 | 11.90 | 0.24 | 0.31 | 0.27 | 0.24 |
| SEQID-01797 | 0.06 | 0.04 | 0.03 | 0.03 | 0.04 | 0.01 | 0.06 | 0.06 | -26.89 | 0.85 | 0.03 | 10.18 | 0.58 | 0.79 | 0.30 | 0.23 |
| SEQID-01798 | 0.05 | 0.03 | 0.06 | 0.04 | 0.05 | 0.00 | 0.03 | 0.10 | -11.76 | 0.40 | 0.01 | 8.46 | 0.39 | 0.52 | 0.23 | 0.25 |
| SEQID-01799 | 0.05 | 0.05 | 0.05 | 0.01 | 0.06 | 0.02 | 0.05 | 0.05 | -26.63 | 0.26 | 0.00 | 6.94 | 0.22 | 0.32 | 0.22 | 0.22 |
| SEQID-01800 | 0.05 | 0.09 | 0.05 | 0.05 | 0.05 | 0.01 | 0.06 | 0.06 | -21.19 | 0.36 | 0.01 | 8.43 | 0.22 | 0.33 | 0.28 | 0.23 |
| SEQID-01801 | 0.01 | 0.01 | 0.04 | 0.03 | 0.04 | 0.00 | 0.01 | 0.07 | -18.98 | 0.10 | -0.01 | 5.90 | 0.29 | 0.49 | 0.00 | 0.32 |
| SEQID-01802 | 0.03 | 0.03 | 0.02 | 0.04 | 0.02 | 0.10 | 0.00 | 0.03 | -22.83 | 0.42 | 0.16 | 6.26 | 0.00 | 0.30 | 0.00 | 0.24 |
| SEQID-01803 | 0.04 | 0.04 | 0.05 | 0.03 | 0.05 | 0.02 | 0.04 | 0.08 | -14.04 | 0.78 | -0.01 | 12.03 | 0.25 | 0.34 | 0.25 | 0.24 |
| SEQID-01804 | 0.01 | 0.07 | 0.03 | 0.05 | 0.03 | 0.04 | 0.07 | 0.05 | -16.72 | 0.46 | -0.01 | 5.64 | 0.25 | 0.31 | 0.00 | 0.00 |
| SEQID-01805 | 0.04 | 0.05 | 0.03 | 0.04 | 0.04 | 0.01 | 0.04 | 0.09 | -21.68 | 0.44 | 0.05 | 10.22 | 0.23 | 0.30 | 0.00 | 0.00 |

TABLE 1-continued

| SEQID | | | | | | | | | | | | | | | | | |
|---|---|---|---|---|---|---|---|---|---|---|---|---|---|---|---|---|---|
| SEQID-01806 | 0.03 | 0.03 | 0.06 | 0.05 | 0.04 | 0.05 | 0.01 | 0.02 | 0.06 | -23.13 | 0.34 | 0.01 | 7.97 | 0.00 | 0.31 | 0.23 | 0.00 |
| SEQID-01807 | 0.02 | 0.04 | 0.05 | 0.02 | 0.04 | 0.02 | 0.02 | 0.02 | 0.07 | -24.75 | 0.37 | 0.14 | 11.12 | 0.00 | 0.31 | 0.24 | 0.21 |
| SEQID-01808 | 0.01 | 0.08 | 0.04 | 0.05 | 0.07 | 0.03 | 0.03 | 0.07 | 0.08 | -11.36 | 0.94 | 0.01 | 7.97 | 0.23 | 0.33 | 0.00 | 0.21 |
| SEQID-01809 | 0.02 | 0.06 | 0.05 | 0.03 | 0.05 | 0.02 | 0.02 | 0.02 | 0.09 | -20.81 | 0.41 | 0.08 | 10.85 | 0.23 | 0.31 | 0.20 | 0.26 |
| SEQID-01810 | 0.04 | 0.08 | 0.04 | 0.04 | 0.07 | 0.05 | 0.02 | 0.05 | 0.07 | -14.40 | 0.53 | 0.05 | 10.22 | 0.22 | 0.31 | 0.00 | 0.15 |
| SEQID-01811 | 0.02 | 0.05 | 0.03 | 0.06 | 0.05 | 0.04 | 0.00 | 0.08 | 0.04 | -26.68 | 0.27 | 0.04 | 9.78 | 0.19 | 0.37 | 0.00 | 0.23 |
| SEQID-01812 | 0.02 | 0.05 | 0.05 | 0.06 | 0.04 | 0.04 | 0.00 | 0.00 | 0.09 | -21.32 | 0.56 | -0.02 | 4.93 | 0.23 | 0.49 | 0.00 | 0.00 |
| SEQID-01813 | 0.02 | 0.07 | 0.07 | 0.09 | 0.04 | 0.07 | 0.01 | 0.05 | 0.09 | -9.80 | 0.68 | 0.00 | 7.68 | 0.22 | 0.32 | 0.22 | 0.21 |
| SEQID-01814 | 0.03 | 0.09 | 0.03 | 0.06 | 0.03 | 0.03 | 0.02 | 0.03 | 0.05 | -16.57 | 0.45 | 0.06 | 10.35 | 0.21 | 0.33 | 0.00 | 0.21 |
| SEQID-01815 | 0.04 | 0.08 | 0.04 | 0.06 | 0.04 | 0.04 | 0.07 | 0.02 | 0.07 | -17.44 | 0.77 | 0.05 | 10.58 | 0.21 | 0.32 | 0.18 | 0.19 |
| SEQID-01816 | 0.03 | 0.07 | 0.05 | 0.07 | 0.05 | 0.05 | 0.02 | 0.04 | 0.09 | -11.10 | 0.84 | 0.06 | 10.53 | 0.21 | 0.31 | 0.00 | 0.22 |
| SEQID-01817 | 0.05 | 0.08 | 0.05 | 0.09 | 0.04 | 0.04 | 0.04 | 0.05 | 0.08 | -11.63 | 0.77 | 0.04 | 10.12 | 0.21 | 0.30 | 0.00 | 0.20 |
| SEQID-01818 | 0.04 | 0.04 | 0.06 | 0.06 | 0.06 | 0.03 | 0.03 | 0.04 | 0.03 | -17.52 | 0.45 | -0.01 | 6.14 | 0.25 | 0.32 | 0.00 | 0.24 |
| SEQID-01819 | 0.02 | 0.08 | 0.04 | 0.03 | 0.03 | 0.02 | 0.02 | 0.03 | 0.06 | -23.99 | 0.39 | 0.00 | 6.74 | 0.23 | 0.32 | 0.00 | 0.22 |
| SEQID-01820 | 0.03 | 0.06 | 0.05 | 0.06 | 0.06 | 0.04 | 0.04 | 0.07 | 0.06 | -17.01 | 0.43 | 0.01 | 8.42 | 0.22 | 0.31 | 0.00 | 0.22 |
| SEQID-01821 | 0.01 | 0.05 | 0.05 | 0.06 | 0.04 | 0.06 | 0.04 | 0.05 | 0.08 | -20.56 | 0.44 | -0.02 | 4.99 | 0.21 | 0.34 | 0.00 | 0.22 |
| SEQID-01822 | 0.03 | 0.09 | 0.03 | 0.03 | 0.05 | 0.05 | 0.01 | 0.06 | 0.07 | -12.55 | 0.92 | 0.02 | 9.11 | 0.20 | 0.33 | 0.00 | 0.22 |
| SEQID-01823 | 0.03 | 0.05 | 0.05 | 0.05 | 0.04 | 0.04 | 0.01 | 0.06 | 0.05 | -19.29 | 0.44 | -0.02 | 5.12 | 0.21 | 0.30 | 0.00 | 0.21 |
| SEQID-01824 | 0.02 | 0.02 | 0.04 | 0.04 | 0.04 | 0.02 | 0.00 | 0.02 | 0.09 | -17.75 | 0.51 | 0.00 | 7.07 | 0.21 | 0.35 | 0.20 | 0.21 |
| SEQID-01825 | 0.03 | 0.07 | 0.01 | 0.03 | 0.05 | 0.04 | 0.05 | 0.08 | 0.05 | -18.27 | 0.71 | 0.09 | 10.32 | 0.31 | 0.28 | 0.00 | 0.00 |
| SEQID-01826 | 0.06 | 0.02 | 0.02 | 0.06 | 0.06 | 0.10 | 0.02 | 0.02 | 0.16 | -18.59 | 0.39 | -0.01 | 5.02 | 0.30 | 0.30 | 0.26 | 0.24 |
| SEQID-01627 | 0.05 | 0.12 | 0.06 | 0.05 | 0.04 | 0.04 | 0.00 | 0.05 | 0.06 | -14.20 | 0.51 | -0.02 | 6.07 | 0.53 | 0.60 | 0.00 | 0.22 |
| SEQID-01828 | 0.02 | 0.02 | 0.03 | 0.04 | 0.03 | 0.06 | 0.04 | 0.04 | 0.06 | -18.73 | 0.48 | 0.08 | 10.91 | 0.24 | 0.30 | 0.31 | 0.22 |
| SEQID-01829 | 0.01 | 0.03 | 0.07 | 0.02 | 0.07 | 0.05 | 0.05 | 0.07 | 0.07 | -23.75 | 0.29 | -0.02 | 11.60 | 0.23 | 0.30 | 0.00 | 0.26 |
| SEQID-01830 | 0.03 | 0.04 | 0.06 | 0.04 | 0.06 | 0.10 | 0.00 | 0.01 | 0.10 | -19.88 | 0.43 | 0.17 | 9.21 | 0.26 | 0.34 | 0.23 | 0.26 |
| SEQID-01831 | 0.03 | 0.05 | 0.04 | 0.04 | 0.07 | 0.04 | 0.01 | 0.01 | 0.06 | -23.32 | 0.35 | 0.02 | 11.36 | 0.24 | 0.33 | 0.16 | 0.23 |
| SEQID-01832 | 0.02 | 0.05 | 0.04 | 0.06 | 0.05 | 0.03 | 0.00 | 0.06 | 0.07 | -21.28 | 0.28 | 0.09 | 10.53 | 0.22 | 0.32 | 0.00 | 0.21 |
| SEQID-01833 | 0.05 | 0.02 | 0.04 | 0.04 | 0.05 | 0.02 | 0.02 | 0.03 | 0.12 | -18.22 | 0.58 | 0.00 | 7.15 | 0.19 | 0.30 | 0.20 | 0.21 |
| SEQID-01334 | 0.02 | 0.05 | 0.05 | 0.02 | 0.04 | 0.05 | 0.00 | 0.08 | 0.07 | -23.53 | 0.36 | 0.15 | 11.29 | 0.24 | 0.31 | 0.24 | 0.25 |
| SEQID-01835 | 0.01 | 0.09 | 0.05 | 0.07 | 0.04 | 0.05 | 0.03 | 0.00 | 0.07 | -25.23 | 0.26 | -0.01 | 5.78 | 0.74 | 0.88 | 0.00 | 0.21 |
| SEQID-01836 | 0.03 | 0.03 | 0.04 | 0.02 | 0.04 | 0.04 | 0.03 | 0.05 | 0.05 | -18.59 | 0.62 | -0.04 | 4.41 | 0.27 | 0.35 | 0.21 | 0.28 |
| SEQID-01837 | 0.01 | 0.02 | 0.05 | 0.05 | 0.03 | 0.05 | 0.02 | 0.04 | 0.06 | -19.08 | 0.62 | -0.01 | 6.25 | 0.27 | 0.32 | 0.26 | 0.25 |
| SEQID-01838 | 0.02 | 0.03 | 0.06 | 0.03 | 0.06 | 0.06 | 0.01 | 0.05 | 0.10 | -21.38 | 0.32 | 0.12 | 11.06 | 0.22 | 0.28 | 0.00 | 0.25 |
| SEQID-01839 | 0.03 | 0.06 | 0.01 | 0.03 | 0.07 | 0.07 | 0.04 | 0.04 | 0.06 | -20.86 | 0.45 | 0.00 | 6.80 | 0.22 | 0.31 | 0.00 | 0.25 |
| SEQID-01840 | 0.04 | 0.04 | 0.05 | 0.04 | 0.04 | 0.04 | 0.03 | 0.06 | 0.12 | -18.59 | 0.47 | -0.02 | 5.34 | 0.25 | 0.33 | 0.21 | 0.23 |
| SEQID-01841 | 0.02 | 0.07 | 0.06 | 0.06 | 0.05 | 0.05 | 0.05 | 0.03 | 0.05 | -24.15 | 0.39 | 0.10 | 10.85 | 0.23 | 0.31 | 0.00 | 0.00 |
| SEQID-01842 | 0.04 | 0.01 | 0.04 | 0.05 | 0.05 | 0.03 | 0.01 | 0.08 | 0.07 | -25.12 | 0.36 | 0.13 | 10.87 | 0.20 | 0.31 | 0.20 | 0.00 |
| SEQID-01843 | 0.03 | 0.06 | 0.01 | 0.02 | 0.03 | 0.05 | 0.01 | 0.06 | 0.06 | -23.04 | 0.39 | -0.01 | 5.80 | 0.22 | 0.29 | 0.00 | 0.00 |
| SEQID-01844 | 0.03 | 0.04 | 0.06 | 0.08 | 0.02 | 0.05 | 0.02 | 0.05 | 0.10 | -23.20 | 0.42 | -0.02 | 5.39 | 0.20 | 0.33 | 0.00 | 0.22 |
| SEQID-01845 | 0.04 | 0.05 | 0.38 | 0.04 | 0.20 | 0.07 | 0.01 | 0.09 | 0.07 | -21.00 | 0.36 | 0.00 | 6.79 | 0.22 | 0.30 | 0.20 | 0.20 |
| SEQID-01846 | 0.02 | 0.03 | 0.05 | 0.05 | 0.02 | 0.04 | 0.01 | 0.04 | 0.07 | -16.96 | 0.39 | 0.00 | 7.32 | 0.81 | 0.91 | 0.23 | 0.00 |
| SEQID-01847 | 0.02 | 0.08 | 0.04 | 0.03 | 0.07 | 0.03 | 0.05 | 0.01 | 0.07 | -16.06 | 0.59 | -0.01 | 6.23 | 0.75 | 0.94 | 0.21 | 0.00 |
| SEQID-01848 | 0.02 | 0.02 | 0.05 | 0.07 | 0.04 | 0.04 | 0.01 | 0.00 | 0.08 | -19.65 | 0.63 | 0.00 | 8.90 | 0.23 | 0.33 | 0.24 | 0.00 |
| SEQID-01849 | 0.03 | 0.05 | 0.04 | 0.06 | 0.04 | 0.07 | 0.00 | 0.03 | 0.12 | -18.97 | 0.54 | 0.01 | 9.46 | 0.17 | 0.34 | 0.23 | 0.00 |
| SEQID-01850 | 0.01 | 0.07 | 0.06 | 0.05 | 0.06 | 0.04 | 0.03 | 0.05 | 0.05 | -12.44 | 0.40 | 0.02 | 8.62 | 0.24 | 0.31 | 0.20 | 0.23 |
| SEQID-01851 | 0.02 | 0.04 | 0.05 | 0.02 | 0.05 | 0.04 | 0.05 | 0.08 | 0.06 | -25.38 | 0.30 | 0.04 | 10.72 | 0.51 | 0.65 | 0.19 | 0.24 |
| SEQID-01852 | 0.02 | 0.06 | 0.03 | 0.06 | 0.04 | 0.01 | 0.02 | 0.06 | 0.06 | -15.19 | 0.11 | 0.10 | 7.81 | 0.23 | 0.33 | 0.22 | 0.00 |
| SEQID-01853 | 0.00 | 0.00 | 0.06 | 0.04 | 0.01 | 0.01 | 0.09 | 0.05 | 0.04 | -12.64 | 0.12 | 0.01 | 10.61 | 0.29 | 0.49 | 0.23 | 0.29 |
| SEQID-01854 | 0.04 | 0.05 | 0.38 | 0.05 | 0.02 | 0.01 | 0.00 | 0.00 | 0.01 | -19.12 | 0.53 | 0.10 | 5.47 | 0.26 | 0.54 | 0.29 | 0.25 |
| SEQID-01855 | 0.03 | 0.08 | 0.05 | 0.05 | 0.04 | 0.01 | 0.01 | 0.04 | 0.08 | -18.77 | 0.58 | -0.01 | 5.23 | 0.21 | 0.33 | 0.00 | 0.00 |
| SEQID-01856 | 0.03 | 0.05 | 0.04 | 0.07 | 0.04 | 0.05 | 0.02 | 0.02 | 0.07 | -17.27 | 0.52 | -0.02 | 8.03 | 0.00 | 0.71 | 0.00 | 0.19 |
| SEQID-01857 | 0.03 | 0.05 | 0.05 | 0.04 | 0.04 | 0.05 | 0.02 | 0.03 | 0.11 | -17.00 | 0.54 | 0.00 | 6.82 | 0.53 | 0.35 | 0.20 | 0.22 |
| SEQID-01858 | 0.03 | 0.07 | 0.06 | 0.06 | 0.03 | 0.03 | 0.01 | 0.04 | 0.08 | -16.63 | 0.53 | 0.01 | 8.46 | 0.28 | 0.35 | 0.00 | 0.22 |

TABLE 1-continued

| | | | | | | | | | | | | | |
|---|---|---|---|---|---|---|---|---|---|---|---|---|---|
| SEQID-01859 | 0.03 | 0.06 | 0.05 | 0.05 | 0.05 | 0.01 | 0.04 | 0.07 | -17.33 | 0.54 | 0.01 | 7.73 | 0.22 | 0.33 | 0.20 | 0.22 |
| SEQID-01860 | 0.03 | 0.05 | 0.04 | 0.04 | 0.04 | 0.02 | 0.04 | 0.09 | -20.27 | 0.38 | -0.02 | 5.18 | 0.22 | 0.34 | 0.22 | 0.23 |
| SEQID-01861 | 0.04 | 0.09 | 0.04 | 0.06 | 0.04 | 0.03 | 0.05 | 0.06 | -12.27 | 0.91 | 0.03 | 9.53 | 0.20 | 0.33 | 0.00 | 0.21 |
| SEQID-01862 | 0.02 | 0.03 | 0.05 | 0.06 | 0.07 | 0.01 | 0.03 | 0.07 | -19.54 | 0.41 | 0.00 | 7.45 | 0.21 | 0.34 | 0.18 | 0.21 |
| SEQID-01863 | 0.03 | 0.04 | 0.03 | 0.04 | 0.06 | 0.01 | 0.03 | 0.06 | -23.07 | 0.38 | -0.03 | 4.84 | 0.71 | 0.91 | 0.00 | 0.20 |
| SEQID-01864 | 0.03 | 0.07 | 0.01 | 0.05 | 0.05 | 0.01 | 0.03 | 0.07 | -18.51 | 0.52 | 0.02 | 9.23 | 0.19 | 0.33 | 0.20 | 0.20 |
| SEQID-01865 | 0.03 | 0.04 | 0.01 | 0.04 | 0.05 | 0.01 | 0.03 | 0.04 | -28.16 | 0.23 | -0.02 | 5.50 | 0.18 | 0.58 | 0.18 | 0.18 |
| SEQID-01866 | 0.03 | 0.04 | 0.01 | 0.04 | 0.05 | 0.01 | 0.03 | 0.04 | -28.15 | 0.23 | -0.02 | 5.56 | 0.18 | 0.55 | 0.18 | 0.17 |
| SEQID-01867 | 0.03 | 0.04 | 0.01 | 0.04 | 0.04 | 0.01 | 0.03 | 0.04 | -28.30 | 0.22 | -0.02 | 5.50 | 0.19 | 0.55 | 0.18 | 0.17 |
| SEQID-01868 | 0.03 | 0.04 | 0.04 | 0.04 | 0.05 | 0.01 | 0.03 | 0.04 | -28.42 | 0.23 | -0.03 | 5.48 | 0.18 | 0.53 | 0.18 | 0.19 |
| SEQID-01869 | 0.05 | 0.04 | 0.04 | 0.05 | 0.06 | 0.02 | 0.06 | 0.05 | -19.69 | 0.41 | 0.01 | 5.05 | 0.19 | 0.30 | 0.00 | 0.20 |
| SEQID-01870 | 0.02 | 0.04 | 0.06 | 0.05 | 0.08 | 0.01 | 0.04 | 0.08 | -22.75 | 0.31 | 0.01 | 8.67 | 0.18 | 0.35 | 0.18 | 0.19 |
| SEQID-01871 | 0.03 | 0.06 | 0.03 | 0.03 | 0.04 | 0.02 | 0.06 | 0.06 | -22.38 | 0.34 | 0.00 | 7.11 | 0.19 | 0.31 | 0.00 | 0.20 |
| SEQID-01872 | 0.03 | 0.04 | 0.04 | 0.04 | 0.04 | 0.03 | 0.04 | 0.03 | -24.32 | 0.29 | -0.03 | 5.13 | 0.20 | 0.36 | 0.19 | 0.20 |
| SEQID-01873 | 0.03 | 0.05 | 0.04 | 0.05 | 0.06 | 0.02 | 0.04 | 0.07 | -23.56 | 0.32 | 0.00 | 7.11 | 0.42 | 0.54 | 0.19 | 0.20 |
| SEQID-01874 | 0.00 | 0.07 | 0.04 | 0.03 | 0.04 | 0.01 | 0.05 | 0.05 | -24.99 | 0.33 | -0.01 | 6.33 | 0.80 | 0.90 | 0.00 | 0.00 |
| SEQID-01875 | 0.03 | 0.05 | 0.03 | 0.04 | 0.04 | 0.01 | 0.04 | 0.07 | -20.83 | 0.43 | 0.01 | 8.12 | 0.85 | 0.99 | 0.00 | 0.22 |
| SEQID-01876 | 0.04 | 0.05 | 0.04 | 0.04 | 0.06 | 0.02 | 0.03 | 0.08 | -19.08 | 0.62 | -0.02 | 4.92 | 0.19 | 0.35 | 0.00 | 0.22 |
| SEQID-01877 | 0.04 | 0.04 | 0.04 | 0.04 | 0.05 | 0.01 | 0.03 | 0.08 | -20.69 | 0.45 | 0.01 | 7.94 | 0.22 | 0.31 | 0.00 | 0.20 |
| SEQID-01878 | 0.04 | 0.04 | 0.03 | 0.03 | 0.04 | 0.03 | 0.03 | 0.04 | -23.47 | 0.31 | -0.03 | 5.12 | 0.21 | 0.34 | 0.00 | 0.22 |
| SEQID-01879 | 0.04 | 0.06 | 0.03 | 0.05 | 0.06 | 0.02 | 0.04 | 0.09 | -17.84 | 0.47 | 0.02 | 8.58 | 0.69 | 0.85 | 0.00 | 0.21 |
| SEQID-01880 | 0.04 | 0.06 | 0.04 | 0.05 | 0.06 | 0.03 | 0.03 | 0.08 | -18.26 | 0.64 | -0.02 | 4.99 | 0.18 | 0.35 | 0.19 | 0.20 |
| SEQID-01881 | 0.02 | 0.04 | 0.06 | 0.04 | 0.05 | 0.03 | 0.05 | 0.07 | -23.52 | 0.30 | -0.01 | 6.23 | 0.19 | 0.33 | 0.19 | 0.20 |
| SEQID-01882 | 0.01 | 0.05 | 0.18 | 0.03 | 0.03 | 0.01 | 0.02 | 0.04 | -13.80 | 0.20 | 0.00 | 9.54 | 0.95 | 1.00 | 0.21 | 0.39 |
| SEQID-01883 | 0.04 | 0.03 | 0.03 | 0.05 | 0.04 | 0.01 | 0.09 | 0.04 | -24.90 | 0.20 | 0.01 | 9.62 | 0.18 | 0.33 | 0.00 | 0.18 |
| SEQID-01884 | 0.01 | 0.08 | 0.03 | 0.03 | 0.05 | 0.02 | 0.07 | 0.06 | -21.41 | 0.25 | 0.04 | 8.46 | 0.22 | 0.30 | 0.19 | 0.23 |
| SEQID-01885 | 0.04 | 0.06 | 0.06 | 0.03 | 0.05 | 0.05 | 0.02 | 0.05 | -23.23 | 0.36 | 0.07 | 4.61 | 0.33 | 0.46 | 0.21 | 0.25 |
| SEQID-01886 | 0.01 | 0.04 | 0.04 | 0.04 | 0.05 | 0.00 | 0.02 | 0.09 | -19.17 | 0.44 | -0.04 | 7.03 | 0.65 | 0.34 | 0.00 | 0.22 |
| SEQID-01887 | 0.03 | 0.05 | 0.03 | 0.04 | 0.04 | 0.03 | 0.04 | 0.06 | -21.09 | 0.44 | 0.00 | 4.95 | 0.00 | 0.41 | 0.00 | 0.18 |
| SEQID-01888 | 0.03 | 0.09 | 0.02 | 0.04 | 0.03 | 0.03 | 0.06 | 0.07 | -16.87 | 0.54 | 0.07 | 10.33 | 0.21 | 0.34 | 0.00 | 0.00 |
| SEQID-01889 | 0.05 | 0.09 | 0.03 | 0.04 | 0.05 | 0.01 | 0.02 | 0.05 | -25.05 | 0.32 | -0.04 | 4.61 | 0.41 | 0.59 | 0.25 | 0.23 |
| SEQID-01890 | 0.04 | 0.05 | 0.04 | 0.05 | 0.03 | 0.02 | 0.01 | 0.09 | -20.27 | 0.44 | 0.01 | 8.04 | 0.22 | 0.35 | 0.21 | 0.22 |
| SEQID-01891 | 0.02 | 0.05 | 0.05 | 0.06 | 0.03 | 0.03 | 0.05 | 0.09 | -22.19 | 0.34 | -0.03 | 5.09 | 0.19 | 0.34 | 0.19 | 0.18 |
| SEQID-01892 | 0.03 | 0.03 | 0.03 | 0.05 | 0.05 | 0.03 | 0.03 | 0.10 | -18.61 | 0.56 | 0.01 | 8.23 | 0.23 | 0.31 | 0.00 | 0.21 |
| SEQID-01893 | 0.02 | 0.05 | 0.06 | 0.04 | 0.05 | 0.03 | 0.05 | 0.09 | -23.86 | 0.30 | 0.00 | 6.49 | 0.19 | 0.35 | 0.19 | 0.30 |
| SEQID-01894 | 0.01 | 0.05 | 0.07 | 0.05 | 0.01 | 0.01 | 0.03 | 0.05 | -20.39 | 0.32 | 0.02 | 7.97 | 0.23 | 0.36 | 0.23 | 0.23 |
| SEQID-01895 | 0.04 | 0.03 | 0.05 | 0.04 | 0.04 | 0.02 | 0.06 | 0.05 | -23.30 | 0.27 | 0.04 | 9.03 | 0.21 | 0.31 | 0.00 | 0.22 |
| SEQID-01896 | 0.02 | 0.06 | 0.03 | 0.03 | 0.05 | 0.02 | 0.09 | 0.06 | -25.22 | 0.18 | 0.02 | 9.62 | 0.00 | 0.30 | 0.00 | 0.20 |
| SEQID-01897 | 0.02 | 0.02 | 0.02 | 0.06 | 0.07 | 0.02 | 0.04 | 0.09 | -25.35 | 0.18 | 0.04 | 4.94 | 0.30 | 0.34 | 0.21 | 0.18 |
| SEQID-01898 | 0.03 | 0.05 | 0.04 | 0.04 | 0.05 | 0.02 | 0.04 | 0.06 | -19.06 | 0.43 | -0.03 | 7.01 | 0.21 | 0.45 | 0.20 | 0.23 |
| SEQID-01899 | 0.03 | 0.07 | 0.04 | 0.04 | 0.05 | 0.04 | 0.05 | 0.05 | -19.24 | 0.34 | 0.00 | 8.17 | 0.52 | 0.34 | 0.20 | 0.22 |
| SEQID-01900 | 0.04 | 0.04 | 0.02 | 0.04 | 0.07 | 0.01 | 0.03 | 0.07 | -19.21 | 0.46 | 0.01 | 8.28 | 0.20 | 0.35 | 0.00 | 0.20 |
| SEQID-01901 | 0.02 | 0.04 | 0.04 | 0.06 | 0.05 | 0.03 | 0.06 | 0.07 | -22.22 | 0.31 | -0.01 | 6.46 | 0.18 | 0.34 | 0.19 | 0.19 |
| SEQID-01902 | 0.04 | 0.05 | 0.06 | 0.09 | 0.05 | 0.01 | 0.05 | 0.04 | -17.28 | 0.20 | -0.01 | 8.67 | 0.24 | 0.40 | 0.25 | 0.25 |
| SEQID-01903 | 0.02 | 0.01 | 0.03 | 0.02 | 0.05 | 0.01 | 0.03 | 0.03 | -38.43 | 0.07 | -0.01 | 6.36 | 0.23 | 0.36 | 0.23 | 0.23 |
| SEQID-01904 | 0.03 | 0.06 | 0.06 | 0.06 | 0.04 | 0.01 | 0.07 | 0.07 | -15.95 | 0.55 | 0.04 | 9.68 | 0.20 | 0.34 | 0.00 | 0.22 |
| SEQID-01905 | 0.02 | 0.06 | 0.03 | 0.05 | 0.06 | 0.02 | 0.05 | 0.06 | -21.24 | 0.34 | 0.02 | 8.76 | 0.21 | 0.31 | 0.00 | 0.21 |
| SEQID-01906 | 0.02 | 0.05 | 0.07 | 0.04 | 0.07 | 0.01 | 0.04 | 0.09 | -18.84 | 0.32 | -0.02 | 5.81 | 0.00 | 0.39 | 0.17 | 0.22 |
| SEQID-01907 | 0.03 | 0.07 | 0.04 | 0.04 | 0.05 | 0.02 | 0.04 | 0.06 | -22.41 | 0.34 | 0.01 | 3.31 | 0.37 | 0.56 | 0.20 | 0.20 |
| SEQID-01908 | 0.04 | 0.00 | 0.00 | 0.04 | 0.05 | 0.04 | 0.03 | 0.05 | -19.24 | 0.41 | 0.01 | 8.17 | 0.20 | 0.33 | 0.00 | 0.21 |
| SEQID-01909 | 0.02 | 0.04 | 0.03 | 0.04 | 0.05 | 0.00 | 0.02 | 0.03 | -36.92 | 0.12 | -0.11 | 4.32 | 0.55 | 0.68 | 0.23 | 0.35 |
| SEQID-01910 | 0.02 | 0.03 | 0.05 | 0.05 | 0.05 | 0.02 | 0.05 | 0.07 | -19.81 | 0.43 | 0.01 | 9.19 | 0.21 | 0.32 | 0.00 | 0.21 |
| SEQID-01911 | 0.02 | 0.03 | 0.04 | 0.06 | 0.07 | 0.02 | 0.02 | 0.10 | -20.99 | 0.34 | -0.01 | 6.28 | 0.21 | 0.32 | 0.19 | 0.21 |

TABLE 1-continued

| | | | | | | | | | | | | | | | |
|---|---|---|---|---|---|---|---|---|---|---|---|---|---|---|---|
| SEQID-01912 | 0.01 | 0.07 | 0.04 | 0.06 | 0.05 | 0.01 | 0.02 | 0.09 | -16.91 | 0.42 | 0.03 | 9.14 | 0.24 | 0.31 | 0.00 | 0.26 |
| SEQID-01913 | 0.02 | 0.07 | 0.02 | 0.03 | 0.04 | 0.02 | 0.02 | 0.12 | -18.96 | 0.49 | 0.01 | 7.84 | 0.25 | 0.31 | 0.24 | 0.26 |
| SEQID-01914 | 0.01 | 0.10 | 0.09 | 0.07 | 0.04 | 0.02 | 0.02 | 0.05 | -23.35 | 0.27 | 0.01 | 7.38 | 0.24 | 0.35 | 0.23 | 0.24 |
| SEQID-01915 | 0.03 | 0.02 | 0.24 | 0.03 | 0.01 | 0.00 | 0.00 | 0.02 | -12.61 | 0.11 | 0.02 | 10.55 | 0.70 | 0.80 | 0.31 | 0.48 |
| SEQID-01916 | 0.04 | 0.01 | 0.03 | 0.04 | 0.03 | 0.02 | 0.02 | 0.05 | -30.81 | 0.23 | 0.07 | 10.33 | 0.26 | 0.33 | 0.00 | 0.21 |
| SEQID-01917 | 0.01 | 0.03 | 0.13 | 0.05 | 0.02 | 0.02 | 0.04 | 0.08 | -16.73 | 0.44 | -0.01 | 6.39 | 0.27 | 0.33 | 0.29 | 0.27 |
| SEQID-01918 | 0.04 | 0.11 | 0.04 | 0.02 | 0.05 | 0.00 | 0.00 | 0.05 | -26.07 | 0.31 | -0.05 | 4.56 | 0.41 | 0.60 | 0.00 | 0.00 |
| SEQID-01919 | 0.03 | 0.05 | 0.06 | 0.05 | 0.06 | 0.00 | 0.02 | 0.08 | -16.12 | 0.56 | 0.02 | 8.90 | 0.51 | 0.69 | 0.00 | 0.21 |
| SEQID-01920 | 0.03 | 0.04 | 0.03 | 0.06 | 0.04 | 0.02 | 0.03 | 0.08 | -20.62 | 0.54 | 0.00 | 6.53 | 0.25 | 0.33 | 0.22 | 0.21 |
| SEQID-01921 | 0.01 | 0.03 | 0.05 | 0.04 | 0.04 | 0.01 | 0.05 | 0.07 | -19.18 | 0.43 | 0.00 | 6.63 | 0.20 | 0.33 | 0.17 | 0.00 |
| SEQID-01922 | 0.03 | 0.04 | 0.05 | 0.04 | 0.06 | 0.00 | 0.04 | 0.08 | -17.78 | 0.51 | -0.03 | 4.92 | 0.22 | 0.33 | 0.23 | 0.21 |
| SEQID-01923 | 0.02 | 0.05 | 0.08 | 0.06 | 0.03 | 0.01 | 0.03 | 0.03 | -23.01 | 0.25 | -0.09 | 4.22 | 0.23 | 0.40 | 0.20 | 0.23 |
| SEQID-01924 | 0.02 | 0.04 | 0.05 | 0.05 | 0.04 | 0.03 | 0.09 | 0.03 | -22.92 | 0.44 | 0.01 | 7.66 | 0.20 | 0.28 | 0.21 | 0.22 |
| SEQID-01925 | 0.01 | 0.03 | 0.21 | 0.04 | 0.03 | 0.01 | 0.01 | 0.03 | -13.36 | 0.14 | 0.00 | 5.29 | 0.50 | 0.73 | 0.29 | 0.46 |
| SEQID-01926 | 0.04 | 0.06 | 0.03 | 0.03 | 0.03 | 0.00 | 0.02 | 0.07 | -17.97 | 0.56 | -0.03 | 5.11 | 0.22 | 0.30 | 0.00 | 0.23 |
| SEQID-01927 | 0.04 | 0.05 | 0.04 | 0.04 | 0.06 | 0.01 | 0.03 | 0.09 | -20.09 | 0.45 | 0.04 | 9.88 | 0.21 | 0.33 | 0.20 | 0.21 |
| SEQID-01928 | 0.02 | 0.04 | 0.06 | 0.04 | 0.02 | 0.03 | 0.03 | 0.07 | -20.39 | 0.43 | -0.01 | 6.51 | 0.22 | 0.34 | 0.00 | 0.23 |
| SEQID-01929 | 0.02 | 0.04 | 0.01 | 0.05 | 0.05 | 0.01 | 0.04 | 0.04 | -28.64 | 0.25 | -0.01 | 6.48 | 0.22 | 0.40 | 0.22 | 0.20 |
| SEQID-01930 | 0.03 | 0.05 | 0.05 | 0.04 | 0.04 | 0.03 | 0.06 | 0.05 | -19.50 | 0.38 | 0.00 | 6.80 | 0.19 | 0.35 | 0.18 | 0.19 |
| SEQID-01931 | 0.02 | 0.04 | 0.04 | 0.04 | 0.04 | 0.02 | 0.05 | 0.06 | -18.28 | 0.41 | 0.00 | 8.47 | 0.24 | 0.31 | 0.00 | 0.20 |
| SEQID-01932 | 0.03 | 0.05 | 0.03 | 0.05 | 0.06 | 0.03 | 0.05 | 0.10 | -18.27 | 0.46 | 0.02 | 8.91 | 0.69 | 0.84 | 0.00 | 0.22 |
| SEQID-01933 | 0.02 | 0.04 | 0.04 | 0.05 | 0.06 | 0.02 | 0.05 | 0.05 | -18.20 | 0.40 | 0.02 | 8.61 | 0.24 | 0.31 | 0.00 | 0.20 |
| SEQID-01934 | 0.02 | 0.05 | 0.03 | 0.04 | 0.04 | 0.01 | 0.04 | 0.06 | -21.81 | 0.39 | -0.06 | 7.27 | 0.98 | 1.00 | 0.21 | 0.21 |
| SEQID-01935 | 0.02 | 0.05 | 0.04 | 0.04 | 0.06 | 0.02 | 0.06 | 0.06 | -21.72 | 0.38 | 0.00 | 7.09 | 1.00 | 1.00 | 0.20 | 0.22 |
| SEQID-01936 | 0.05 | 0.04 | 0.03 | 0.04 | 0.04 | 0.01 | 0.04 | 0.05 | -20.06 | 0.42 | 0.01 | 8.29 | 0.22 | 0.35 | 0.00 | 0.21 |
| SEQID-01937 | 0.05 | 0.06 | 0.07 | 0.02 | 0.03 | 0.00 | 0.06 | 0.07 | -19.65 | 0.30 | -0.03 | 5.05 | 0.19 | 0.30 | 0.00 | 0.19 |
| SEQID-01938 | 0.04 | 0.06 | 0.04 | 0.04 | 0.05 | 0.01 | 0.03 | 0.06 | -23.67 | 0.43 | 0.00 | 6.93 | 0.43 | 0.61 | 0.22 | 0.21 |
| SEQID-01939 | 0.02 | 0.04 | 0.04 | 0.04 | 0.04 | 0.04 | 0.02 | 0.09 | -19.79 | 0.43 | 0.01 | 7.89 | 0.68 | 0.76 | 0.00 | 0.00 |
| SEQID-01940 | 0.05 | 0.06 | 0.05 | 0.04 | 0.04 | 0.03 | 0.03 | 0.06 | -23.33 | 0.31 | 0.00 | 6.92 | 0.43 | 0.64 | 0.22 | 0.20 |
| SEQID-01941 | 0.02 | 0.00 | 0.00 | 0.04 | 0.04 | 0.00 | 0.03 | 0.03 | -36.46 | 0.13 | -0.10 | 4.34 | 0.53 | 0.68 | 0.25 | 0.22 |
| SEQID-01942 | 0.04 | 0.04 | 0.03 | 0.04 | 0.05 | 0.01 | 0.03 | 0.06 | -21.67 | 0.42 | 0.01 | 8.12 | 0.20 | 0.35 | 0.00 | 0.22 |
| SEQID-01943 | 0.08 | 0.06 | 0.07 | 0.02 | 0.03 | 0.00 | 0.02 | 0.07 | -23.48 | 0.34 | -0.06 | 4.40 | 0.28 | 0.37 | 0.00 | 0.24 |
| SEQID-01944 | 0.04 | 0.06 | 0.03 | 0.04 | 0.03 | 0.02 | 0.06 | 0.06 | -22.73 | 0.34 | 0.00 | 7.18 | 0.20 | 0.33 | 0.00 | 0.20 |
| SEQID-01945 | 0.04 | 0.06 | 0.03 | 0.04 | 0.04 | 0.01 | 0.01 | 0.09 | -20.06 | 0.45 | 0.01 | 8.29 | 0.22 | 0.35 | 0.00 | 0.21 |
| SEQID-01946 | 0.05 | 0.06 | 0.07 | 0.02 | 0.03 | 0.00 | 0.02 | 0.07 | -23.48 | 0.34 | -0.06 | 4.40 | 0.28 | 0.37 | 0.00 | 0.24 |
| SEQID-01947 | 0.04 | 0.09 | 0.04 | 0.03 | 0.06 | 0.01 | 0.02 | 0.06 | -23.98 | 0.39 | -0.06 | 4.41 | 0.41 | 0.54 | 0.00 | 0.33 |
| SEQID-01948 | 0.04 | 0.03 | 0.04 | 0.03 | 0.04 | 0.05 | 0.03 | 0.04 | -23.93 | 0.30 | 0.03 | 9.29 | 0.21 | 0.30 | 0.20 | 0.00 |
| SEQID-01949 | 0.09 | 0.01 | 0.01 | 0.02 | 0.02 | 0.03 | 0.04 | 0.08 | -31.08 | 0.29 | -0.07 | 10.04 | 0.28 | 0.36 | 0.22 | 0.75 |
| SEQID-01950 | 0.04 | 0.03 | 0.03 | 0.04 | 0.04 | 0.01 | 0.04 | 0.05 | -25.50 | 0.40 | 0.06 | 8.17 | 0.00 | 0.33 | 0.00 | 0.21 |
| SEQID-01951 | 0.02 | 0.06 | 0.09 | 0.03 | 0.07 | 0.00 | 0.05 | 0.07 | -22.65 | 0.29 | 0.01 | 5.76 | 0.21 | 0.44 | 0.22 | 0.23 |
| SEQID-01952 | 0.02 | 0.14 | 0.01 | 0.02 | 0.35 | 0.02 | 0.00 | 0.04 | -24.37 | 0.45 | -0.01 | 4.73 | 0.37 | 1.00 | 0.00 | 0.22 |
| SEQID-01953 | 0.04 | 0.02 | 0.03 | 0.03 | 0.06 | 0.00 | 0.02 | 0.04 | -20.88 | 0.50 | -0.04 | 5.38 | 0.20 | 0.35 | 0.24 | 0.25 |
| SEQID-01954 | 0.01 | 0.02 | 0.04 | 0.02 | 0.02 | 0.01 | 0.01 | 0.10 | -39.35 | 0.11 | -0.01 | 5.20 | 0.24 | 0.40 | 0.19 | 0.22 |
| SEQID-01955 | 0.04 | 0.06 | 0.03 | 0.02 | 0.06 | 0.01 | 0.01 | 0.09 | -19.05 | 0.60 | -0.03 | 6.97 | 0.22 | 0.32 | 0.23 | 0.21 |
| SEQID-01956 | 0.03 | 0.04 | 0.04 | 0.04 | 0.04 | 0.02 | 0.02 | 0.08 | -20.42 | 0.45 | 0.03 | 9.75 | 0.21 | 0.31 | 0.00 | 0.00 |
| SEQID-01957 | 0.04 | 0.05 | 0.02 | 0.02 | 0.05 | 0.05 | 0.04 | 0.04 | -22.36 | 0.29 | -0.07 | 4.39 | 0.20 | 0.34 | 0.00 | 0.21 |
| SEQID-01958 | 0.04 | 0.09 | 0.02 | 0.02 | 0.04 | 0.00 | 0.06 | 0.05 | -16.87 | 0.53 | 0.06 | 10.30 | 0.20 | 0.31 | 0.00 | 0.20 |
| SEQID-01959 | 0.03 | 0.06 | 0.04 | 0.03 | 0.06 | 0.03 | 0.03 | 0.06 | -20.42 | 0.37 | 0.01 | 7.71 | 0.21 | 0.34 | 0.22 | 0.20 |
| SEQID-01960 | 0.04 | 0.05 | 0.04 | 0.04 | 0.06 | 0.02 | 0.03 | 0.05 | -21.88 | 0.34 | -0.04 | 7.73 | 0.37 | 0.59 | 0.24 | 0.21 |
| SEQID-01961 | 0.03 | 0.03 | 0.04 | 0.04 | 0.05 | 0.00 | 0.00 | 0.09 | -18.98 | 0.44 | 0.01 | 9.29 | 0.21 | 0.33 | 0.19 | 0.22 |
| SEQID-01962 | 0.03 | 0.07 | 0.04 | 0.04 | 0.05 | 0.01 | 0.04 | 0.07 | -18.96 | 0.44 | 0.02 | 7.19 | 0.21 | 0.33 | 0.00 | 0.21 |
| SEQID-01963 | 0.02 | 0.07 | 0.04 | 0.06 | 0.05 | 0.01 | 0.07 | 0.06 | -19.47 | 0.32 | 0.01 | 9.03 | 0.20 | 0.33 | 0.00 | 0.20 |
| SEQID-01964 | 0.04 | 0.02 | 0.03 | 0.03 | 0.06 | 0.00 | 0.02 | 0.07 | -22.39 | 0.45 | -0.03 | 4.71 | 0.21 | 0.34 | 0.22 | 0.22 |

TABLE 1-continued

| | | | | | | | | | | | | | | | |
|---|---|---|---|---|---|---|---|---|---|---|---|---|---|---|---|
| SEQID-01965 | 0.02 | 0.02 | 0.06 | 0.07 | 0.05 | 0.00 | 0.02 | 0.09 | −22.73 | 0.33 | −0.02 | 5.25 | 0.19 | 0.34 | 0.20 | 0.20 |
| SEQID-01966 | 0.02 | 0.02 | 0.05 | 0.05 | 0.05 | 0.00 | 0.01 | 0.09 | −21.32 | 0.37 | −0.02 | 5.11 | 0.20 | 0.36 | 0.00 | 0.21 |
| SEQID-01967 | 0.03 | 0.06 | 0.04 | 0.04 | 0.04 | 0.01 | 0.05 | 0.09 | −21.62 | 0.44 | −0.03 | 4.79 | 0.19 | 0.32 | 0.00 | 0.22 |
| SEQID-01968 | 0.03 | 0.06 | 0.03 | 0.04 | 0.04 | 0.01 | 0.05 | 0.08 | −21.87 | 0.43 | −0.03 | 4.68 | 0.20 | 0.33 | 0.00 | 0.22 |
| SEQID-01969 | 0.05 | 0.04 | 0.04 | 0.04 | 0.01 | 0.01 | 0.02 | 0.07 | −19.58 | 0.53 | −0.03 | 5.04 | 0.18 | 0.32 | 0.00 | 0.22 |
| SEQID-01970 | 0.04 | 0.03 | 0.04 | 0.05 | 0.05 | 0.00 | 0.05 | 0.07 | −18.79 | 0.41 | −0.02 | 6.01 | 0.20 | 0.31 | 0.00 | 0.10 |
| SEQID-01971 | 0.02 | 0.04 | 0.05 | 0.04 | 0.06 | 0.03 | 0.05 | 0.05 | −22.65 | 0.19 | 0.02 | 9.92 | 0.21 | 0.33 | 0.17 | 0.00 |
| SEQID-01972 | 0.01 | 0.04 | 0.04 | 0.04 | 0.03 | 0.03 | 0.01 | 0.05 | −20.52 | 0.33 | −0.03 | 4.96 | 0.18 | 0.36 | 0.19 | 0.19 |
| SEQID-01973 | 0.01 | 0.03 | 0.05 | 0.09 | 0.05 | 0.02 | 0.07 | 0.06 | −17.93 | 0.33 | 0.01 | 8.33 | 0.20 | 0.35 | 0.20 | 0.21 |
| SEQID-01974 | 0.03 | 0.02 | 0.03 | 0.05 | 0.07 | 0.03 | 0.04 | 0.10 | −17.52 | 0.53 | −0.01 | 6.51 | 0.46 | 0.62 | 0.00 | 0.20 |
| SEQID-01975 | 0.03 | 0.02 | 0.03 | 0.05 | 0.07 | 0.03 | 0.04 | 0.10 | −17.78 | 0.52 | 0.00 | 6.72 | 0.46 | 0.62 | 0.00 | 0.19 |
| SEQID-01976 | 0.03 | 0.07 | 0.06 | 0.04 | 0.06 | 0.03 | 0.07 | 0.05 | −18.64 | 0.28 | 0.02 | 9.52 | 0.22 | 0.31 | 0.00 | 0.20 |
| SEQID-01977 | 0.03 | 0.09 | 0.04 | 0.05 | 0.05 | 0.06 | 0.04 | 0.05 | −12.42 | 0.65 | 0.01 | 7.91 | 0.20 | 0.34 | 0.00 | 0.21 |
| SEQID-01978 | 0.02 | 0.04 | 0.03 | 0.03 | 0.04 | 0.00 | 0.03 | 0.06 | −24.74 | 0.39 | −0.02 | 5.17 | 0.20 | 0.33 | 0.52 | 0.20 |
| SEQID-01979 | 0.01 | 0.05 | 0.06 | 0.09 | 0.09 | 0.01 | 0.03 | 0.07 | −13.51 | 0.41 | 0.00 | 6.95 | 0.20 | 0.37 | 0.20 | 0.20 |
| SEQID-01980 | 0.02 | 0.04 | 0.05 | 0.04 | 0.04 | 0.01 | 0.03 | 0.05 | −22.92 | 0.34 | −0.02 | 5.09 | 0.20 | 0.34 | 0.20 | 0.20 |
| SEQID-01981 | 0.04 | 0.04 | 0.04 | 0.02 | 0.03 | 0.06 | 0.03 | 0.08 | −22.02 | 0.46 | −0.03 | 5.12 | 0.22 | 0.31 | 0.20 | 0.22 |
| SEQID-01982 | 0.04 | 0.04 | 0.05 | 0.03 | 0.06 | 0.00 | 0.07 | 0.04 | −19.89 | 0.33 | 0.00 | 6.79 | 0.21 | 0.34 | 0.00 | 0.00 |
| SEQID-01983 | 0.04 | 0.04 | 0.04 | 0.02 | 0.03 | 0.02 | 0.03 | 0.08 | −21.44 | 0.46 | −0.03 | 5.22 | 0.21 | 0.31 | 0.00 | 0.22 |
| SEQID-01984 | 0.02 | 0.05 | 0.04 | 0.05 | 0.05 | 0.03 | 0.05 | 0.07 | −18.58 | 0.45 | −0.02 | 5.96 | 0.21 | 0.33 | 0.00 | 0.22 |
| SEQID-01985 | 0.04 | 0.02 | 0.04 | 0.03 | 0.07 | 0.00 | 0.06 | 0.03 | −24.96 | 0.23 | 0.02 | 9.66 | 0.00 | 0.30 | 0.21 | 0.25 |
| SEQID-01986 | 0.04 | 0.02 | 0.02 | 0.04 | 0.06 | 0.00 | 0.01 | 0.09 | −20.21 | 0.51 | −0.03 | 4.60 | 0.21 | 0.35 | 0.22 | 0.21 |
| SEQID-01987 | 0.02 | 0.05 | 0.03 | 0.05 | 0.05 | 0.03 | 0.05 | 0.05 | −20.16 | 0.29 | −0.03 | 5.06 | 0.16 | 0.35 | 0.18 | 0.19 |
| SEQID-01988 | 0.03 | 0.04 | 0.05 | 0.04 | 0.04 | 0.00 | 0.05 | 0.09 | −21.92 | 0.44 | −0.04 | 4.75 | 0.20 | 0.32 | 0.00 | 0.20 |
| SEQID-01989 | 0.02 | 0.03 | 0.04 | 0.02 | 0.03 | 0.01 | 0.04 | 0.09 | −22.26 | 0.39 | −0.06 | 4.33 | 0.19 | 0.34 | 0.00 | 0.20 |
| SEQID-01990 | 0.04 | 0.10 | 0.04 | 0.03 | 0.06 | 0.03 | 0.03 | 0.09 | −21.67 | 0.43 | −0.03 | 4.62 | 0.35 | 0.46 | 0.00 | 0.23 |
| SEQID-01991 | 0.05 | 0.05 | 0.05 | 0.04 | 0.05 | 0.03 | 0.0a | 0.10 | −19.43 | 0.27 | 0.01 | 9.01 | 0.23 | 0.32 | 0.00 | 0.23 |
| SEQID-01992 | 0.03 | 0.05 | 0.03 | 0.03 | 0.04 | 0.02 | 0.03 | 0.07 | −16.92 | 0.43 | −0.02 | 4.62 | 0.21 | 0.31 | 0.20 | 0.00 |
| SEQID-01993 | 0.04 | 0.07 | 0.06 | 0.04 | 0.03 | 0.03 | 0.03 | 0.06 | −14.71 | 0.55 | −0.01 | 6.13 | 0.22 | 0.33 | 0.00 | 0.23 |
| SEQID-01994 | 0.03 | 0.13 | 0.05 | 0.04 | 0.05 | 0.06 | 0.03 | 0.07 | −18.50 | 0.48 | −0.03 | 4.53 | 0.21 | 0.36 | 0.22 | 0.21 |
| SEQID-01995 | 0.03 | 0.03 | 0.04 | 0.05 | 0.06 | 0.00 | 0.05 | 0.07 | −20.53 | 0.52 | −0.03 | 4.70 | 0.20 | 0.32 | 0.21 | 0.21 |
| SEQID-01996 | 0.04 | 0.01 | 0.02 | 0.04 | 0.04 | 0.00 | 0.01 | 0.09 | −18.00 | 0.45 | −0.02 | 5.27 | 0.22 | 0.34 | 0.22 | 0.22 |
| SEQID-01997 | 0.03 | 0.07 | 0.04 | 0.05 | 0.04 | 0.01 | 0.05 | 0.06 | −20.64 | 0.28 | −0.03 | 4.99 | 0.19 | 0.33 | 0.00 | 0.19 |
| SEQID-01998 | 0.02 | 0.05 | 0.03 | 0.03 | 0.06 | 0.00 | 0.04 | 0.05 | −14.37 | 0.56 | −0.01 | 6.40 | 0.16 | 0.35 | 0.13 | 0.23 |
| SEQID-01999 | 0.03 | 0.11 | 0.05 | 0.04 | 0.04 | 0.06 | 0.06 | 0.07 | −24.83 | 0.23 | 0.02 | 8.66 | 0.22 | 0.36 | 0.00 | 0.00 |
| SEQID-02000 | 0.04 | 0.07 | 0.04 | 0.04 | 0.07 | 0.05 | 0.05 | 0.03 | −22.75 | 0.22 | 0.02 | 8.96 | 0.24 | 0.31 | 0.00 | 0.00 |
| SEQID-02001 | 0.05 | 0.03 | 0.05 | 0.03 | 0.06 | 0.00 | 0.05 | 0.04 | −20.51 | 0.45 | −0.03 | 4.60 | 0.22 | 0.28 | 0.19 | 0.21 |
| SEQID-02002 | 0.02 | 0.05 | 0.03 | 0.05 | 0.06 | 0.06 | 0.09 | 0.09 | −19.91 | 0.29 | 0.01 | 8.38 | 0.00 | 0.31 | 0.26 | 0.24 |
| SEQID-02003 | 0.04 | 0.05 | 0.05 | 0.04 | 0.05 | 0.03 | 0.09 | 0.06 | −18.47 | 0.49 | −0.03 | 4.64 | 0.21 | 0.34 | 0.00 | 0.00 |
| SEQID-02004 | 0.02 | 0.03 | 0.04 | 0.03 | 0.04 | 0.00 | 0.04 | 0.09 | −22.66 | 0.36 | −0.04 | 4.52 | 0.49 | 0.78 | 0.00 | 0.22 |
| SEQID-02005 | 0.03 | 0.07 | 0.04 | 0.04 | 0.04 | 0.00 | 0.02 | 0.08 | −17.91 | 0.46 | −0.03 | 5.03 | 0.21 | 0.33 | 0.00 | 0.21 |
| SEQID-02006 | 0.03 | 0.09 | 0.04 | 0.05 | 0.05 | 0.01 | 0.05 | 0.06 | −12.46 | 0.63 | 0.00 | 7.04 | 0.20 | 0.31 | 0.00 | 0.22 |
| SEQID-02007 | 0.01 | 0.03 | 0.02 | 0.07 | 0.05 | 0.00 | 0.06 | 0.05 | −24.40 | 0.16 | −0.03 | 4.85 | 0.22 | 0.39 | 0.00 | 0.20 |
| SEQID-02008 | 0.04 | 0.02 | 0.02 | 0.04 | 0.04 | 0.00 | 0.03 | 0.02 | −16.77 | 0.44 | 0.00 | 6.60 | 0.23 | 0.30 | 0.21 | 0.19 |
| SEQID-02009 | 0.03 | 0.09 | 0.04 | 0.06 | 0.06 | 0.00 | 0.11 | 0.06 | −12.75 | 0.69 | −0.01 | 6.58 | 0.21 | 0.34 | 0.00 | 0.25 |
| SEQID-02010 | 0.03 | 0.05 | 0.04 | 0.04 | 0.03 | 0.06 | 0.05 | 0.05 | −20.82 | 0.31 | −0.02 | 6.11 | 0.20 | 0.34 | 0.00 | 0.22 |
| SEQID-02011 | 0.03 | 0.04 | 0.05 | 0.05 | 0.05 | 0.03 | 0.07 | 0.06 | −18.19 | 0.42 | −0.02 | 5.59 | 0.20 | 0.34 | 0.21 | 0.20 |
| SEQID-02012 | 0.01 | 0.04 | 0.03 | 0.07 | 0.07 | 0.02 | 0.04 | 0.04 | −22.36 | 0.24 | −0.01 | 5.90 | 0.22 | 0.35 | 0.20 | 0.21 |
| SEQID-02013 | 0.02 | 0.04 | 0.04 | 0.05 | 0.05 | 0.00 | 0.04 | 0.04 | −20.36 | 0.41 | −0.02 | 5.32 | 0.23 | 0.31 | 0.19 | 0.00 |
| SEQID-02014 | 0.01 | 0.02 | 0.01 | 0.03 | 0.03 | 0.06 | 0.00 | 0.00 | −24.24 | 0.09 | −0.09 | 4.24 | 0.19 | 0.36 | 0.00 | 0.21 |
| SEQID-02015 | 0.03 | 0.09 | 0.05 | 0.05 | 0.04 | 0.02 | 0.07 | 0.05 | −20.47 | 0.34 | −0.04 | 5.55 | 0.20 | 0.36 | 0.20 | 0.21 |
| SEQID-02016 | 0.01 | 0.00 | 0.24 | 0.06 | 0.07 | 0.00 | 0.00 | 0.04 | −39.60 | 0.05 | 0.00 | 7.54 | 0.33 | 0.35 | 0.33 | 0.34 |
| SEQID-02017 | 0.04 | 0.04 | 0.03 | 0.09 | 0.06 | 0.00 | 0.05 | 0.07 | −16.22 | 0.56 | −0.02 | 4.71 | 0.00 | 0.32 | 0.23 | 0.23 |

TABLE 1-continued

| | | | | | | | | | | | | | | | | |
|---|---|---|---|---|---|---|---|---|---|---|---|---|---|---|---|---|
| SEQID-02018 | 0.03 | 0.02 | 0.03 | 0.03 | 0.03 | 0.06 | 0.03 | 0.01 | 0.05 | 0.03 | 0.41 | -23.78 | 4.90 | 0.24 | 0.31 | 0.24 | 0.00 | 0.24 |
| SEQID-02019 | 0.04 | 0.10 | 0.04 | 0.06 | 0.04 | 0.05 | 0.06 | 0.05 | 0.06 | 0.07 | 0.74 | -10.97 | 5.24 | 0.21 | 0.31 | 0.21 | 0.00 | 0.20 |
| SEQID-02020 | 0.02 | 0.06 | 0.02 | 0.03 | 0.03 | 0.04 | 0.03 | 0.01 | 0.02 | 0.07 | 0.50 | -20.48 | 5.04 | 0.21 | 0.33 | 0.21 | 0.21 | 0.23 |
| SEQID-02021 | 0.04 | 0.03 | 0.03 | 0.02 | 0.05 | 0.05 | 0.05 | 0.01 | 0.02 | 0.07 | 0.33 | -26.59 | 5.56 | 0.22 | 0.34 | 0.22 | 0.19 | 0.00 |
| SEQID-02022 | 0.02 | 0.04 | 0.04 | 0.03 | 0.03 | 0.07 | 0.03 | 0.01 | 0.03 | 0.07 | 0.39 | -21.00 | 8.02 | 0.21 | 0.33 | 0.21 | 0.00 | 0.00 |
| SEQID-02023 | 0.04 | 0.05 | 0.03 | 0.03 | 0.03 | 0.04 | 0.03 | 0.01 | 0.03 | 0.09 | 0.47 | -19.81 | 5.81 | 0.22 | 0.32 | 0.22 | 0.00 | 0.21 |
| SEQID-02024 | 0.03 | 0.05 | 0.04 | 0.05 | 0.04 | 0.05 | 0.06 | 0.04 | 0.06 | 0.05 | 0.33 | -19.74 | 6.18 | 0.19 | 0.33 | 0.19 | 0.00 | 0.20 |
| SEQID-02025 | 0.02 | 0.05 | 0.03 | 0.03 | 0.04 | 0.05 | 0.04 | 0.02 | 0.06 | 0.06 | 0.37 | -21.52 | 5.59 | 0.23 | 0.33 | 0.19 | 0.19 | 0.20 |
| SEQID-02026 | 0.03 | 0.03 | 0.02 | 0.05 | 0.03 | 0.04 | 0.03 | 0.01 | 0.02 | 0.07 | 0.28 | -27.34 | 5.56 | 0.25 | 0.35 | 0.23 | 0.00 | 0.24 |
| SEQID-02027 | 0.02 | 0.01 | 0.06 | 0.05 | 0.05 | 0.05 | 0.05 | 0.01 | 0.04 | 0.07 | 0.31 | -21.18 | 11.71 | 0.23 | 0.33 | 0.23 | 0.21 | 0.24 |
| SEQID-02028 | 0.01 | 0.04 | 0.21 | 0.03 | 0.03 | 0.06 | 0.06 | 0.01 | 0.02 | 0.06 | 0.34 | -24.60 | 5.18 | 0.44 | 0.44 | 0.23 | 0.26 | 0.24 |
| SEQID-02029 | 0.03 | 0.05 | 0.04 | 0.05 | 0.04 | 0.07 | 0.04 | 0.02 | 0.04 | 0.09 | 0.47 | -18.14 | 5.39 | 0.58 | 0.79 | 0.58 | 0.00 | 0.22 |
| SEQID-02030 | 0.02 | 0.07 | 0.04 | 0.06 | 0.06 | 0.05 | 0.08 | 0.02 | 0.08 | 0.05 | 0.35 | -18.45 | 7.05 | 0.23 | 0.32 | 0.23 | 0.00 | 0.22 |
| SEQID-02031 | 0.03 | 0.06 | 0.06 | 0.05 | 0.05 | 0.04 | 0.04 | 0.03 | 0.04 | 0.06 | 0.41 | -19.68 | 4.61 | 0.22 | 0.35 | 0.22 | 0.00 | 0.23 |
| SEQID-02032 | 0.01 | 0.05 | 0.03 | 0.03 | 0.03 | 0.03 | 0.05 | 0.01 | 0.02 | 0.08 | 0.61 | -19.30 | 7.53 | 0.23 | 0.33 | 0.23 | 0.00 | 0.00 |
| SEQID-02033 | 0.02 | 0.08 | 0.05 | 0.05 | 0.05 | 0.05 | 0.05 | 0.02 | 0.03 | 0.08 | 0.45 | -18.53 | 6.31 | 0.22 | 0.33 | 0.22 | 0.00 | 0.22 |
| SEQID-02034 | 0.03 | 0.03 | 0.04 | 0.03 | 0.04 | 0.03 | 0.04 | 0.02 | 0.04 | 0.07 | 0.40 | -22.24 | 8.52 | 0.20 | 0.34 | 0.20 | 0.00 | 0.21 |
| SEQID-02035 | 0.04 | 0.05 | 0.05 | 0.06 | 0.06 | 0.06 | 0.09 | 0.02 | 0.09 | 0.04 | 0.41 | -17.35 | 9.69 | 0.26 | 0.30 | 0.23 | 0.23 | 0.23 |
| SEQID-02036 | 0.06 | 0.06 | 0.11 | 0.05 | 0.07 | 0.07 | 0.05 | 0.00 | 0.02 | 0.03 | 0.22 | -22.02 | 10.52 | 0.28 | 0.37 | 0.26 | 0.27 | 0.26 |
| SEQID-02037 | 0.03 | 0.04 | 0.03 | 0.03 | 0.06 | 0.06 | 0.06 | 0.00 | 0.00 | 0.08 | 0.20 | -20.55 | 9.48 | 0.21 | 0.33 | 0.21 | 0.00 | 0.24 |
| SEQID-02038 | 0.01 | 0.02 | 0.03 | 0.04 | 0.04 | 0.05 | 0.05 | 0.03 | 0.02 | 0.09 | 0.45 | -23.12 | 10.69 | 0.00 | 0.30 | 0.00 | 0.23 | 0.21 |
| SEQID-02039 | 0.03 | 0.02 | 0.02 | 0.06 | 0.06 | 0.04 | 0.04 | 0.01 | 0.03 | 0.04 | 0.36 | -23.29 | 4.72 | 0.25 | 0.33 | 0.25 | 0.00 | 0.00 |
| SEQID-02040 | 0.00 | 0.09 | 0.06 | 0.06 | 0.06 | 0.05 | 0.06 | 0.00 | 0.05 | 0.06 | 0.20 | -18.92 | 4.56 | 0.21 | 0.31 | 0.21 | 0.21 | 0.21 |
| SEQID-02041 | 0.04 | 0.02 | 0.06 | 0.03 | 0.03 | 0.05 | 0.05 | 0.00 | 0.02 | 0.05 | 0.43 | -25.62 | 4.47 | 0.21 | 0.32 | 0.21 | 0.22 | 0.18 |
| SEQID-02042 | 0.02 | 0.06 | 0.02 | 0.04 | 0.05 | 0.05 | 0.07 | 0.02 | 0.01 | 0.07 | 0.42 | -20.68 | 4.97 | 0.45 | 0.33 | 0.00 | 0.00 | 0.19 |
| SEQID-02043 | 0.06 | 0.03 | 0.03 | 0.06 | 0.06 | 0.04 | 0.02 | 0.01 | 0.00 | 0.06 | 0.43 | -25.21 | 4.34 | 0.43 | 0.33 | 0.25 | 0.23 | 0.00 |
| SEQID-02044 | 0.06 | 0.05 | 0.10 | 0.05 | 0.07 | 0.06 | 0.00 | 0.00 | 0.02 | 0.03 | 0.22 | -22.27 | 10.62 | 0.25 | 0.34 | 0.25 | 0.26 | 0.27 |
| SEQID-02045 | 0.05 | 0.04 | 0.02 | 0.05 | 0.04 | 0.05 | 0.02 | 0.00 | 0.02 | 0.08 | 0.57 | -19.54 | 6.55 | 0.23 | 0.37 | 0.23 | 0.00 | 0.24 |
| SEQID-02046 | 0.03 | 0.04 | 0.04 | 0.04 | 0.04 | 0.06 | 0.04 | 0.01 | 0.04 | 0.07 | 0.32 | -24.59 | 4.15 | 0.22 | 0.32 | 0.22 | 0.00 | 0.00 |
| SEQID-02047 | 0.03 | 0.04 | 0.04 | 0.04 | 0.05 | 0.04 | 0.05 | 0.01 | 0.04 | 0.09 | 0.49 | -18.87 | 4.99 | 0.21 | 0.35 | 0.21 | 0.20 | 0.22 |
| SEQID-02048 | 0.03 | 0.04 | 0.03 | 0.04 | 0.03 | 0.05 | 0.03 | 0.00 | 0.03 | 0.06 | 0.25 | -25.99 | 4.09 | 0.22 | 0.34 | 0.22 | 0.00 | 0.22 |
| SEQID-02049 | 0.03 | 0.06 | 0.07 | 0.06 | 0.06 | 0.05 | 0.04 | 0.00 | 0.04 | 0.06 | 0.39 | -19.40 | 4.55 | 0.21 | 0.36 | 0.21 | 0.00 | 0.23 |
| SEQID-02050 | 0.00 | 0.10 | 0.02 | 0.02 | 0.02 | 0.05 | 0.05 | 0.03 | 0.04 | 0.07 | 0.42 | -22.40 | 3.30 | 0.16 | 0.41 | 0.16 | 0.18 | 0.19 |
| SEQID-02051 | 0.01 | 0.03 | 0.01 | 0.01 | 0.04 | 0.05 | 0.05 | 0.00 | 0.04 | 0.08 | 0.33 | -24.36 | 11.10 | 0.23 | 0.29 | 0.23 | 0.26 | 0.00 |
| SEQID-02052 | 0.04 | 0.03 | 0.05 | 0.04 | 0.04 | 0.04 | 0.03 | 0.00 | 0.05 | 0.05 | 0.49 | -22.91 | 4.73 | 0.21 | 0.32 | 0.21 | 0.00 | 0.23 |
| SEQID-02053 | 0.02 | 0.04 | 0.04 | 0.05 | 0.04 | 0.05 | 0.05 | 0.01 | 0.02 | 0.05 | 0.23 | -22.60 | 9.77 | 0.25 | 0.33 | 0.25 | 0.20 | 0.25 |
| SEQID-02054 | 0.03 | 0.09 | 0.05 | 0.09 | 0.04 | 0.04 | 0.02 | 0.05 | 0.01 | 0.04 | 0.28 | -16.03 | 5.51 | 0.40 | 0.48 | 0.40 | 0.00 | 0.24 |
| SEQID-02055 | 0.04 | 0.05 | 0.04 | 0.05 | 0.04 | 0.04 | 0.00 | 0.02 | 0.05 | 0.06 | 0.40 | -21.40 | 8.44 | 0.20 | 0.33 | 0.20 | 0.00 | 0.00 |
| SEQID-02056 | 0.03 | 0.14 | 0.06 | 0.04 | 0.04 | 0.05 | 0.02 | 0.07 | 0.02 | 0.06 | 0.78 | -11.96 | 5.83 | 0.20 | 0.32 | 0.20 | 0.23 | 0.23 |
| SEQID-02057 | 0.05 | 0.05 | 0.04 | 0.04 | 0.04 | 0.05 | 0.07 | 0.01 | 0.05 | 0.06 | 0.39 | -21.18 | 5.20 | 0.21 | 0.31 | 0.21 | 0.00 | 0.20 |
| SEQID-02058 | 0.03 | 0.04 | 0.04 | 0.07 | 0.05 | 0.02 | 0.04 | 0.04 | 0.07 | 0.07 | 0.54 | -15.02 | 5.10 | 0.29 | 0.45 | 0.29 | 0.00 | 0.23 |
| SEQID-02059 | 0.04 | 0.07 | 0.05 | 0.05 | 0.06 | 0.06 | 0.05 | 0.02 | 0.04 | 0.09 | 1.04 | -10.95 | 10.49 | 0.21 | 0.34 | 0.21 | 0.20 | 0.21 |
| SEQID-02060 | 0.02 | 0.01 | 0.01 | 0.01 | 0.04 | 0.07 | 0.06 | 0.02 | 0.02 | 0.09 | 0.18 | -22.39 | 5.77 | 0.23 | 0.36 | 0.18 | 0.18 | 0.21 |
| SEQID-02061 | 0.01 | 0.04 | 0.05 | 0.05 | 0.04 | 0.04 | 0.05 | 0.01 | 0.01 | 0.05 | 0.42 | -20.56 | 4.99 | 0.20 | 0.33 | 0.00 | 0.00 | 0.21 |
| SEQID-02062 | 0.04 | 0.05 | 0.05 | 0.04 | 0.04 | 0.04 | 0.04 | 0.01 | 0.01 | 0.08 | 0.52 | -20.85 | 4.76 | 0.21 | 0.36 | 0.21 | 0.00 | 0.22 |
| SEQID-02063 | 0.02 | 0.07 | 0.05 | 0.04 | 0.04 | 0.05 | 0.05 | 0.05 | 0.06 | 0.04 | 0.36 | -19.08 | 6.75 | 0.20 | 0.35 | 0.20 | 0.00 | 0.21 |
| SEQID-02064 | 0.03 | 0.05 | 0.05 | 0.04 | 0.04 | 0.04 | 0.04 | 0.02 | 0.04 | 0.07 | 0.44 | -18.79 | 4.64 | 0.19 | 0.34 | 0.19 | 0.00 | 0.21 |
| SEQID-02065 | 0.04 | 0.06 | 0.05 | 0.04 | 0.04 | 0.05 | 0.04 | 0.01 | 0.05 | 0.06 | 0.43 | -18.55 | 5.32 | 0.18 | 0.35 | 0.18 | 0.00 | 0.20 |
| SEQID-02066 | 0.03 | 0.05 | 0.05 | 0.05 | 0.04 | 0.05 | 0.05 | 0.03 | 0.05 | 0.06 | 0.40 | -18.95 | 6.14 | 0.25 | 0.35 | 0.25 | 0.20 | 0.20 |
| SEQID-02067 | 0.02 | 0.01 | 0.04 | 0.04 | 0.04 | 0.04 | 0.05 | 0.00 | 0.05 | 0.06 | 0.61 | -22.91 | 4.88 | 0.24 | 0.32 | 0.24 | 0.25 | 0.13 |
| SEQID-02068 | 0.08 | 0.07 | 0.07 | 0.09 | 0.05 | 0.05 | 0.03 | 0.00 | 0.03 | 0.12 | 0.09 | -26.12 | 10.60 | 0.25 | 0.31 | 0.25 | 0.17 | 0.00 |
| SEQID-02069 | 0.04 | 0.04 | 0.04 | 0.03 | 0.04 | 0.05 | 0.05 | 0.02 | 0.04 | 0.11 | 0.62 | -17.36 | 5.87 | 0.25 | 0.30 | 0.25 | 0.00 | 0.26 |
| SEQID-02070 | 0.01 | 0.03 | 0.03 | 0.03 | 0.03 | 0.08 | 0.04 | 0.00 | 0.04 | 0.08 | 0.34 | -23.78 | 9.75 | 0.25 | 0.34 | 0.25 | 0.27 | 0.23 |

TABLE 1-continued

| | | | | | | | | | | | | | | | | | |
|---|---|---|---|---|---|---|---|---|---|---|---|---|---|---|---|---|---|
| SEQID-02071 | 0.03 | 0.06 | 0.04 | 0.05 | 0.04 | 0.04 | 0.05 | 0.04 | 0.03 | −17.18 | 0.59 | 0.00 | 6.52 | 0.21 | 0.34 | 0.24 | 0.00 |
| SEQID-02072 | 0.03 | 0.06 | 0.04 | 0.05 | 0.03 | 0.04 | 0.05 | 0.04 | 0.04 | −17.10 | 0.62 | 0.00 | 6.52 | 0.21 | 0.34 | 0.24 | 0.00 |
| SEQID-02073 | 0.01 | 0.05 | 0.10 | 0.03 | 0.06 | 0.01 | 0.05 | 0.05 | 0.07 | −18.26 | 0.47 | 0.03 | 9.73 | 0.25 | 0.31 | 0.00 | 0.24 |
| SEQID-02074 | 0.04 | 0.04 | 0.03 | 0.08 | 0.03 | 0.01 | 0.05 | 0.05 | 0.09 | −14.10 | 0.64 | −0.02 | 4.89 | 0.28 | 0.34 | 0.00 | 0.00 |
| SEQID-02075 | 0.03 | 0.05 | 0.06 | 0.03 | 0.03 | 0.01 | 0.07 | 0.05 | 0.06 | −24.22 | 0.34 | 0.00 | 6.97 | 0.22 | 0.31 | 0.00 | 0.23 |
| SEQID-02076 | 0.02 | 0.04 | 0.06 | 0.06 | 0.07 | 0.00 | 0.05 | 0.08 | 0.07 | −20.99 | 0.36 | −0.03 | 4.68 | 0.42 | 0.53 | 0.18 | 0.24 |
| SEQID-02077 | 0.03 | 0.03 | 0.05 | 0.04 | 0.09 | 0.00 | 0.04 | 0.07 | 0.07 | −19.18 | 0.30 | 0.03 | 10.75 | 0.22 | 0.32 | 0.00 | 0.26 |
| SEQID-02078 | 0.03 | 0.04 | 0.06 | 0.05 | 0.03 | 0.03 | 0.09 | 0.04 | 0.09 | −17.54 | 0.60 | −0.02 | 5.90 | 0.17 | 0.34 | 0.00 | 0.19 |
| SEQID-02079 | 0.01 | 0.05 | 0.05 | 0.06 | 0.06 | 0.02 | 0.02 | 0.05 | 0.03 | −13.17 | 0.30 | −0.02 | 4.59 | 0.22 | 0.32 | 0.00 | 0.23 |
| SEQID-02080 | 0.02 | 0.11 | 0.03 | 0.04 | 0.04 | 0.03 | 0.10 | 0.04 | 0.04 | −23.47 | 0.37 | 0.00 | 6.91 | 0.20 | 0.33 | 0.00 | 0.20 |
| SEQID-02081 | 0.04 | 0.05 | 0.06 | 0.04 | 0.05 | 0.01 | 0.06 | 0.06 | 0.05 | −20.97 | 0.33 | 0.00 | 6.80 | 0.21 | 0.33 | 0.00 | 0.22 |
| SEQID-02082 | 0.04 | 0.07 | 0.05 | 0.04 | 0.06 | 0.01 | 0.04 | 0.04 | 0.07 | −16.07 | 0.50 | −0.02 | 5.43 | 0.21 | 0.33 | 0.00 | 0.21 |
| SEQID-02083 | 0.03 | 0.05 | 0.04 | 0.04 | 0.05 | 0.02 | 0.06 | 0.05 | 0.06 | −18.69 | 0.44 | −0.02 | 4.94 | 0.21 | 0.34 | 0.21 | 0.21 |
| SEQID-02084 | 0.06 | 0.07 | 0.05 | 0.04 | 0.06 | 0.05 | 0.08 | 0.08 | 0.05 | −17.64 | 0.40 | −0.02 | 5.65 | 0.20 | 0.31 | 0.00 | 0.22 |
| SEQID-02085 | 0.00 | 0.03 | 0.03 | 0.05 | 0.04 | 0.02 | 0.08 | 0.03 | 0.03 | −18.57 | 0.29 | −0.04 | 4.95 | 0.21 | 0.33 | 0.22 | 0.22 |
| SEQID-02086 | 0.04 | 0.06 | 0.05 | 0.04 | 0.07 | 0.02 | 0.05 | 0.05 | 0.05 | −16.31 | 0.46 | −0.02 | 5.48 | 0.20 | 0.33 | 0.00 | 0.21 |
| SEQID-02087 | 0.03 | 0.04 | 0.03 | 0.03 | 0.04 | 0.01 | 0.05 | 0.04 | 0.07 | −23.59 | 0.37 | −0.03 | 4.89 | 0.19 | 0.33 | 0.00 | 0.20 |
| SEQID-02088 | 0.00 | 0.10 | 0.03 | 0.06 | 0.05 | 0.01 | 0.04 | 0.04 | 0.08 | −20.74 | 0.42 | −0.17 | 3.39 | 0.15 | 0.41 | 0.19 | 0.19 |
| SEQID-02089 | 0.02 | 0.00 | 0.01 | 0.09 | 0.03 | 0.02 | 0.04 | 0.04 | 0.18 | −17.01 | 0.91 | −0.04 | 4.37 | 0.33 | 0.29 | 0.00 | 0.27 |
| SEQID-02090 | 0.01 | 0.09 | 0.05 | 0.04 | 0.10 | 0.04 | 0.05 | 0.05 | 0.03 | −16.04 | 0.63 | −0.01 | 5.76 | 0.26 | 0.27 | 0.00 | 0.23 |
| SEQID-02091 | 0.02 | 0.03 | 0.06 | 0.06 | 0.05 | 0.00 | 0.05 | 0.05 | 0.05 | −24.85 | 0.21 | 0.03 | 10.85 | 0.25 | 0.30 | 0.00 | 0.00 |
| SEQID-02092 | 0.02 | 0.07 | 0.07 | 0.01 | 0.07 | 0.00 | 0.03 | 0.03 | 0.11 | −24.25 | 0.43 | 0.06 | 10.72 | 0.29 | 0.32 | 0.00 | 0.25 |
| SEQID-02093 | 0.04 | 0.00 | 0.02 | 0.03 | 0.02 | 0.00 | 0.05 | 0.05 | 0.07 | −26.07 | 0.29 | 0.14 | 11.85 | 0.22 | 0.29 | 0.28 | 0.21 |
| SEQID-02094 | 0.02 | 0.06 | 0.09 | 0.04 | 0.09 | 0.02 | 0.09 | 0.05 | 0.09 | −20.86 | 0.38 | −0.04 | 4.59 | 0.25 | 0.34 | 0.25 | 0.22 |
| SEQID-02095 | 0.03 | 0.07 | 0.02 | 0.05 | 0.03 | 0.04 | 0.01 | 0.05 | 0.06 | −20.82 | 0.50 | −0.01 | 6.27 | 0.20 | 0.30 | 0.23 | 0.22 |
| SEQID-02096 | 0.01 | 0.02 | 0.03 | 0.03 | 0.08 | 0.00 | 0.10 | 0.04 | 0.07 | −19.24 | 0.42 | 0.00 | 4.45 | 0.21 | 0.31 | 0.00 | 0.24 |
| SEQID-02097 | 0.01 | 0.01 | 0.04 | 0.04 | 0.04 | 0.01 | 0.01 | 0.06 | 0.13 | −19.37 | 0.48 | 0.04 | 11.46 | 0.25 | 0.34 | 0.00 | 0.23 |
| SEQID-02098 | 0.02 | 0.04 | 0.05 | 0.09 | 0.07 | 0.01 | 0.02 | 0.04 | 0.04 | −21.54 | 0.21 | 0.10 | 9.97 | 0.22 | 0.29 | 0.00 | 0.23 |
| SEQID-02099 | 0.06 | 0.05 | 0.04 | 0.04 | 0.05 | 0.00 | 0.04 | 0.05 | 0.06 | −20.26 | 0.40 | 0.03 | 9.94 | 0.25 | 0.30 | 0.00 | 0.22 |
| SEQID-02100 | 0.04 | 0.04 | 0.03 | 0.03 | 0.04 | 0.01 | 0.05 | 0.05 | 0.05 | −23.47 | 0.38 | −0.04 | 4.61 | 0.23 | 0.33 | 0.00 | 0.00 |
| SEQID-02101 | 0.03 | 0.02 | 0.04 | 0.04 | 0.04 | 0.00 | 0.05 | 0.05 | 0.07 | −21.34 | 0.25 | −0.01 | 8.71 | 0.31 | 0.31 | 0.00 | 0.25 |
| SEQID-02102 | 0.02 | 0.04 | 0.02 | 0.04 | 0.02 | 0.02 | 0.09 | 0.09 | 0.06 | −23.24 | 0.21 | −0.03 | 6.18 | 0.22 | 0.29 | 0.21 | 0.12 |
| SEQID-02103 | 0.04 | 0.03 | 0.04 | 0.05 | 0.04 | 0.01 | 0.01 | 0.03 | 0.07 | −21.63 | 0.38 | 0.01 | 8.67 | 0.20 | 0.31 | 0.19 | 0.00 |
| SEQID-02104 | 0.05 | 0.04 | 0.09 | 0.05 | 0.08 | 0.01 | 0.05 | 0.05 | 0.05 | −17.60 | 0.49 | 0.00 | 7.29 | 0.21 | 0.30 | 0.23 | 0.19 |
| SEQID-02105 | 0.02 | 0.06 | 0.04 | 0.04 | 0.06 | 0.10 | 0.05 | 0.04 | 0.06 | −21.56 | 0.46 | 0.04 | 9.87 | 0.25 | 0.36 | 0.00 | 0.00 |
| SEQID-02106 | 0.03 | 0.09 | 0.05 | 0.05 | 0.03 | 0.04 | 0.04 | 0.04 | 0.06 | −17.76 | 0.58 | 0.01 | 8.77 | 0.22 | 0.35 | 0.00 | 0.20 |
| SEQID-02107 | 0.03 | 0.06 | 0.04 | 0.04 | 0.06 | 0.01 | 0.03 | 0.03 | 0.06 | −19.10 | 0.39 | −0.01 | 6.27 | 0.21 | 0.33 | 0.00 | 0.22 |
| SEQID-02108 | 0.03 | 0.04 | 0.03 | 0.05 | 0.05 | 0.02 | 0.05 | 0.03 | 0.05 | −19.58 | 0.47 | −0.04 | 4.60 | 0.51 | 0.68 | 0.21 | 0.20 |
| SEQID-02109 | 0.01 | 0.02 | 0.04 | 0.03 | 0.06 | 0.02 | 0.05 | 0.05 | 0.08 | −20.33 | 0.44 | −0.02 | 5.35 | 0.21 | 0.35 | 0.00 | 0.25 |
| SEQID-02110 | 0.04 | 0.07 | 0.06 | 0.04 | 0.06 | 0.02 | 0.06 | 0.06 | 0.05 | −19.17 | 0.36 | −0.04 | 4.63 | 0.21 | 0.33 | 0.20 | 0.28 |
| SEQID-02111 | 0.03 | 0.07 | 0.02 | 0.06 | 0.05 | 0.02 | 0.02 | 0.02 | 0.09 | −11.09 | 1.13 | −0.01 | 4.93 | 0.20 | 0.32 | 0.00 | 0.00 |
| SEQID-02112 | 0.04 | 0.05 | 0.05 | 0.04 | 0.04 | 0.00 | 0.04 | 0.04 | 0.09 | −22.16 | 0.40 | −0.04 | 4.71 | 0.11 | 0.32 | 0.00 | 0.21 |
| SEQID-02113 | 0.03 | 0.03 | 0.06 | 0.04 | 0.05 | 0.30 | 0.03 | 0.03 | 0.08 | −20.86 | 0.51 | −0.03 | 4.69 | 0.19 | 0.34 | 0.00 | 0.21 |
| SEQID-02114 | 0.02 | 0.03 | 0.03 | 0.05 | 0.06 | 0.03 | 0.04 | 0.04 | 0.03 | −16.41 | 0.40 | −0.01 | 5.65 | 0.10 | 0.39 | 0.00 | 0.21 |
| SEQID-02115 | 0.04 | 0.05 | 0.06 | 0.04 | 0.05 | 0.01 | 0.04 | 0.03 | 0.06 | −18.27 | 0.45 | −0.03 | 4.75 | 0.18 | 0.33 | 0.00 | 0.22 |
| SEQID-02116 | 0.01 | 0.04 | 0.04 | 0.04 | 0.06 | 0.04 | 0.03 | 0.04 | 0.09 | −20.93 | 0.45 | −0.02 | 5.70 | 0.18 | 0.37 | 0.00 | 0.20 |
| SEQID-02117 | 0.05 | 0.06 | 0.06 | 0.01 | 0.03 | 0.02 | 0.00 | 0.04 | 0.08 | −19.43 | 0.36 | 0.13 | 11.09 | 0.26 | 0.22 | 0.19 | 0.25 |
| SEQID-02118 | 0.01 | 0.04 | 0.04 | 0.04 | 0.10 | 0.00 | 0.00 | 0.06 | 0.10 | −26.77 | 0.32 | 0.04 | 10.37 | 0.35 | 0.29 | 0.19 | 0.28 |
| SEQID-02119 | 0.04 | 0.03 | 0.06 | 0.08 | 0.08 | 0.00 | 0.06 | 0.05 | 0.15 | −17.89 | 0.60 | −0.01 | 5.70 | 0.21 | 0.33 | 0.00 | 0.00 |
| SEQID-02120 | 0.05 | 0.02 | 0.04 | 0.06 | 0.02 | 0.00 | 0.00 | 0.03 | 0.06 | −24.70 | 0.24 | −0.02 | 4.91 | 0.36 | 0.30 | 0.29 | 0.27 |
| SEQID-02121 | 0.03 | 0.02 | 0.04 | 0.04 | 0.04 | 0.06 | 0.06 | 0.04 | 0.09 | −24.80 | 0.40 | 0.03 | 9.83 | 0.23 | 0.29 | 0.23 | 0.00 |
| SEQID-02122 | 0.04 | 0.13 | 0.04 | 0.04 | 0.04 | 0.00 | 0.01 | 0.01 | 0.04 | −8.41 | 1.32 | 0.01 | 8.53 | 0.19 | 0.28 | 0.21 | 0.00 |
| SEQID-02123 | 0.03 | 0.04 | 0.05 | 0.08 | 0.05 | 0.00 | 0.06 | 0.06 | 0.03 | −17.19 | 0.53 | 0.04 | 10.00 | 0.26 | 0.31 | 0.24 | 0.75 |

TABLE 1-continued

| | | | | | | | | | | | | | | | |
|---|---|---|---|---|---|---|---|---|---|---|---|---|---|---|---|
| SEQID-02124 | 0.02 | 0.03 | 0.04 | 0.08 | 0.05 | 0.00 | 0.02 | 0.04 | -18.96 | 0.32 | 0.11 | 11.71 | 0.25 | 0.31 | 0.16 | 0.26 |
| SEQID-02125 | 0.03 | 0.03 | 0.01 | 0.05 | 0.02 | 0.00 | 0.04 | 0.02 | -21.54 | 0.50 | -0.02 | 4.88 | 0.24 | 0.36 | 0.25 | 0.25 |
| SEQID-02126 | 0.01 | 0.09 | 0.02 | 0.03 | 0.06 | 0.03 | 0.03 | 0.06 | -20.43 | 0.65 | -0.04 | 4.40 | 0.00 | 0.32 | 0.12 | 0.23 |
| SEQID-02127 | 0.06 | 0.02 | 0.03 | 0.06 | 0.05 | 0.01 | 0.05 | 0.08 | -24.19 | 0.25 | 0.10 | 11.65 | 0.23 | 0.31 | 0.00 | 0.22 |
| SEQID-02128 | 0.03 | 0.07 | 0.03 | 0.05 | 0.03 | 0.01 | 0.05 | 0.07 | -18.79 | 0.54 | 0.00 | 6.77 | 0.24 | 0.30 | 0.00 | 0.23 |
| SEQID-02129 | 0.01 | 0.03 | 0.00 | 0.04 | 0.02 | 0.00 | 0.03 | 0.04 | -22.65 | 0.43 | -0.03 | 4.83 | 0.27 | 0.35 | 0.22 | 0.21 |
| SEQID-02130 | 0.03 | 0.05 | 0.03 | 0.04 | 0.06 | 0.01 | 0.03 | 0.09 | -17.91 | 0.60 | -0.01 | 5.86 | 0.30 | 0.34 | 0.00 | 0.20 |
| SEQID-02131 | 0.03 | 0.03 | 0.02 | 0.07 | 0.04 | 0.02 | 0.03 | 0.07 | -32.77 | 0.31 | -0.03 | 4.71 | 0.22 | 0.50 | 0.17 | 0.21 |
| SEQID-02132 | 0.03 | 0.04 | 0.03 | 0.05 | 0.05 | 0.01 | 0.04 | 0.08 | -20.20 | 0.43 | -0.05 | 4.58 | 0.38 | 0.33 | 0.23 | 0.25 |
| SEQID-02133 | 0.03 | 0.07 | 0.02 | 0.06 | 0.05 | 0.02 | 0.03 | 0.05 | -23.22 | 0.29 | -0.03 | 4.63 | 0.22 | 0.33 | 0.33 | 0.00 |
| SEQID-02134 | 0.02 | 0.06 | 0.02 | 0.04 | 0.06 | 0.00 | 0.04 | 0.05 | -16.13 | 0.39 | -0.12 | 3.40 | 0.26 | 0.39 | 0.33 | 0.26 |
| SEQID-02135 | 0.04 | 0.01 | 0.04 | 0.05 | 0.04 | 0.00 | 0.04 | 0.09 | -18.90 | 0.49 | -0.01 | 6.38 | 0.23 | 0.31 | 0.21 | 0.23 |
| SEQID-02136 | 0.05 | 0.04 | 0.03 | 0.05 | 0.05 | 0.01 | 0.03 | 0.06 | -19.17 | 0.55 | -0.03 | 5.05 | 0.22 | 0.33 | 0.00 | 0.00 |
| SEQID-02137 | 0.02 | 0.05 | 0.06 | 0.03 | 0.06 | 0.01 | 0.05 | 0.11 | -15.26 | 0.59 | -0.04 | 4.43 | 0.21 | 0.32 | 0.20 | 0.13 |
| SEQID-02138 | 0.05 | 0.04 | 0.05 | 0.04 | 0.04 | 0.00 | 0.05 | 0.07 | -18.34 | 0.47 | -0.02 | 5.32 | 0.19 | 0.31 | 0.20 | 0.19 |
| SEQID-02139 | 0.04 | 0.03 | 0.04 | 0.05 | 0.06 | 0.00 | 0.03 | 0.10 | -17.78 | 0.55 | -0.03 | 4.78 | 0.22 | 0.39 | 0.22 | 0.21 |
| SEQID-02140 | 0.01 | 0.06 | 0.04 | 0.04 | 0.04 | 0.00 | 0.04 | 0.05 | -21.80 | 0.30 | 0.00 | 6.75 | 0.22 | 0.34 | 0.00 | 0.13 |
| SEQID-02141 | 0.04 | 0.03 | 0.04 | 0.04 | 0.07 | 0.01 | 0.07 | 0.08 | -30.82 | 0.37 | 0.01 | 8.41 | 0.22 | 0.33 | 0.00 | 0.18 |
| SEQID-02142 | 0.03 | 0.05 | 0.05 | 0.04 | 0.07 | 0.00 | 0.04 | 0.05 | -17.71 | 0.43 | -0.01 | 6.55 | 0.11 | 0.34 | 0.19 | 0.20 |
| SEQID-02143 | 0.03 | 0.09 | 0.04 | 0.06 | 0.05 | 0.03 | 0.01 | 0.12 | -11.30 | 1.31 | -0.05 | 4.02 | 0.21 | 0.34 | 0.00 | 0.22 |
| SEQID-02144 | 0.03 | 0.04 | 0.03 | 0.04 | 0.06 | 0.01 | 0.03 | 0.09 | -17.41 | 0.56 | -0.02 | 5.83 | 0.21 | 0.34 | 0.00 | 0.22 |
| SEQID-02145 | 0.03 | 0.02 | 0.04 | 0.04 | 0.04 | 0.00 | 0.03 | 0.09 | -18.17 | 0.53 | -0.03 | 5.38 | 0.12 | 0.33 | 0.00 | 0.22 |
| SEQID-02146 | 0.03 | 0.06 | 0.04 | 0.03 | 0.05 | 0.03 | 0.05 | 0.08 | -21.40 | 0.41 | -0.01 | 6.68 | 0.20 | 0.31 | 0.00 | 0.21 |
| SEQID-02147 | 0.03 | 0.04 | 0.02 | 0.06 | 0.04 | 0.04 | 0.03 | 0.03 | -22.57 | 0.18 | -0.04 | 4.69 | 0.20 | 0.34 | 0.00 | 0.20 |
| SEQID-02148 | 0.03 | 0.03 | 0.04 | 0.06 | 0.07 | 0.01 | 0.03 | 0.07 | -22.27 | 0.37 | -0.04 | 4.57 | 0.19 | 0.35 | 0.00 | 0.21 |
| SEQID-02149 | 0.03 | 0.04 | 0.03 | 0.04 | 0.04 | 0.02 | 0.07 | 0.05 | -31.30 | 0.34 | -0.02 | 5.61 | 0.20 | 0.32 | 0.00 | 0.20 |
| SEQID-02150 | 0.10 | 0.03 | 0.14 | 0.14 | 0.04 | 0.02 | 0.09 | 0.09 | -11.67 | 0.51 | -0.03 | 4.42 | 0.21 | 0.43 | 0.19 | 0.22 |
| SEQID-02151 | 0.02 | 0.07 | 0.04 | 0.04 | 0.07 | 0.03 | 0.07 | 0.05 | -21.86 | 0.34 | -0.04 | 6.55 | 0.19 | 0.33 | 0.00 | 0.20 |
| SEQID-02152 | 0.03 | 0.04 | 0.05 | 0.04 | 0.06 | 0.01 | 0.05 | 0.07 | -19.74 | 0.46 | -0.03 | 4.67 | 0.19 | 0.37 | 0.13 | 0.20 |
| SEQID-02153 | 0.02 | 0.04 | 0.04 | 0.05 | 0.04 | 0.02 | 0.05 | 0.05 | -20.57 | 0.34 | -0.01 | 6.46 | 0.19 | 0.33 | 0.19 | 0.10 |
| SEQID-02154 | 0.03 | 0.05 | 0.03 | 0.06 | 0.05 | 0.00 | 0.03 | 0.06 | -24.92 | 0.30 | -0.17 | 3.61 | 0.20 | 0.35 | 0.20 | 0.21 |
| SEQID-02155 | 0.01 | 0.06 | 0.05 | 0.04 | 0.05 | 0.03 | 0.06 | 0.05 | -18.77 | 0.38 | -0.03 | 5.27 | 0.18 | 0.37 | 0.19 | 0.19 |
| SEQID-02156 | 0.04 | 0.09 | 0.06 | 0.04 | 0.11 | 0.03 | 0.05 | 0.02 | -13.76 | 0.65 | 0.00 | 6.65 | 0.27 | 0.19 | 0.31 | 0.26 |
| SEQID-02157 | 0.02 | 0.00 | 0.04 | 0.04 | 0.04 | 0.00 | 0.00 | 0.01 | -27.75 | 0.24 | 0.04 | 10.19 | 0.34 | 0.30 | 0.37 | 0.30 |
| SEQID-02158 | 0.05 | 0.05 | 0.01 | 0.01 | 0.04 | 0.03 | 0.03 | 0.04 | -33.89 | 0.16 | 0.01 | 7.70 | 0.27 | 0.23 | 0.00 | 0.00 |
| SEQID-02159 | 0.04 | 0.02 | 0.04 | 0.06 | 0.09 | 0.02 | 0.06 | 0.07 | -17.85 | 0.43 | -0.01 | 5.74 | 0.29 | 0.29 | 0.00 | 0.38 |
| SEQID-02160 | 0.02 | 0.05 | 0.04 | 0.04 | 0.05 | 0.02 | 0.06 | 0.13 | -21.12 | 0.33 | 0.12 | 9.08 | 0.23 | 0.26 | 0.23 | 0.27 |
| SEQID-02161 | 0.04 | 0.06 | 0.04 | 0.05 | 0.02 | 0.00 | 0.09 | 0.14 | -20.90 | 0.46 | -0.05 | 4.38 | 0.24 | 0.30 | 0.28 | 0.23 |
| SEQID-02162 | 0.03 | 0.08 | 0.03 | 0.03 | 0.07 | 0.00 | 0.00 | 0.09 | -16.54 | 0.31 | -0.01 | 5.19 | 0.22 | 0.32 | 0.00 | 0.00 |
| SEQID-02163 | 0.09 | 0.05 | 0.09 | 0.09 | 0.10 | 0.00 | 0.07 | 0.06 | -21.10 | 0.11 | 0.09 | 6.83 | 0.00 | 0.43 | 0.00 | 0.24 |
| SEQID-02164 | 0.07 | 0.09 | 0.03 | 0.10 | 0.05 | 0.00 | 0.01 | 0.02 | -23.49 | 0.31 | 0.10 | 10.67 | 0.27 | 0.28 | 0.33 | 0.21 |
| SEQID-02165 | 0.03 | 0.05 | 0.03 | 0.04 | 0.04 | 0.02 | 0.04 | 0.10 | -15.36 | 0.73 | 0.03 | 9.19 | 0.36 | 0.39 | 0.29 | 0.23 |
| SEQID-02166 | 0.04 | 0.04 | 0.06 | 0.02 | 0.06 | 0.03 | 0.04 | 0.13 | -16.83 | 0.54 | -0.05 | 4.34 | 0.40 | 0.31 | 0.00 | 0.27 |
| SEQID-02167 | 0.02 | 0.03 | 0.05 | 0.04 | 0.09 | 0.00 | 0.03 | 0.04 | -25.16 | 0.37 | 0.07 | 10.46 | 0.27 | 0.46 | 0.00 | 0.00 |
| SEQID-02168 | 0.04 | 0.03 | 0.04 | 0.04 | 0.05 | 0.00 | 0.06 | 0.13 | -25.40 | 0.23 | 0.12 | 11.02 | 0.23 | 0.28 | 0.23 | 0.24 |
| SEQID-02169 | 0.05 | 0.05 | 0.03 | 0.05 | 0.03 | 0.00 | 0.09 | 0.06 | -22.21 | 0.32 | -0.05 | 4.38 | 0.24 | 0.39 | 0.28 | 0.21 |
| SEQID-02170 | 0.03 | 0.08 | 0.06 | 0.03 | 0.07 | 0.00 | 0.05 | 0.12 | -16.54 | 0.74 | -0.01 | 5.19 | 0.22 | 0.32 | 0.00 | 0.00 |
| SEQID-02171 | 0.04 | 0.02 | 0.03 | 0.04 | 0.10 | 0.01 | 0.03 | 0.07 | -20.64 | 0.43 | 0.09 | 11.06 | 0.24 | 0.32 | 0.00 | 0.23 |
| SEQID-02172 | 0.03 | 0.03 | 0.03 | 0.02 | 0.05 | 0.00 | 0.04 | 0.10 | -23.32 | 0.33 | 0.10 | 11.21 | 0.20 | 0.30 | 0.34 | 0.00 |
| SEQID-02173 | 0.02 | 0.05 | 0.05 | 0.04 | 0.06 | 0.00 | 0.03 | 0.06 | -17.37 | 0.50 | 0.00 | 6.52 | 0.31 | 0.29 | 0.21 | 0.12 |
| SEQID-02174 | 0.03 | 0.04 | 0.03 | 0.04 | 0.08 | 0.01 | 0.06 | 0.08 | -16.83 | 0.69 | -0.04 | 4.48 | 0.00 | 0.31 | 0.00 | 0.21 |
| SEQID-02175 | 0.01 | 0.07 | 0.05 | 0.04 | 0.06 | 0.01 | 0.02 | 0.07 | -16.84 | 0.65 | -0.03 | 4.65 | 0.33 | 0.33 | 0.00 | 0.14 |
| SEQID-02175 | 0.06 | 0.09 | 0.03 | 0.07 | 0.06 | 0.01 | 0.06 | 0.12 | -9.86 | 1.25 | -0.03 | 4.30 | 0.20 | 0.31 | 0.00 | 0.22 |
| SEQID-02176 | 0.02 | 0.03 | 0.05 | 0.05 | 0.04 | 0.02 | 0.02 | 0.08 | -19.08 | 0.45 | -0.06 | 4.48 | 0.00 | 0.33 | 0.00 | 0.23 |

TABLE 1-continued

| | | | | | | | | | | | | | | | |
|---|---|---|---|---|---|---|---|---|---|---|---|---|---|---|---|
| SEQID-02177 | 0.03 | 0.06 | 0.06 | 0.04 | 0.06 | 0.02 | 0.10 | 0.06 | -16.64 | 0.38 | -0.01 | 6.12 | 0.22 | 0.30 | 0.22 | 0.00 |
| SEQID-02178 | 0.06 | 0.09 | 0.04 | 0.06 | 0.07 | 0.05 | 0.06 | 0.09 | -12.20 | 0.88 | 0.02 | 9.25 | 0.21 | 0.29 | 0.00 | 0.19 |
| SEQID-02179 | 0.02 | 0.04 | 0.05 | 0.05 | 0.06 | 0.02 | 0.02 | 0.09 | -15.62 | 0.57 | -0.02 | 5.15 | 0.20 | 0.32 | 0.00 | 0.24 |
| SEQID-02180 | 0.04 | 0.03 | 0.05 | 0.05 | 0.06 | 0.01 | 0.01 | 0.10 | -15.23 | 0.64 | -0.02 | 4.99 | 0.27 | 0.38 | 0.00 | 0.00 |
| SEQID-02181 | 0.05 | 0.03 | 0.03 | 0.05 | 0.05 | 0.01 | 0.03 | 0.07 | -20.34 | 0.42 | -0.01 | 5.12 | 0.24 | 0.34 | 0.00 | 0.19 |
| SEQID-02182 | 0.02 | 0.07 | 0.04 | 0.04 | 0.05 | 0.02 | 0.03 | 0.06 | -21.19 | 0.43 | -0.02 | 5.47 | 0.22 | 0.31 | 0.00 | 0.00 |
| SEQID-02183 | 0.03 | 0.03 | 0.06 | 0.05 | 0.06 | 0.03 | 0.06 | 0.06 | -16.88 | 0.56 | -0.01 | 6.36 | 0.20 | 0.31 | 0.00 | 0.00 |
| SEQID-02184 | 0.02 | 0.03 | 0.03 | 0.04 | 0.05 | 0.03 | 0.05 | 0.06 | -22.05 | 0.41 | -0.01 | 4.61 | 0.24 | 0.31 | 0.00 | 0.00 |
| SEQID-02185 | 0.03 | 0.05 | 0.05 | 0.03 | 0.06 | 0.01 | 0.03 | 0.06 | -20.27 | 0.37 | -0.01 | 6.51 | 0.21 | 0.34 | 0.00 | 0.00 |
| SEQID-02186 | 0.02 | 0.11 | 0.04 | 0.02 | 0.05 | 0.04 | 0.01 | 0.07 | -11.45 | 0.82 | -0.01 | 6.51 | 0.22 | 0.31 | 0.00 | 0.21 |
| SEQID-02187 | 0.02 | 0.06 | 0.05 | 0.08 | 0.06 | 0.07 | 0.04 | 0.05 | -18.36 | 0.40 | -0.04 | 4.52 | 0.19 | 0.34 | 0.00 | 0.21 |
| SEQID-02188 | 0.05 | 0.08 | 0.03 | 0.04 | 0.04 | 0.01 | 0.06 | 0.07 | -22.44 | 0.39 | -0.04 | 4.83 | 0.20 | 0.32 | 0.00 | 0.20 |
| SEQID-02189 | 0.04 | 0.05 | 0.05 | 0.03 | 0.05 | 0.02 | 0.03 | 0.06 | -18.28 | 0.54 | -0.01 | 6.44 | 0.17 | 0.31 | 0.17 | 0.21 |
| SEQID-02190 | 0.04 | 0.03 | 0.03 | 0.04 | 0.06 | 0.01 | 0.05 | 0.08 | -15.62 | 0.60 | 0.00 | 5.94 | 0.22 | 0.33 | 0.23 | 0.24 |
| SEQID-02191 | 0.03 | 0.06 | 0.06 | 0.06 | 0.06 | 0.01 | 0.03 | 0.05 | -16.55 | 0.51 | -0.02 | 5.25 | 0.23 | 0.32 | 0.00 | 0.21 |
| SEQID-02192 | 0.04 | 0.03 | 0.03 | 0.05 | 0.09 | 0.02 | 0.04 | 0.09 | -14.81 | 0.52 | -0.01 | 5.23 | 0.21 | 0.33 | 0.18 | 0.21 |
| SEQID-02193 | 0.03 | 0.06 | 0.06 | 0.05 | 0.03 | 0.01 | 0.05 | 0.07 | -10.43 | 1.03 | -0.03 | 4.79 | 0.22 | 0.34 | 0.00 | 0.23 |
| SEQID-02194 | 0.01 | 0.07 | 0.03 | 0.04 | 0.06 | 0.04 | 0.02 | 0.08 | -15.31 | 0.79 | -0.03 | 4.51 | 0.23 | 0.33 | 0.00 | 0.22 |
| SEQID-02195 | 0.02 | 0.05 | 0.09 | 0.05 | 0.06 | 0.01 | 0.04 | 0.05 | -19.05 | 0.33 | -0.02 | 4.95 | 0.22 | 0.39 | 0.23 | 0.22 |
| SEQID-02196 | 0.03 | 0.09 | 0.05 | 0.04 | 0.06 | 0.05 | 0.05 | 0.03 | -10.73 | 0.96 | -0.02 | 5.16 | 0.21 | 0.32 | 0.00 | 0.22 |
| SEQID-02197 | 0.00 | 0.02 | 0.10 | 0.07 | 0.10 | 0.02 | 0.00 | 0.08 | -26.49 | 0.28 | -0.14 | 3.92 | 0.21 | 0.43 | 0.21 | 0.23 |
| SEQID-02198 | 0.01 | 0.09 | 0.10 | 0.06 | 0.06 | 0.01 | 0.02 | 0.10 | -13.64 | 0.45 | -0.03 | 3.66 | 0.26 | 0.35 | 0.18 | 0.24 |
| SEQID-02199 | 0.02 | 0.04 | 0.04 | 0.04 | 0.04 | 0.02 | 0.05 | 0.05 | -18.35 | 0.42 | -0.02 | 5.50 | 0.20 | 0.31 | 0.00 | 0.21 |
| SEQID-02200 | 0.03 | 0.05 | 0.06 | 0.06 | 0.07 | 0.02 | 0.05 | 0.05 | -18.13 | 0.35 | -0.03 | 4.90 | 0.22 | 0.33 | 0.00 | 0.21 |
| SEQID-02201 | 0.04 | 0.04 | 0.05 | 0.05 | 0.04 | 0.02 | 0.05 | 0.07 | -17.57 | 0.46 | -0.02 | 5.62 | 0.21 | 0.32 | 0.00 | 0.22 |
| SEQID-02202 | 0.03 | 0.04 | 0.05 | 0.04 | 0.04 | 0.05 | 0.05 | 0.06 | -20.49 | 0.35 | -0.02 | 5.54 | 0.00 | 0.32 | 0.00 | 0.22 |
| SEQID-02203 | 0.02 | 0.05 | 0.05 | 0.05 | 0.06 | 0.01 | 0.06 | 0.05 | -21.67 | 0.31 | -0.01 | 6.52 | 0.18 | 0.32 | 0.00 | 0.21 |
| SEQID-02204 | 0.02 | 0.06 | 0.03 | 0.04 | 0.06 | 0.05 | 0.05 | 0.05 | -23.34 | 0.33 | -0.04 | 4.74 | 0.25 | 0.39 | 0.00 | 0.20 |
| SEQID-02205 | 0.03 | 0.05 | 0.05 | 0.04 | 0.05 | 0.02 | 0.04 | 0.06 | -20.67 | 0.33 | -0.03 | 4.77 | 0.42 | 0.43 | 0.21 | 0.21 |
| SEQID-02206 | 0.02 | 0.05 | 0.04 | 0.05 | 0.05 | 0.03 | 0.03 | 0.07 | -15.97 | 0.76 | -0.02 | 4.80 | 0.19 | 0.35 | 0.18 | 0.20 |
| SEQID-02207 | 0.02 | 0.03 | 0.06 | 0.04 | 0.07 | 0.03 | 0.04 | 0.03 | -23.26 | 0.31 | -0.01 | 5.64 | 0.00 | 0.31 | 0.00 | 0.00 |
| SEQID-02208 | 0.03 | 0.03 | 0.03 | 0.05 | 0.05 | 0.02 | 0.09 | 0.05 | -23.56 | 0.26 | 0.04 | 9.73 | 0.00 | 0.35 | 0.00 | 0.17 |
| SEQID-02209 | 0.03 | 0.03 | 0.03 | 0.04 | 0.04 | 0.01 | 0.02 | 0.04 | -28.21 | 0.23 | -0.02 | 5.45 | 0.19 | 0.56 | 0.19 | 0.00 |
| SEQID-02210 | 0.03 | 0.04 | 0.02 | 0.04 | 0.04 | 0.01 | 0.03 | 0.04 | -26.63 | 0.25 | -0.01 | 5.91 | 0.20 | 0.53 | 0.19 | 0.18 |
| SEQID-02211 | 0.02 | 0.04 | 0.01 | 0.04 | 0.06 | 0.02 | 0.03 | 0.08 | -24.06 | 0.30 | -0.02 | 6.23 | 0.00 | 0.38 | 0.19 | 0.00 |
| SEQID-02212 | 0.04 | 0.02 | 0.04 | 0.03 | 0.05 | 0.01 | 0.03 | 0.05 | -26.31 | 0.29 | -0.02 | 5.33 | 0.26 | 0.54 | 0.00 | 0.18 |
| SEQID-02213 | 0.03 | 0.04 | 0.01 | 0.06 | 0.06 | 0.01 | 0.03 | 0.05 | -19.00 | 0.62 | -0.02 | 4.86 | 0.19 | 0.35 | 0.18 | 0.20 |
| SEQID-02214 | 0.04 | 0.00 | 0.04 | 0.04 | 0.03 | 0.01 | 0.06 | 0.09 | -32.13 | 0.13 | -0.03 | 5.10 | 0.33 | 0.55 | 0.00 | 0.21 |
| SEQID-02215 | 0.04 | 0.04 | 0.01 | 0.04 | 0.06 | 0.02 | 0.01 | 0.05 | -23.77 | 0.30 | -0.03 | 4.98 | 0.21 | 0.34 | 0.21 | 0.19 |
| SEQID-02216 | 0.02 | 0.04 | 0.06 | 0.05 | 0.07 | 0.03 | 0.04 | 0.04 | -19.87 | 0.35 | 0.01 | 8.15 | 0.18 | 0.38 | 0.19 | 0.21 |
| SEQID-02217 | 0.05 | 0.04 | 0.04 | 0.05 | 0.06 | 0.04 | 0.05 | 0.09 | -19.66 | 0.42 | -0.03 | 5.05 | 0.00 | 0.30 | 0.00 | 0.20 |
| SEQID-02218 | 0.04 | 0.07 | 0.04 | 0.03 | 0.04 | 0.02 | 0.06 | 0.05 | -20.75 | 0.42 | -0.01 | 6.25 | 0.21 | 0.33 | 0.00 | 0.21 |
| SEQID-02219 | 0.03 | 0.04 | 0.01 | 0.04 | 0.06 | 0.01 | 0.03 | 0.04 | -27.49 | 0.25 | -0.02 | 5.63 | 0.18 | 0.53 | 0.18 | 0.18 |
| SEQID-02220 | 0.04 | 0.04 | 0.04 | 0.04 | 0.04 | 0.01 | 0.03 | 0.04 | -27.72 | 0.23 | -0.02 | 5.64 | 0.19 | 0.51 | 0.18 | 0.18 |
| SEQID-02221 | 0.05 | 0.06 | 0.04 | 0.05 | 0.07 | 0.02 | 0.06 | 0.06 | -19.58 | 0.45 | -0.01 | 6.33 | 0.21 | 0.34 | 0.00 | 0.19 |
| SEQID-02222 | 0.03 | 0.04 | 0.01 | 0.04 | 0.04 | 0.00 | 0.03 | 0.03 | -28.29 | 0.22 | -0.02 | 5.42 | 0.19 | 0.49 | 0.21 | 0.18 |
| SEQID-02223 | 0.01 | 0.03 | 0.06 | 0.05 | 0.08 | 0.03 | 0.05 | 0.10 | -20.80 | 0.34 | 0.00 | 7.29 | 0.19 | 0.32 | 0.18 | 0.18 |
| SEQID-02224 | 0.02 | 0.05 | 0.06 | 0.06 | 0.06 | 0.03 | 0.06 | 0.07 | -19.95 | 0.34 | 0.00 | 6.73 | 0.19 | 0.37 | 0.20 | 0.21 |
| SEQID-02225 | 0.03 | 0.05 | 0.05 | 0.06 | 0.06 | 0.02 | 0.07 | 0.07 | -20.00 | 0.32 | -0.01 | 6.59 | 0.18 | 0.33 | 0.19 | 0.19 |
| SEQID-02226 | 0.03 | 0.05 | 0.04 | 0.06 | 0.04 | 0.02 | 0.03 | 0.06 | -23.59 | 0.30 | 0.00 | 6.84 | 0.42 | 0.64 | 0.00 | 0.19 |
| SEQID-02227 | 0.04 | 0.06 | 0.03 | 0.06 | 0.04 | 0.02 | 0.04 | 0.06 | -21.10 | 0.46 | -0.02 | 5.40 | 0.00 | 0.35 | 0.00 | 0.20 |
| SEQID-02228 | 0.02 | 0.03 | 0.05 | 0.04 | 0.05 | 0.01 | 0.06 | 0.06 | -18.44 | 0.42 | 0.02 | 8.30 | 0.20 | 0.30 | 0.00 | 0.21 |
| SEQID-02229 | 0.03 | 0.04 | 0.05 | 0.04 | 0.05 | 0.03 | 0.05 | 0.08 | -24.61 | 0.31 | -0.01 | 5.58 | 0.20 | 0.33 | 0.19 | 0.19 |

TABLE 1-continued

| | | | | | | | | | | | | | | | |
|---|---|---|---|---|---|---|---|---|---|---|---|---|---|---|---|
| SEQID-02230 | 0.04 | 0.05 | 0.03 | 0.02 | 0.04 | 0.02 | 0.06 | 0.06 | -22.56 | 0.34 | 0.00 | 7.09 | 0.20 | 0.33 | 0.00 | 0.20 |
| SEQID-02231 | 0.04 | 0.05 | 0.03 | 0.05 | 0.05 | 0.05 | 0.05 | 0.09 | -19.29 | 0.45 | 0.01 | 8.31 | 0.72 | 0.89 | 0.00 | 0.00 |
| SEQID-02232 | 0.04 | 0.06 | 0.04 | 0.05 | 0.04 | 0.02 | 0.04 | 0.06 | -22.05 | 0.44 | -0.04 | 4.80 | 0.00 | 0.41 | 0.00 | 0.18 |
| SEQID-02233 | 0.04 | 0.07 | 0.03 | 0.04 | 0.04 | 0.01 | 0.07 | 0.05 | -22.35 | 0.33 | 0.00 | 6.87 | 0.20 | 0.33 | 0.00 | 0.21 |
| SEQID-02234 | 0.02 | 0.05 | 0.04 | 0.04 | 0.04 | 0.02 | 0.03 | 0.06 | -22.15 | 0.37 | 0.00 | 6.79 | 0.94 | 0.99 | 0.21 | 0.22 |
| SEQID-02235 | 0.03 | 0.05 | 0.03 | 0.04 | 0.04 | 0.03 | 0.05 | 0.07 | -22.81 | 0.33 | 0.00 | 6.74 | 0.44 | 0.65 | 0.00 | 0.00 |
| SEQID-02236 | 0.02 | 0.05 | 0.04 | 0.05 | 0.06 | 0.03 | 0.03 | 0.10 | -21.98 | 0.35 | 0.00 | 6.84 | 0.19 | 0.33 | 0.19 | 0.19 |
| SEQID-02237 | 0.05 | 0.05 | 0.03 | 0.04 | 0.04 | 0.03 | 0.05 | 0.04 | -22.90 | 0.32 | 0.05 | 9.86 | 0.00 | 0.29 | 0.00 | 0.00 |
| SEQID-02238 | 0.02 | 0.03 | 0.02 | 0.02 | 0.02 | 0.01 | 0.04 | 0.02 | -40.08 | 0.09 | 0.07 | 10.40 | 0.26 | 0.39 | 0.24 | 0.24 |
| SEQID-02239 | 0.04 | 0.03 | 0.03 | 0.03 | 0.05 | 0.03 | 0.02 | 0.05 | -24.45 | 0.38 | -0.06 | 4.47 | 0.39 | 0.54 | 0.00 | 0.00 |
| SEQID-02240 | 0.01 | 0.05 | 0.04 | 0.05 | 0.06 | 0.03 | 0.06 | 0.09 | -21.66 | 0.35 | -0.01 | 5.77 | 0.20 | 0.33 | 0.19 | 0.19 |
| SEQID-02241 | 0.05 | 0.06 | 0.03 | 0.04 | 0.04 | 0.00 | 0.04 | 0.06 | -21.24 | 0.38 | -0.07 | 4.39 | 0.27 | 0.38 | 0.00 | 0.21 |
| SEQID-02242 | 0.04 | 0.06 | 0.08 | 0.06 | 0.05 | 0.01 | 0.03 | 0.05 | -20.78 | 0.20 | 0.01 | 7.73 | 0.24 | 0.39 | 0.22 | 0.24 |
| SEQID-02243 | 0.04 | 0.03 | 0.01 | 0.08 | 0.05 | 0.00 | 0.04 | 0.03 | -25.45 | 0.16 | -0.03 | 5.11 | 0.31 | 0.49 | 0.00 | 0.26 |
| SEQID-02244 | 0.02 | 0.02 | 0.16 | 0.04 | 0.04 | 0.01 | 0.02 | 0.03 | -14.16 | 0.16 | 0.02 | 9.58 | 0.57 | 0.83 | 0.21 | 0.21 |
| SEQID-02245 | 0.05 | 0.06 | 0.09 | 0.03 | 0.02 | 0.00 | 0.03 | 0.06 | -21.06 | 0.37 | -0.05 | 4.40 | 0.26 | 0.35 | 0.00 | 0.39 |
| SEQID-02246 | 0.04 | 0.03 | 0.07 | 0.07 | 0.07 | 0.02 | 0.03 | 0.05 | -17.43 | 0.28 | 0.02 | 9.52 | 0.22 | 0.32 | 0.20 | 0.24 |
| SEQID-02247 | 0.05 | 0.05 | 0.03 | 0.03 | 0.07 | 0.02 | 0.03 | 0.07 | -18.04 | 0.51 | 0.01 | 8.27 | 0.20 | 0.34 | 0.22 | 0.21 |
| SEQID-02248 | 0.03 | 0.03 | 0.18 | 0.04 | 0.04 | 0.01 | 0.01 | 0.03 | -15.17 | 0.17 | 0.01 | 5.18 | 0.54 | 0.80 | 0.00 | 0.21 |
| SEQID-02249 | 0.02 | 0.03 | 0.18 | 0.05 | 0.04 | 0.01 | 0.03 | 0.03 | -14.55 | 0.17 | -0.01 | 6.05 | 0.59 | 0.80 | 0.21 | 0.38 |
| SEQID-02250 | 0.02 | 0.04 | 0.04 | 0.05 | 0.05 | 0.02 | 0.04 | 0.06 | -22.44 | 0.34 | -0.01 | 5.99 | 0.21 | 0.50 | 0.19 | 0.33 |
| SEQID-02251 | 0.05 | 0.02 | 0.03 | 0.06 | 0.04 | 0.03 | 0.02 | 0.12 | -18.26 | 0.58 | 0.01 | 7.70 | 0.24 | 0.34 | 0.00 | 0.21 |
| SEQID-02252 | 0.01 | 0.04 | 0.09 | 0.04 | 0.04 | 0.02 | 0.03 | 0.07 | -23.00 | 0.39 | 0.01 | 5.90 | 0.21 | 0.41 | 0.21 | 0.20 |
| SEQID-02253 | 0.04 | 0.04 | 0.03 | 0.05 | 0.06 | 0.05 | 0.04 | 0.09 | -21.44 | 0.45 | 0.01 | 7.94 | 0.21 | 0.33 | 0.00 | 0.22 |
| SEQID-02254 | 0.05 | 0.03 | 0.03 | 0.04 | 0.03 | 0.03 | 0.02 | 0.06 | -29.51 | 0.27 | 0.05 | 10.02 | 0.23 | 0.36 | 0.23 | 0.18 |
| SEQID-02255 | 0.03 | 0.01 | 0.01 | 0.05 | 0.04 | 0.02 | 0.04 | 0.04 | -23.64 | 0.19 | 0.02 | 9.54 | 0.22 | 0.31 | 0.00 | 0.22 |
| SEQID-02256 | 0.03 | 0.08 | 0.01 | 0.04 | 0.06 | 0.03 | 0.05 | 0.06 | -30.26 | 0.28 | -0.19 | 6.21 | 0.22 | 0.43 | 0.22 | 0.22 |
| SEQID-02257 | 0.02 | 0.07 | 0.01 | 0.04 | 0.05 | 0.01 | 0.02 | 0.06 | -23.75 | 0.45 | -0.01 | 5.76 | 0.20 | 0.31 | 0.21 | 0.00 |
| SEQID-02258 | 0.03 | 0.04 | 0.05 | 0.04 | 0.04 | 0.03 | 0.04 | 0.09 | -20.89 | 0.41 | -0.01 | 9.59 | 0.21 | 0.31 | 0.00 | 0.19 |
| SEQID-02259 | 0.02 | 0.00 | 0.06 | 0.07 | 0.08 | 0.03 | 0.05 | 0.09 | -19.83 | 0.34 | -0.01 | 5.53 | 0.20 | 0.34 | 0.19 | 0.22 |
| SEQID-02260 | 0.02 | 0.07 | 0.03 | 0.03 | 0.05 | 0.04 | 0.07 | 0.07 | -16.17 | 0.70 | 0.02 | 9.14 | 0.20 | 0.33 | 0.00 | 0.21 |
| SEQID-02261 | 0.03 | 0.03 | 0.05 | 0.05 | 0.05 | 0.03 | 0.06 | 0.06 | -19.20 | 0.36 | 0.00 | 6.73 | 0.19 | 0.32 | 0.19 | 0.20 |
| SEQID-02262 | 0.04 | 0.03 | 0.05 | 0.03 | 0.04 | 0.05 | 0.05 | 0.07 | -19.23 | 0.32 | -0.01 | 6.31 | 0.00 | 0.37 | 0.17 | 0.19 |
| SEQID-02263 | 0.04 | 0.10 | 0.03 | 0.05 | 0.06 | 0.02 | 0.02 | 0.05 | -23.98 | 0.25 | -0.05 | 4.70 | 0.22 | 0.36 | 0.00 | 0.21 |
| SEQID-02264 | 0.03 | 0.05 | 0.01 | 0.05 | 0.06 | 0.02 | 0.06 | 0.05 | -19.53 | 0.43 | -0.03 | 5.15 | 0.00 | 0.31 | 0.00 | 0.00 |
| SEQID-02265 | 0.09 | 0.08 | 0.04 | 0.04 | 0.05 | 0.02 | 0.05 | 0.06 | -22.21 | 0.34 | 0.00 | 7.11 | 0.19 | 0.33 | 0.00 | 0.22 |
| SEQID-02266 | 0.03 | 0.06 | 0.03 | 0.03 | 0.03 | 0.06 | 0.06 | 0.05 | -25.20 | 0.34 | -0.02 | 6.06 | 0.92 | 0.93 | 0.21 | 0.20 |
| SEQID-02267 | 0.01 | 0.07 | 0.01 | 0.04 | 0.04 | 0.02 | 0.04 | 0.07 | -16.86 | 0.55 | 0.07 | 10.36 | 0.20 | 0.34 | 0.00 | 0.00 |
| SEQID-02268 | 0.03 | 0.09 | 0.05 | 0.06 | 0.07 | 0.05 | 0.04 | 0.09 | -17.85 | 0.47 | 0.02 | 8.58 | 0.69 | 0.85 | 0.19 | 0.22 |
| SEQID-02269 | 0.04 | 0.06 | 0.03 | 0.03 | 0.04 | 0.02 | 0.05 | 0.06 | -21.18 | 0.25 | 0.07 | 8.51 | 0.21 | 0.32 | 0.00 | 0.20 |
| SEQID-02270 | 0.03 | 0.05 | 0.05 | 0.05 | 0.05 | 0.03 | 0.06 | 0.07 | -19.20 | 0.36 | 0.00 | 6.73 | 0.19 | 0.32 | 0.19 | 0.19 |
| SEQID-02271 | 0.02 | 0.05 | 0.03 | 0.03 | 0.07 | 0.03 | 0.05 | 0.09 | -23.98 | 0.25 | -0.05 | 4.70 | 0.22 | 0.36 | 0.00 | 0.21 |
| SEQID-02272 | 0.03 | 0.03 | 0.04 | 0.06 | 0.05 | 0.02 | 0.06 | 0.05 | -19.53 | 0.43 | -0.03 | 5.15 | 0.00 | 0.31 | 0.00 | 0.22 |
| SEQID-02273 | 0.03 | 0.05 | 0.06 | 0.03 | 0.03 | 0.06 | 0.06 | 0.06 | -22.21 | 0.34 | 0.00 | 7.11 | 0.19 | 0.33 | 0.00 | 0.20 |
| SEQID-02274 | 0.01 | 0.07 | 0.01 | 0.04 | 0.04 | 0.02 | 0.04 | 0.07 | -25.20 | 0.34 | -0.02 | 6.06 | 0.92 | 0.93 | 0.21 | 0.21 |
| SEQID-02275 | 0.03 | 0.09 | 0.05 | 0.06 | 0.07 | 0.05 | 0.06 | 0.09 | -16.86 | 0.55 | 0.07 | 10.36 | 0.20 | 0.34 | 0.00 | 0.00 |
| SEQID-02276 | 0.04 | 0.06 | 0.03 | 0.04 | 0.04 | 0.02 | 0.04 | 0.07 | -17.85 | 0.47 | 0.02 | 8.58 | 0.69 | 0.85 | 0.19 | 0.22 |
| SEQID-02277 | 0.01 | 0.01 | 0.03 | 0.03 | 0.05 | 0.02 | 0.07 | 0.06 | -21.18 | 0.25 | 0.07 | 8.51 | 0.21 | 0.32 | 0.00 | 0.23 |
| SEQID-02278 | 0.04 | 0.09 | 0.06 | 0.03 | 0.04 | 0.02 | 0.09 | 0.07 | -16.15 | 0.52 | 0.05 | 9.72 | 0.20 | 0.34 | 0.21 | 0.21 |
| SEQID-02279 | 0.05 | 0.09 | 0.03 | 0.06 | 0.05 | 0.02 | 0.03 | 0.06 | -24.33 | 0.31 | -0.04 | 4.60 | 0.40 | 0.60 | 0.00 | 0.19 |
| SEQID-02280 | 0.01 | 0.04 | 0.04 | 0.03 | 0.04 | 0.01 | 0.04 | 0.09 | -20.24 | 0.49 | 0.00 | 7.29 | 0.19 | 0.33 | 0.24 | 0.23 |
| SEQID-02281 | 0.05 | 0.08 | 0.05 | 0.05 | 0.06 | 0.00 | 0.01 | 0.03 | -28.13 | 0.33 | -0.05 | 4.67 | 0.22 | 0.26 | 0.00 | 0.21 |
| SEQID-02282 | 0.02 | 0.00 | 0.00 | 0.04 | 0.02 | 0.00 | 0.03 | 0.03 | -36.76 | 0.12 | -0.09 | 4.39 | 0.58 | 0.69 | 0.22 | 0.22 |

TABLE 1-continued

| | | | | | | | | | | | | | | | | |
|---|---|---|---|---|---|---|---|---|---|---|---|---|---|---|---|---|
| SEQID-02283 | 0.05 | 0.03 | 0.02 | 0.03 | 0.04 | 0.00 | 0.01 | 0.09 | 0.71 | 0.00 | -19.35 | 7.52 | 0.24 | 0.32 | 0.00 | 0.25 |
| SEQID-02284 | 0.07 | 0.08 | 0.06 | 0.05 | 0.06 | 0.00 | 0.01 | 0.03 | 0.31 | -0.02 | -24.42 | 5.21 | 0.19 | 0.28 | 0.00 | 0.00 |
| SEQID-02285 | 0.07 | 0.08 | 0.06 | 0.05 | 0.06 | 0.00 | 0.01 | 0.08 | 0.32 | -0.03 | -24.41 | 5.22 | 0.25 | 0.30 | 0.00 | 0.00 |
| SEQID-02286 | 0.04 | 0.06 | 0.04 | 0.03 | 0.02 | 0.00 | 0.07 | 0.06 | 0.39 | -0.03 | -21.17 | 5.14 | 0.90 | 0.91 | 0.22 | 0.23 |
| SEQID-02287 | 0.02 | 0.07 | 0.04 | 0.07 | 0.06 | 0.01 | 0.03 | 0.09 | 0.44 | 0.03 | -16.53 | 9.09 | 0.25 | 0.33 | 0.25 | 0.26 |
| SEQID-02288 | 0.02 | 0.02 | 0.02 | 0.02 | 0.10 | 0.00 | 0.02 | 0.11 | 0.47 | 0.01 | -19.85 | 7.35 | 0.27 | 0.30 | 0.24 | 0.25 |
| SEQID-02289 | 0.01 | 0.04 | 0.06 | 0.02 | 0.05 | 0.00 | 0.00 | 0.09 | 0.62 | 0.00 | -14.29 | 7.39 | 0.59 | 0.65 | 0.23 | 0.25 |
| SEQID-02290 | 0.05 | 0.11 | 0.04 | 0.02 | 0.03 | 0.02 | 0.02 | 0.05 | 0.30 | -0.05 | -25.98 | 4.56 | 0.41 | 0.59 | 0.19 | 0.00 |
| SEQID-02291 | 0.01 | 0.07 | 0.01 | 0.05 | 0.07 | 0.04 | 0.06 | 0.09 | 0.90 | 0.03 | -17.65 | 9.78 | 0.18 | 0.31 | 0.33 | 0.22 |
| SEQID-02292 | 0.00 | 0.03 | 0.00 | 0.04 | 0.07 | 0.00 | 0.00 | 0.07 | 0.40 | -0.05 | -21.86 | 4.76 | 0.33 | 0.16 | 0.00 | 0.33 |
| SEQID-02293 | 0.00 | 0.06 | 0.06 | 0.11 | 0.04 | 0.02 | 0.04 | 0.09 | 0.25 | 0.05 | -19.05 | 10.11 | 0.27 | 0.23 | 0.25 | 0.24 |
| SEQID-02294 | 0.06 | 0.06 | 0.02 | 0.02 | 0.05 | 0.00 | 0.04 | 0.09 | 0.39 | -0.08 | -23.42 | 4.32 | 0.38 | 0.46 | 0.25 | 0.00 |
| SEQID-02295 | 0.04 | 0.03 | 0.03 | 0.04 | 0.07 | 0.00 | 0.05 | 0.08 | 0.33 | 0.01 | -24.69 | 8.63 | 0.00 | 0.33 | 0.00 | 0.23 |
| SEQID-02296 | 0.05 | 0.09 | 0.04 | 0.05 | 0.09 | 0.01 | 0.06 | 0.07 | 0.61 | 0.05 | -14.96 | 10.35 | 0.21 | 0.33 | 0.00 | 0.24 |
| SEQID-02297 | 0.02 | 0.05 | 0.03 | 0.03 | 0.06 | 0.01 | 0.03 | 0.06 | 0.36 | -0.01 | -22.33 | 5.96 | 0.71 | 0.89 | 0.00 | 0.21 |
| SEQID-02298 | 0.01 | 0.04 | 0.04 | 0.04 | 0.06 | 0.01 | 0.05 | 0.03 | 0.30 | 0.14 | -23.86 | 11.71 | 0.24 | 0.30 | 0.00 | 0.21 |
| SEQID-02299 | 0.03 | 0.04 | 0.04 | 0.04 | 0.04 | 0.01 | 0.01 | 0.10 | 0.57 | 0.00 | -20.10 | 6.92 | 0.21 | 0.34 | 0.21 | 0.22 |
| SEQID-02300 | 0.03 | 0.06 | 0.04 | 0.03 | 0.03 | 0.02 | 0.07 | 0.04 | 0.35 | 0.02 | -20.39 | 8.61 | 0.19 | 0.32 | 0.22 | 0.21 |
| SEQID-02301 | 0.05 | 0.09 | 0.03 | 0.03 | 0.04 | 0.06 | 0.04 | 0.03 | 0.39 | -0.02 | -20.36 | 6.09 | 0.51 | 0.63 | 0.25 | 0.25 |
| SEQID-02302 | 0.03 | 0.10 | 0.05 | 0.05 | 0.05 | 0.03 | 0.06 | 0.06 | 0.42 | 0.02 | -17.77 | 8.21 | 0.00 | 0.31 | 0.00 | 0.24 |
| SEQID-02303 | 0.01 | 0.10 | 0.08 | 0.07 | 0.04 | 0.02 | 0.02 | 0.05 | 0.27 | 0.01 | -23.34 | 7.38 | 0.25 | 0.35 | 0.23 | 0.23 |
| SEQID-02304 | 0.09 | 0.04 | 0.05 | 0.07 | 0.07 | 0.04 | 0.06 | 0.05 | 0.69 | -0.05 | -14.98 | 4.44 | 0.21 | 0.31 | 0.00 | 0.19 |
| SEQID-02305 | 0.03 | 0.03 | 0.02 | 0.06 | 0.06 | 0.31 | 0.05 | 0.04 | 0.30 | -0.05 | -25.77 | 4.48 | 0.24 | 0.33 | 0.00 | 0.23 |
| SEQID-02306 | 0.03 | 0.07 | 0.02 | 0.07 | 0.07 | 0.02 | 0.04 | 0.05 | 0.62 | 0.02 | -18.34 | 9.36 | 0.18 | 0.35 | 0.19 | 0.20 |
| SEQID-02307 | 0.02 | 0.04 | 0.06 | 0.09 | 0.05 | 0.03 | 0.03 | 0.07 | 0.57 | -0.01 | -17.22 | 6.46 | 0.00 | 0.39 | 0.16 | 0.19 |
| SEQID-02308 | 0.01 | 0.03 | 0.04 | 0.05 | 0.06 | 0.01 | 0.05 | 0.06 | 0.41 | -0.01 | -18.98 | 6.89 | 0.22 | 0.33 | 0.00 | 0.20 |
| SEQID-02309 | 0.03 | 0.05 | 0.04 | 0.09 | 0.06 | 0.03 | 0.03 | 0.05 | 0.40 | 0.00 | -18.07 | 6.18 | 0.38 | 0.61 | 0.18 | 0.21 |
| SEQID-02310 | 0.05 | 0.07 | 0.05 | 0.03 | 0.04 | 0.02 | 0.04 | 0.07 | 0.36 | -0.04 | -22.73 | 4.83 | 0.21 | 0.35 | 0.00 | 0.22 |
| SEQID-02311 | 0.02 | 0.06 | 0.04 | 0.05 | 0.04 | 0.03 | 0.03 | 0.06 | 0.57 | 0.00 | -20.55 | 6.88 | 0.21 | 0.33 | 0.00 | 0.22 |
| SEQID-02312 | 0.01 | 0.05 | 0.03 | 0.05 | 0.07 | 0.04 | 0.04 | 0.11 | 0.30 | -0.02 | -24.64 | 5.77 | 0.38 | 0.44 | 0.00 | 1.00 |
| SEQID-02313 | 0.03 | 0.06 | 0.06 | 0.06 | 0.07 | 0.03 | 0.05 | 0.05 | 0.33 | -0.01 | -23.03 | 6.04 | 0.23 | 0.30 | 0.00 | 0.20 |
| SEQID-02314 | 0.03 | 0.06 | 0.05 | 0.04 | 0.05 | 0.03 | 0.05 | 0.08 | 0.45 | -0.02 | -17.36 | 5.73 | 0.18 | 0.33 | 0.00 | 0.21 |
| SEQID-02315 | 0.01 | 0.06 | 0.06 | 0.06 | 0.06 | 0.04 | 0.09 | 0.04 | 0.45 | 0.01 | -12.07 | 7.96 | 1.00 | 1.00 | 0.22 | 0.22 |
| SEQID-02316 | 0.03 | 0.06 | 0.04 | 0.04 | 0.04 | 0.04 | 0.06 | 0.06 | 0.37 | -0.02 | -20.46 | 6.41 | 0.27 | 0.35 | 0.00 | 0.23 |
| SEQID-02317 | 0.02 | 0.07 | 0.03 | 0.05 | 0.07 | 0.04 | 0.05 | 0.09 | 0.47 | -0.01 | -19.61 | 6.03 | 0.22 | 0.32 | 0.21 | 0.22 |
| SEQID-02318 | 0.04 | 0.01 | 0.01 | 0.04 | 0.02 | 0.00 | 0.03 | 0.03 | 0.13 | 0.03 | -29.34 | 8.91 | 0.28 | 0.30 | 0.27 | 0.30 |
| SEQID-02319 | 0.02 | 0.06 | 0.04 | 0.04 | 0.04 | 0.03 | 0.05 | 0.03 | 0.38 | -0.01 | -19.82 | 6.24 | 0.20 | 0.32 | 0.00 | 0.22 |
| SEQID-02320 | 0.05 | 0.04 | 0.03 | 0.05 | 0.09 | 0.02 | 0.02 | 0.06 | 0.49 | -0.02 | -19.93 | 5.51 | 0.20 | 0.34 | 0.21 | 0.21 |
| SEQID-02321 | 0.01 | 0.08 | 0.05 | 0.03 | 0.08 | 0.02 | 0.03 | 0.07 | 0.31 | 0.00 | -19.55 | 7.25 | 0.19 | 0.34 | 0.00 | 0.29 |
| SEQID-02322 | 0.03 | 0.06 | 0.07 | 0.09 | 0.08 | 0.03 | 0.04 | 0.06 | 0.45 | 0.03 | -13.94 | 7.94 | 0.41 | 0.56 | 0.21 | 0.21 |
| SEQID-02323 | 0.02 | 0.09 | 0.06 | 0.03 | 0.05 | 0.02 | 0.02 | 0.06 | 0.30 | -0.03 | -21.81 | 5.79 | 0.23 | 0.33 | 0.21 | 0.23 |
| SEQID-02324 | 0.04 | 0.06 | 0.03 | 0.04 | 0.04 | 0.01 | 0.01 | 0.04 | 0.45 | 0.00 | -21.10 | 7.46 | 0.00 | 0.35 | 0.00 | 0.32 |
| SEQID-02325 | 0.05 | 0.07 | 0.03 | 0.06 | 0.05 | 0.02 | 0.03 | 0.09 | 0.34 | -0.05 | -19.60 | 4.53 | 0.39 | 0.56 | 0.21 | 0.00 |
| SEQID-02326 | 0.02 | 0.05 | 0.06 | 0.04 | 0.05 | 0.03 | 0.05 | 0.06 | 0.36 | -0.02 | -22.14 | 5.59 | 0.20 | 0.33 | 0.19 | 0.22 |
| SEQID-02327 | 0.01 | 0.07 | 0.07 | 0.04 | 0.09 | 0.02 | 0.05 | 0.07 | 0.56 | 0.01 | -14.97 | 8.44 | 0.24 | 0.33 | 0.00 | 0.21 |
| SEQID-02328 | 0.02 | 0.04 | 0.03 | 0.03 | 0.03 | 0.02 | 0.03 | 0.05 | 0.49 | -0.03 | -21.37 | 5.10 | 0.21 | 0.32 | 0.00 | 0.20 |
| SEQID-02329 | 0.03 | 0.06 | 0.07 | 0.07 | 0.08 | 0.03 | 0.04 | 0.06 | 0.31 | -0.01 | -16.53 | 6.12 | 0.27 | 0.35 | 0.00 | 0.29 |
| SEQID-02330 | 0.03 | 0.06 | 0.04 | 0.03 | 0.05 | 0.02 | 0.02 | 0.06 | 0.45 | -0.02 | -22.17 | 7.94 | 0.41 | 0.33 | 0.21 | 0.21 |
| SEQID-02331 | 0.01 | 0.00 | 0.00 | 0.07 | 0.00 | 0.01 | 0.08 | 0.09 | 0.15 | 0.00 | -38.09 | 4.90 | 0.74 | 0.56 | 0.00 | 0.26 |
| SEQID-02332 | 0.01 | 0.05 | 0.04 | 0.05 | 0.05 | 0.00 | 0.00 | 0.01 | 0.45 | 0.02 | -13.98 | 7.57 | 0.29 | 0.30 | 0.27 | 0.28 |
| SEQID-02333 | 0.02 | 0.09 | 0.04 | 0.02 | 0.02 | 0.02 | 0.07 | 0.07 | 0.38 | -0.03 | -24.33 | 6.21 | 0.80 | 0.83 | 0.26 | 0.28 |
| SEQID-02334 | 0.02 | 0.09 | 0.02 | 0.07 | 0.03 | 0.02 | 0.07 | 0.04 | 0.49 | 0.05 | -17.50 | 10.21 | 0.39 | 0.46 | 0.00 | 0.25 |
| SEQID-02335 | 0.04 | 0.05 | 0.05 | 0.05 | 0.04 | 0.00 | 0.04 | 0.07 | 0.43 | 0.00 | -19.22 | 6.65 | 0.21 | 0.33 | 0.20 | 0.22 |

TABLE 1-continued

| | | | | | | | | | | | | | | | |
|---|---|---|---|---|---|---|---|---|---|---|---|---|---|---|---|
| SEQID-02336 | 0.03 | 0.03 | 0.02 | 0.05 | 0.05 | 0.02 | 0.05 | 0.06 | −24.82 | 0.37 | −0.01 | 6.33 | 0.21 | 0.33 | 0.20 | 0.00 |
| SEQID-02337 | 0.01 | 0.07 | 0.05 | 0.05 | 0.07 | 0.04 | 0.07 | 0.07 | −19.39 | 0.29 | −0.01 | 5.93 | 0.19 | 0.34 | 0.00 | 0.22 |
| SEQID-02338 | 0.02 | 0.07 | 0.04 | 0.05 | 0.04 | 0.01 | 0.06 | 0.08 | −19.98 | 0.45 | −0.01 | 5.60 | 0.22 | 0.35 | 0.22 | 0.21 |
| SEQID-02339 | 0.03 | 0.06 | 0.04 | 0.05 | 0.04 | 0.03 | 0.05 | 0.06 | −21.72 | 0.36 | −0.03 | 5.69 | 0.21 | 0.33 | 0.00 | 0.21 |
| SEQID-02340 | 0.02 | 0.03 | 0.03 | 0.05 | 0.05 | 0.00 | 0.06 | 0.07 | −18.32 | 0.47 | 0.00 | 5.95 | 0.22 | 0.34 | 0.21 | 0.22 |
| SEQID-02341 | 0.02 | 0.11 | 0.04 | 0.05 | 0.04 | 0.03 | 0.06 | 0.07 | −14.51 | 0.60 | −0.01 | 6.51 | 0.21 | 0.33 | 0.20 | 0.22 |
| SEQID-02342 | 0.03 | 0.09 | 0.05 | 0.05 | 0.05 | 0.07 | 0.04 | 0.06 | −13.27 | 0.60 | 0.00 | 7.04 | 0.22 | 0.33 | 0.00 | 0.23 |
| SEQID-02343 | 0.03 | 0.14 | 0.03 | 0.04 | 0.06 | 0.06 | 0.03 | 0.06 | −12.54 | 0.77 | 0.01 | 6.51 | 0.19 | 0.32 | 0.00 | 0.22 |
| SEQID-02344 | 0.03 | 0.09 | 0.04 | 0.05 | 0.05 | 0.06 | 0.04 | 0.05 | −12.00 | 0.61 | 0.01 | 7.52 | 0.19 | 0.33 | 0.00 | 0.22 |
| SEQID-02345 | 0.02 | 0.10 | 0.05 | 0.04 | 0.05 | 0.07 | 0.05 | 0.05 | −11.60 | 0.64 | 0.00 | 7.08 | 0.19 | 0.35 | 0.00 | 0.20 |
| SEQID-02346 | 0.03 | 0.00 | 0.00 | 0.04 | 0.04 | 0.00 | 0.02 | 0.06 | −33.43 | 0.12 | −0.02 | 5.63 | 0.41 | 0.55 | 0.23 | 0.21 |
| SEQID-02347 | 0.02 | 0.03 | 0.01 | 0.04 | 0.02 | 0.01 | 0.00 | 0.02 | −39.60 | 0.07 | 0.05 | 10.23 | 0.25 | 0.35 | 0.22 | 0.22 |
| SEQID-02348 | 0.04 | 0.06 | 0.03 | 0.05 | 0.05 | 0.03 | 0.07 | 0.07 | −22.00 | 0.36 | 0.03 | 9.13 | 0.45 | 0.64 | 0.00 | 0.00 |
| SEQID-02349 | 0.04 | 0.06 | 0.04 | 0.05 | 0.04 | 0.02 | 0.04 | 0.09 | −19.04 | 0.46 | 0.01 | 8.10 | 0.72 | 0.86 | 0.00 | 0.21 |
| SEQID-02350 | 0.02 | 0.06 | 0.04 | 0.06 | 0.05 | 0.03 | 0.04 | 0.04 | −23.29 | 0.32 | 0.00 | 7.11 | 0.48 | 0.64 | 0.00 | 0.00 |
| SEQID-02351 | 0.06 | 0.09 | 0.02 | 0.03 | 0.06 | 0.01 | 0.06 | 0.04 | −18.81 | 0.53 | −0.03 | 5.29 | 0.20 | 0.29 | 0.21 | 0.00 |
| SEQID-02352 | 0.03 | 0.02 | 0.00 | 0.06 | 0.02 | 0.00 | 0.01 | 0.03 | −30.87 | 0.09 | −0.01 | 6.28 | 0.30 | 0.33 | 0.24 | 0.21 |
| SEQID-02353 | 0.02 | 0.03 | 0.05 | 0.05 | 0.07 | 0.03 | 0.04 | 0.11 | −20.20 | 0.39 | 0.00 | 7.27 | 0.21 | 0.31 | 0.22 | 0.23 |
| SEQID-02354 | 0.06 | 0.01 | 0.03 | 0.05 | 0.03 | 0.02 | 0.01 | 0.04 | −28.42 | 0.26 | 0.02 | 9.14 | 0.29 | 0.35 | 0.18 | 0.26 |
| SEQID-02355 | 0.01 | 0.13 | 0.00 | 0.05 | 0.02 | 0.02 | 0.01 | 0.05 | −23.06 | 0.63 | −0.06 | 4.34 | 1.00 | 1.00 | 0.27 | 0.26 |
| SEQID-02356 | 0.02 | 0.02 | 0.06 | 0.07 | 0.09 | 0.04 | 0.05 | 0.06 | −19.29 | 0.23 | 0.00 | 6.90 | 0.24 | 0.31 | 0.21 | 0.24 |
| SEQID-02357 | 0.03 | 0.04 | 0.04 | 0.05 | 0.05 | 0.02 | 0.04 | 0.08 | −20.45 | 0.42 | 0.03 | 9.69 | 0.22 | 0.33 | 0.20 | 0.22 |
| SEQID-02358 | 0.04 | 0.01 | 0.03 | 0.06 | 0.04 | 0.00 | 0.04 | 0.05 | −17.94 | 0.44 | −0.01 | 6.35 | 0.25 | 0.34 | 0.29 | 0.23 |
| SEQID-02359 | 0.02 | 0.06 | 0.04 | 0.09 | 0.06 | 0.04 | 0.09 | 0.06 | −16.62 | 0.42 | 0.00 | 6.49 | 0.48 | 0.62 | 0.21 | 0.21 |
| SEQID-02360 | 0.03 | 0.06 | 0.06 | 0.07 | 0.05 | 0.04 | 0.05 | 0.04 | −19.45 | 0.29 | −0.02 | 5.66 | 0.24 | 0.30 | 0.35 | 0.24 |
| SEQID-02361 | 0.04 | 0.03 | 0.03 | 0.10 | 0.03 | 0.01 | 0.05 | 0.08 | −15.55 | 0.61 | −0.01 | 5.20 | 0.24 | 0.32 | 0.24 | 0.24 |
| SEQID-02362 | 0.01 | 0.03 | 0.03 | 0.06 | 0.03 | 0.04 | 0.09 | 0.03 | −18.99 | 0.37 | −0.02 | 5.25 | 0.24 | 0.32 | 0.24 | 0.00 |
| SEQID-02363 | 0.04 | 0.03 | 0.03 | 0.06 | 0.02 | 0.03 | 0.08 | 0.09 | −17.98 | 0.53 | 0.02 | 4.90 | 0.22 | 0.32 | 0.26 | 0.26 |
| SEQID-02364 | 0.04 | 0.05 | 0.03 | 0.04 | 0.04 | 0.00 | 0.04 | 0.06 | −16.78 | 0.40 | −0.06 | 5.63 | 0.20 | 0.33 | 0.00 | 0.26 |
| SEQID-02365 | 0.03 | 0.03 | 0.03 | 0.09 | 0.03 | 0.01 | 0.06 | 0.03 | −18.19 | 0.33 | 0.00 | 5.16 | 0.22 | 0.30 | 0.23 | 0.22 |
| SEQID-02366 | 0.04 | 0.09 | 0.04 | 0.07 | 0.04 | 0.05 | 0.10 | 0.07 | −14.55 | 0.75 | −0.01 | 5.25 | 0.00 | 0.31 | 0.00 | 0.24 |
| SEQID-02367 | 0.03 | 0.09 | 0.04 | 0.06 | 0.06 | 0.05 | 0.05 | 0.04 | −11.27 | 0.63 | −0.02 | 7.04 | 0.22 | 0.35 | 0.00 | 0.22 |
| SEQID-02368 | 0.05 | 0.09 | 0.04 | 0.04 | 0.04 | 0.02 | 0.10 | 0.05 | −11.91 | 0.65 | 0.01 | 7.57 | 0.20 | 0.31 | 0.00 | 0.20 |
| SEQID-02369 | 0.01 | 0.01 | 0.05 | 0.06 | 0.06 | 0.03 | 0.03 | 0.05 | −10.93 | 0.25 | −0.02 | 6.21 | 1.00 | 1.00 | 0.23 | 0.21 |
| SEQID-02370 | 0.01 | 0.12 | 0.06 | 0.09 | 0.08 | 0.02 | 0.04 | 0.05 | −19.00 | 0.41 | 0.02 | 7.95 | 1.00 | 1.00 | 0.21 | 0.26 |
| SEQID-02371 | 0.02 | 0.06 | 0.03 | 0.04 | 0.06 | 0.04 | 0.09 | 0.06 | −13.69 | 0.41 | −0.03 | 4.66 | 1.00 | 1.00 | 0.22 | 0.58 |
| SEQID-02372 | 0.02 | 0.05 | 0.07 | 0.06 | 0.07 | 0.04 | 0.04 | 0.07 | −17.33 | 0.36 | 0.03 | 9.85 | 1.00 | 1.00 | 0.00 | 0.32 |
| SEQID-02373 | 0.04 | 0.09 | 0.04 | 0.03 | 0.03 | 0.00 | 0.03 | 0.05 | −15.63 | 0.68 | −0.06 | 4.41 | 1.00 | 1.00 | 0.00 | 1.00 |
| SEQID-02374 | 0.03 | 0.00 | 0.00 | 0.05 | 0.01 | 0.01 | 0.07 | 0.03 | −23.85 | 0.48 | −0.09 | 7.28 | 1.00 | 1.00 | 0.25 | 0.23 |
| SEQID-02375 | 0.03 | 0.05 | 0.06 | 0.03 | 0.06 | 0.00 | 0.09 | 0.09 | −15.49 | 0.50 | 0.01 | 8.01 | 0.71 | 1.00 | 0.54 | 0.20 |
| SEQID-02376 | 0.01 | 0.04 | 0.03 | 0.05 | 0.07 | 0.03 | 0.08 | 0.06 | −17.98 | 0.34 | 0.00 | 8.40 | 0.21 | 0.30 | 0.20 | 0.34 |
| SEQID-02377 | 0.01 | 0.04 | 0.02 | 0.07 | 0.05 | 0.02 | 0.06 | 0.08 | −17.15 | 0.45 | 0.01 | 7.06 | 0.52 | 0.73 | 0.30 | 0.21 |
| SEQID-02378 | 0.03 | 0.05 | 0.04 | 0.06 | 0.04 | 0.01 | 0.03 | 0.05 | −19.83 | 0.38 | 0.00 | 7.34 | 0.52 | 0.73 | 0.21 | 0.22 |
| SEQID-02379 | 0.03 | 0.05 | 0.06 | 0.06 | 0.03 | 0.01 | 0.03 | 0.04 | −19.64 | 0.38 | 0.00 | 4.44 | 0.26 | 0.38 | 0.00 | 0.22 |
| SEQID-02380 | 0.06 | 0.05 | 0.05 | 0.03 | 0.05 | 0.00 | 0.04 | 0.07 | −22.04 | 0.36 | −0.05 | 4.36 | 0.38 | 0.54 | 0.22 | 0.24 |
| SEQID-02381 | 0.04 | 0.09 | 0.07 | 0.04 | 0.03 | 0.00 | 0.04 | 0.05 | −24.42 | 0.37 | −0.06 | 4.39 | 0.59 | 0.70 | 0.25 | 0.19 |
| SEQID-02382 | 0.03 | 0.00 | 0.04 | 0.04 | 0.00 | 0.01 | 0.02 | 0.03 | −36.74 | 0.12 | −0.09 | 4.41 | 0.00 | 0.32 | 0.00 | 0.21 |
| SEQID-02383 | 0.03 | 0.05 | 0.00 | 0.05 | 0.06 | 0.03 | 0.07 | 0.09 | −18.72 | 0.43 | 0.01 | 7.75 | 0.28 | 0.31 | 0.54 | 0.18 |
| SEQID-02384 | 0.02 | 0.09 | 0.06 | 0.04 | 0.02 | 0.02 | 0.09 | 0.06 | −18.31 | 0.58 | 0.00 | 7.24 | 0.19 | 0.30 | 0.20 | 0.25 |
| SEQID-02385 | 0.03 | 0.05 | 0.02 | 0.05 | 0.04 | 0.02 | 0.04 | 0.12 | −26.24 | 0.28 | −0.01 | 6.55 | 0.20 | 0.55 | 0.21 | 0.17 |
| SEQID-02386 | 0.03 | 0.05 | 0.01 | 0.04 | 0.05 | 0.01 | 0.04 | 0.04 | −26.69 | 0.24 | 0.01 | 8.53 | 0.19 | 0.55 | 0.19 | 0.17 |
| SEQID-02387 | 0.04 | 0.09 | 0.03 | 0.04 | 0.05 | 0.00 | 0.06 | 0.05 | −21.50 | 0.39 | 0.01 | 8.45 | 0.20 | 0.34 | 0.18 | 0.25 |
| SEQID-02388 | 0.02 | 0.01 | 0.00 | 0.04 | 0.05 | 0.00 | 0.01 | 0.04 | −32.95 | 0.10 | −0.04 | 5.11 | 0.19 | 0.55 | 0.00 | 0.20 |
| SEQID-02388 | 0.03 | 0.03 | 0.01 | 0.04 | 0.04 | 0.01 | 0.03 | 0.03 | −27.94 | 0.21 | −0.02 | 5.55 | 0.19 | 0.53 | 0.18 | 0.18 |

TABLE 1-continued

| | | | | | | | | | | | | | | |
|---|---|---|---|---|---|---|---|---|---|---|---|---|---|---|
| SEQID-02389 | 0.05 | 0.04 | 0.04 | 0.05 | 0.06 | 0.06 | 0.02 | 0.06 | 0.05 | -19.68 | 0.41 | -0.03 | 5.05 | 0.19 | 0.31 | 0.00 | 0.20 |
| SEQID-02390 | 0.03 | 0.04 | 0.01 | 0.04 | 0.04 | 0.04 | 0.01 | 0.03 | 0.03 | -28.44 | 0.23 | -0.02 | 5.55 | 0.19 | 0.51 | 0.18 | 0.19 |
| SEQID-02391 | 0.03 | 0.04 | 0.01 | 0.04 | 0.03 | 0.03 | 0.01 | 0.03 | 0.04 | -28.04 | 0.22 | -0.02 | 5.44 | 0.18 | 0.54 | 0.18 | 0.19 |
| SEQID-02392 | 0.03 | 0.10 | 0.02 | 0.06 | 0.04 | 0.03 | 0.01 | 0.04 | 0.03 | -28.31 | 0.24 | -0.02 | 5.66 | 0.18 | 0.50 | 0.17 | 0.17 |
| SEQID-02393 | 0.03 | 0.05 | 0.00 | 0.05 | 0.04 | 0.05 | 0.01 | 0.04 | 0.05 | -19.60 | 0.46 | 0.04 | 9.84 | 0.21 | 0.32 | 0.00 | 0.20 |
| SEQID-02394 | 0.04 | 0.05 | 0.07 | 0.05 | 0.06 | 0.04 | 0.04 | 0.10 | 0.10 | -17.92 | 0.49 | 0.02 | 8.82 | 0.70 | 0.86 | 0.00 | 0.20 |
| SEQID-02395 | 0.02 | 0.01 | 0.00 | 0.04 | 0.02 | 0.02 | 0.00 | 0.01 | 0.04 | -32.33 | 0.12 | -0.02 | 5.54 | 0.38 | 0.54 | 0.21 | 0.19 |
| SEQID-02396 | 0.05 | 0.04 | 0.03 | 0.04 | 0.04 | 0.04 | 0.01 | 0.04 | 0.09 | -21.27 | 0.45 | 0.01 | 7.68 | 0.21 | 0.33 | 0.00 | 0.22 |
| SEQID-02397 | 0.04 | 0.04 | 0.03 | 0.04 | 0.04 | 0.04 | 0.03 | 0.06 | 0.03 | -24.38 | 0.28 | -0.03 | 5.17 | 0.20 | 0.36 | 0.17 | 0.19 |
| SEQID-02398 | 0.01 | 0.04 | 0.06 | 0.04 | 0.06 | 0.02 | 0.02 | 0.04 | 0.07 | -26.13 | 0.30 | -0.02 | 5.29 | 0.21 | 0.41 | 0.00 | 0.18 |
| SEQID-02399 | 0.03 | 0.03 | 0.03 | 0.06 | 0.03 | 0.03 | 0.03 | 0.06 | 0.10 | -19.78 | 0.56 | 0.02 | 8.27 | 0.23 | 0.32 | 0.21 | 0.19 |
| SEQID-02400 | 0.02 | 0.04 | 0.04 | 0.06 | 0.06 | 0.03 | 0.02 | 0.03 | 0.09 | -22.74 | 0.31 | -0.01 | 6.33 | 0.00 | 0.34 | 0.17 | 0.19 |
| SEQID-02401 | 0.05 | 0.05 | 0.04 | 0.05 | 0.05 | 0.06 | 0.02 | 0.05 | 0.05 | -19.47 | 0.43 | -0.03 | 5.16 | 0.21 | 0.31 | 0.00 | 0.22 |
| SEQID-02402 | 0.01 | 0.04 | 0.07 | 0.06 | 0.07 | 0.04 | 0.01 | 0.04 | 0.09 | -22.43 | 0.31 | -0.01 | 5.31 | 0.00 | 0.40 | 0.00 | 0.18 |
| SEQID-02403 | 0.02 | 0.02 | 0.03 | 0.05 | 0.05 | 0.09 | 0.02 | 0.09 | 0.06 | -24.64 | 0.20 | 0.03 | 9.41 | 0.00 | 0.34 | 0.17 | 0.18 |
| SEQID-02404 | 0.01 | 0.05 | 0.04 | 0.06 | 0.05 | 0.06 | 0.03 | 0.05 | 0.07 | -22.26 | 0.33 | -0.01 | 6.27 | 0.18 | 0.34 | 0.19 | 0.19 |
| SEQID-02405 | 0.09 | 0.02 | 0.04 | 0.06 | 0.06 | 0.07 | 0.03 | 0.07 | 0.03 | -18.28 | 0.36 | 0.01 | 8.20 | 0.25 | 0.28 | 0.00 | 0.00 |
| SEQID-02406 | 0.04 | 0.06 | 0.03 | 0.04 | 0.06 | 0.04 | 0.02 | 0.04 | 0.09 | -20.16 | 0.47 | 0.01 | 7.53 | 0.23 | 0.35 | 0.00 | 0.31 |
| SEQID-02407 | 0.03 | 0.01 | 0.03 | 0.05 | 0.05 | 0.04 | 0.03 | 0.05 | 0.05 | -24.99 | 0.22 | 0.02 | 8.88 | 0.20 | 0.32 | 0.18 | 0.19 |
| SEQID-02408 | 0.04 | 0.03 | 0.04 | 0.05 | 0.04 | 0.03 | 0.03 | 0.04 | 0.04 | -24.99 | 0.20 | 0.03 | 9.54 | 0.19 | 0.33 | 0.00 | 0.18 |
| SEQID-02409 | 0.03 | 0.04 | 0.03 | 0.04 | 0.06 | 0.07 | 0.02 | 0.07 | 0.06 | -19.75 | 0.46 | 0.02 | 8.25 | 0.21 | 0.32 | 0.00 | 0.21 |
| SEQID-02410 | 0.02 | 0.07 | 0.04 | 0.04 | 0.07 | 0.05 | 0.01 | 0.05 | 0.05 | -19.79 | 0.43 | 0.02 | 8.78 | 0.20 | 0.36 | 0.00 | 0.21 |
| SEQID-02411 | 0.02 | 0.00 | 0.00 | 0.06 | 0.05 | 0.03 | 0.00 | 0.03 | 0.03 | -36.78 | 0.12 | -0.09 | 4.39 | 0.59 | 0.70 | 0.26 | 0.22 |
| SEQID-02412 | 0.04 | 0.05 | 0.03 | 0.03 | 0.05 | 0.04 | 0.03 | 0.04 | 0.05 | -23.93 | 0.35 | -0.01 | 6.37 | 0.88 | 1.00 | 0.18 | 0.22 |
| SEQID-02413 | 0.02 | 0.04 | 0.04 | 0.04 | 0.06 | 0.03 | 0.03 | 0.06 | 0.09 | -22.25 | 0.35 | -0.01 | 6.34 | 0.18 | 0.32 | 0.19 | 0.20 |
| SEQID-02414 | 0.03 | 0.06 | 0.04 | 0.04 | 0.06 | 0.06 | 0.04 | 0.04 | 0.06 | -17.89 | 0.44 | 0.01 | 8.09 | 0.20 | 0.32 | 0.20 | 0.21 |
| SEQID-02415 | 0.03 | 0.05 | 0.05 | 0.04 | 0.04 | 0.02 | 0.04 | 0.05 | 0.05 | -22.74 | 0.33 | 0.02 | 9.12 | 0.21 | 0.30 | 0.21 | 0.20 |
| SEQID-02416 | 0.01 | 0.02 | 0.01 | 0.02 | 0.03 | 0.01 | 0.01 | 0.02 | 0.02 | -37.68 | 0.11 | 0.09 | 10.58 | 0.26 | 0.36 | 0.24 | 0.00 |
| SEQID-02417 | 0.01 | 0.03 | 0.04 | 0.03 | 0.02 | 0.02 | 0.03 | 0.05 | 0.09 | -37.55 | 0.11 | 0.09 | 10.51 | 0.26 | 0.36 | 0.20 | 0.23 |
| SEQID-02418 | 0.02 | 0.03 | 0.07 | 0.04 | 0.07 | 0.03 | 0.03 | 0.04 | 0.07 | -23.17 | 0.28 | 0.00 | 6.53 | 0.20 | 0.34 | 0.19 | 0.22 |
| SEQID-02419 | 0.01 | 0.04 | 0.02 | 0.05 | 0.04 | 0.03 | 0.03 | 0.05 | 0.09 | -19.87 | 0.48 | -0.01 | 6.39 | 0.70 | 0.80 | 0.26 | 0.22 |
| SEQID-02420 | 0.03 | 0.08 | 0.03 | 0.03 | 0.03 | 0.02 | 0.02 | 0.03 | 0.05 | -31.95 | 0.40 | -0.19 | 3.81 | 0.21 | 0.33 | 0.00 | 0.23 |
| SEQID-02421 | 0.02 | 0.05 | 0.03 | 0.04 | 0.04 | 0.03 | 0.01 | 0.04 | 0.07 | -21.29 | 0.41 | 0.00 | 6.39 | 0.85 | 0.96 | 0.00 | 0.22 |
| SEQID-02422 | 0.04 | 0.06 | 0.04 | 0.06 | 0.06 | 0.02 | 0.02 | 0.06 | 0.06 | -21.28 | 0.35 | -0.02 | 5.14 | 0.19 | 0.34 | 0.00 | 0.20 |
| SEQID-02423 | 0.02 | 0.05 | 0.05 | 0.06 | 0.05 | 0.04 | 0.04 | 0.05 | 0.03 | -18.90 | 0.66 | -0.02 | 5.14 | 0.19 | 0.33 | 0.00 | 0.20 |
| SEQID-02424 | 0.03 | 0.05 | 0.04 | 0.04 | 0.04 | 0.06 | 0.03 | 0.04 | 0.05 | -19.61 | 0.37 | 0.00 | 7.02 | 0.17 | 0.34 | 0.00 | 0.00 |
| SEQID-02425 | 0.02 | 0.04 | 0.07 | 0.06 | 0.06 | 0.03 | 0.02 | 0.06 | 0.06 | -21.89 | 0.25 | 0.02 | 8.05 | 0.22 | 0.31 | 0.19 | 0.21 |
| SEQID-02426 | 0.02 | 0.04 | 0.05 | 0.05 | 0.05 | 0.04 | 0.02 | 0.05 | 0.07 | -23.80 | 0.29 | -0.02 | 5.46 | 0.00 | 0.32 | 0.00 | 0.19 |
| SEQID-02427 | 0.02 | 0.06 | 0.03 | 0.05 | 0.05 | 0.04 | 0.01 | 0.05 | 0.03 | -21.68 | 0.43 | -0.05 | 6.55 | 0.19 | 0.52 | 0.21 | 0.97 |
| SEQID-02428 | 0.03 | 0.07 | 0.05 | 0.05 | 0.04 | 0.05 | 0.02 | 0.04 | 0.07 | -18.62 | 0.30 | 0.00 | 7.98 | 0.00 | 0.31 | 0.17 | 0.20 |
| SEQID-02429 | 0.02 | 0.03 | 0.07 | 0.05 | 0.05 | 0.05 | 0.07 | 0.07 | 0.05 | -21.75 | 0.30 | 0.01 | 6.62 | 0.19 | 0.33 | 0.00 | 0.00 |
| SEQID-02430 | 0.03 | 0.06 | 0.03 | 0.05 | 0.04 | 0.06 | 0.05 | 0.06 | 0.07 | -18.78 | 0.43 | 0.00 | 8.74 | 0.19 | 0.69 | 0.00 | 0.23 |
| SEQID-02431 | 0.02 | 0.05 | 0.06 | 0.07 | 0.05 | 0.02 | 0.00 | 0.05 | 0.07 | -16.81 | 0.55 | 0.02 | 4.42 | 0.51 | 0.40 | 0.00 | 0.00 |
| SEQID-02432 | 0.04 | 0.05 | 0.04 | 0.05 | 0.04 | 0.04 | 0.01 | 0.05 | 0.04 | -24.73 | 0.28 | -0.07 | 5.73 | 0.20 | 0.32 | 0.00 | 0.22 |
| SEQID-02433 | 0.01 | 0.04 | 0.05 | 0.05 | 0.06 | 0.03 | 0.03 | 0.05 | 0.03 | -18.45 | 0.60 | -0.01 | 8.58 | 0.19 | 0.35 | 0.19 | 0.20 |
| SEQID-02434 | 0.03 | 0.04 | 0.04 | 0.05 | 0.06 | 0.04 | 0.02 | 0.06 | 0.07 | -22.41 | 0.32 | 0.01 | 9.43 | 0.22 | 0.34 | 0.00 | 0.21 |
| SEQID-02435 | 0.03 | 0.05 | 0.03 | 0.04 | 0.05 | 0.05 | 0.01 | 0.05 | 0.03 | -21.07 | 0.40 | 0.03 | 4.55 | 0.82 | 0.96 | 0.21 | 0.22 |
| SEQID-02436 | 0.04 | 0.05 | 0.04 | 0.05 | 0.04 | 0.04 | 0.02 | 0.04 | 0.07 | -21.68 | 0.43 | -0.05 | 6.73 | 0.21 | 0.32 | 0.00 | 0.22 |
| SEQID-02437 | 0.02 | 0.07 | 0.04 | 0.04 | 0.03 | 0.04 | 0.05 | 0.04 | 0.08 | -22.82 | 0.38 | 0.00 | 8.71 | 0.23 | 0.31 | 0.00 | 0.21 |
| SEQID-02438 | 0.04 | 0.02 | 0.07 | 0.03 | 0.07 | 0.02 | 0.00 | 0.02 | 0.03 | -17.52 | 0.62 | 0.03 | 10.17 | 0.26 | 0.31 | 0.26 | 0.00 |
| SEQID-02439 | 0.01 | 0.07 | 0.03 | 0.04 | 0.05 | 0.07 | 0.01 | 0.04 | 0.05 | -32.14 | 0.15 | 0.06 | 8.37 | 0.21 | 0.32 | 0.23 | 0.23 |
| SEQID-02440 | 0.03 | 0.05 | 0.03 | 0.04 | 0.07 | 0.04 | 0.03 | 0.07 | 0.06 | -21.60 | 0.24 | 0.06 | 5.71 | 0.72 | 0.89 | 0.19 | 0.21 |
| SEQID-02441 | 0.03 | 0.04 | 0.05 | 0.10 | 0.07 | 0.04 | 0.01 | 0.04 | 0.06 | -23.33 | 0.22 | 0.01 | 8.53 | 0.19 | 0.40 | 0.19 | 0.19 |

TABLE 1-continued

| | | | | | | | | | | | | | | | |
|---|---|---|---|---|---|---|---|---|---|---|---|---|---|---|---|
| SEQID-02442 | 0.00 | 0.07 | 0.02 | 0.08 | 0.09 | 0.02 | 0.06 | 0.05 | -17.94 | 0.30 | 0.01 | 8.88 | 0.20 | 0.32 | 0.00 | 0.00 |
| SEQID-02443 | 0.04 | 0.05 | 0.09 | 0.07 | 0.05 | 0.01 | 0.06 | 0.03 | -20.79 | 0.13 | 0.04 | 9.80 | 0.18 | 0.34 | 0.00 | 0.23 |
| SEQID-02444 | 0.04 | 0.05 | 0.04 | 0.06 | 0.04 | 0.03 | 0.05 | 0.05 | -19.86 | 0.39 | 0.03 | 9.43 | 0.22 | 0.31 | 0.20 | 0.21 |
| SEQID-02445 | 0.01 | 0.03 | 0.10 | 0.05 | 0.07 | 0.02 | 0.03 | 0.06 | -21.39 | 0.27 | 0.00 | 6.99 | 0.20 | 0.43 | 0.21 | 0.22 |
| SEQID-02446 | 0.02 | 0.05 | 0.03 | 0.05 | 0.07 | 0.01 | 0.03 | 0.06 | -22.59 | 0.34 | -0.02 | 5.16 | 0.74 | 0.93 | 0.00 | 0.22 |
| SEQID-02447 | 0.04 | 0.07 | 0.05 | 0.03 | 0.06 | 0.00 | 0.02 | 0.07 | -17.51 | 0.50 | 0.01 | 7.98 | 0.23 | 0.31 | 0.00 | 0.00 |
| SEQID-02448 | 0.05 | 0.06 | 0.07 | 0.02 | 0.04 | 0.00 | 0.03 | 0.05 | -23.59 | 0.32 | -0.04 | 4.68 | 0.31 | 0.48 | 0.00 | 0.22 |
| SEQID-02449 | 0.02 | 0.05 | 0.03 | 0.05 | 0.06 | 0.00 | 0.02 | 0.06 | -18.88 | 0.43 | 0.02 | 9.26 | 0.19 | 0.31 | 0.00 | 0.20 |
| SEQID-02450 | 0.02 | 0.04 | 0.04 | 0.04 | 0.05 | 0.02 | 0.04 | 0.05 | -22.04 | 0.23 | 0.01 | 8.21 | 0.37 | 0.54 | 0.20 | 0.22 |
| SEQID-02451 | 0.03 | 0.03 | 0.05 | 0.03 | 0.96 | 0.00 | 0.04 | 0.03 | -19.05 | 0.43 | -0.04 | 4.75 | 0.22 | 0.33 | 0.00 | 0.20 |
| SEQID-02452 | 0.02 | 0.02 | 0.02 | 0.06 | 0.09 | 0.01 | 0.03 | 0.10 | -21.92 | 0.31 | 0.01 | 9.07 | 0.19 | 0.34 | 0.19 | 0.19 |
| SEQID-02453 | 0.02 | 0.06 | 0.07 | 0.05 | 0.03 | 0.05 | 0.02 | 0.09 | -16.92 | 0.54 | 0.04 | 9.64 | 0.23 | 0.33 | 0.20 | 0.21 |
| SEQID-02454 | 0.03 | 0.09 | 0.02 | 0.04 | 0.03 | 0.03 | 0.07 | 0.07 | -17.65 | 0.55 | 0.07 | 10.22 | 0.23 | 0.31 | 0.00 | 0.00 |
| SEQID-02455 | 0.05 | 0.07 | 0.05 | 0.05 | 0.07 | 0.01 | 0.05 | 0.06 | -18.76 | 0.33 | -0.04 | 4.68 | 0.39 | 0.53 | 0.19 | 0.21 |
| SEQID-02456 | 0.03 | 0.04 | 0.02 | 0.05 | 0.06 | 0.02 | 0.04 | 0.07 | -18.79 | 0.48 | 0.01 | 7.64 | 0.19 | 0.33 | 0.00 | 0.22 |
| SEQID-02457 | 0.04 | 0.05 | 0.05 | 0.04 | 0.05 | 0.01 | 0.04 | 0.07 | -21.29 | 0.44 | 0.00 | 6.93 | 0.20 | 0.33 | 0.19 | 0.20 |
| SEQID-02458 | 0.02 | 0.06 | 0.04 | 0.05 | 0.03 | 0.03 | 0.05 | 0.06 | -20.31 | 0.48 | 0.00 | 7.09 | 0.18 | 0.32 | 0.20 | 0.19 |
| SEQID-02459 | 0.03 | 0.06 | 0.03 | 0.06 | 0.04 | 0.02 | 0.05 | 0.05 | -21.32 | 0.46 | -0.02 | 5.69 | 0.19 | 0.33 | 0.00 | 0.19 |
| SEQID-02460 | 0.01 | 0.04 | 0.03 | 0.06 | 0.07 | 0.02 | 0.07 | 0.07 | -23.81 | 0.32 | -0.01 | 6.06 | 0.00 | 0.36 | 0.00 | 0.00 |
| SEQID-02461 | 0.03 | 0.03 | 0.04 | 0.06 | 0.05 | 0.05 | 0.05 | 0.09 | -19.82 | 0.44 | 0.00 | 7.49 | 0.21 | 0.33 | 0.00 | 0.23 |
| SEQID-02462 | 0.04 | 0.06 | 0.04 | 0.04 | 0.04 | 0.02 | 0.03 | 0.06 | -22.56 | 0.35 | -0.01 | 6.40 | 0.42 | 0.65 | 0.19 | 0.19 |
| SEQID-02463 | 0.02 | 0.06 | 0.04 | 0.04 | 0.06 | 0.01 | 0.06 | 0.07 | -19.71 | 0.37 | -0.05 | 4.70 | 0.93 | 1.00 | 0.00 | 0.33 |
| SEQID-02464 | 0.03 | 0.04 | 0.04 | 0.05 | 0.04 | 0.02 | 0.05 | 0.05 | -24.76 | 0.39 | -0.01 | 5.89 | 0.22 | 0.33 | 0.20 | 0.20 |
| SEQID-02465 | 0.04 | 0.06 | 0.01 | 0.04 | 0.05 | 0.05 | 0.03 | 0.05 | -21.99 | 0.39 | -0.03 | 4.94 | 0.20 | 0.33 | 0.00 | 0.72 |
| SEQID-02466 | 0.03 | 0.06 | 0.05 | 0.05 | 0.06 | 0.01 | 0.04 | 0.07 | -20.05 | 0.45 | 0.00 | 7.09 | 0.18 | 0.99 | 0.00 | 0.20 |
| SEQID-02467 | 0.03 | 0.06 | 0.04 | 0.03 | 0.05 | 0.02 | 0.05 | 0.06 | -19.09 | 0.43 | -0.01 | 6.58 | 0.19 | 0.33 | 0.19 | 0.20 |
| SEQID-02468 | 0.03 | 0.04 | 0.04 | 0.04 | 0.05 | 0.02 | 0.10 | 0.05 | -24.58 | 0.43 | -0.01 | 5.16 | 0.26 | 0.29 | 0.00 | 0.00 |
| SEQID-02469 | 0.02 | 0.06 | 0.05 | 0.06 | 0.09 | 0.05 | 0.04 | 0.05 | -20.66 | 0.25 | 0.00 | 6.69 | 0.22 | 0.31 | 0.00 | 0.22 |
| SEQID-02470 | 0.02 | 0.03 | 0.04 | 0.05 | 0.03 | 0.04 | 0.06 | 0.05 | -22.96 | 0.32 | -0.01 | 6.64 | 0.21 | 0.33 | 0.00 | 0.20 |
| SEQID-02471 | 0.03 | 0.02 | 0.03 | 0.07 | 0.04 | 0.02 | 0.05 | 0.06 | -23.64 | 0.29 | -0.01 | 5.78 | 0.19 | 0.33 | 0.00 | 0.00 |
| SEQID-02472 | 0.03 | 0.04 | 0.04 | 0.05 | 0.04 | 0.02 | 0.03 | 0.09 | -20.58 | 0.56 | 0.00 | 7.45 | 0.25 | 0.33 | 0.00 | 0.00 |
| SEQID-02473 | 0.04 | 0.07 | 0.03 | 0.05 | 0.06 | 0.05 | 0.04 | 0.05 | -18.23 | 0.38 | 0.02 | 8.89 | 0.19 | 0.32 | 0.00 | 0.00 |
| SEQID-02474 | 0.03 | 0.03 | 0.02 | 0.06 | 0.04 | 0.00 | 0.07 | 0.04 | -25.38 | 0.35 | 0.00 | 7.40 | 0.21 | 0.33 | 0.00 | 0.22 |
| SEQID-02475 | 0.02 | 0.06 | 0.04 | 0.03 | 0.05 | 0.03 | 0.05 | 0.07 | -20.38 | 0.41 | 0.01 | 8.20 | 0.21 | 0.32 | 0.00 | 0.20 |
| SEQID-02476 | 0.04 | 0.05 | 0.03 | 0.05 | 0.04 | 0.03 | 0.05 | 0.06 | -21.76 | 0.49 | -0.01 | 5.82 | 0.21 | 0.33 | 0.21 | 0.20 |
| SEQID-02477 | 0.02 | 0.04 | 0.08 | 0.04 | 0.04 | 0.02 | 0.04 | 0.04 | -20.44 | 0.24 | 0.01 | 8.55 | 0.20 | 0.36 | 0.00 | 0.21 |
| SEQID-02478 | 0.02 | 0.09 | 0.04 | 0.05 | 0.05 | 0.01 | 0.08 | 0.07 | -17.07 | 0.48 | 0.01 | 8.48 | 0.20 | 0.35 | 0.20 | 0.21 |
| SEQID-02479 | 0.02 | 0.05 | 0.07 | 0.07 | 0.05 | 0.02 | 0.05 | 0.06 | -21.00 | 0.33 | -0.02 | 5.10 | 0.18 | 0.33 | 0.20 | 0.21 |
| SEQID-02480 | 0.03 | 0.04 | 0.02 | 0.04 | 0.04 | 0.01 | 0.05 | 0.06 | -28.79 | 0.30 | -0.05 | 4.73 | 0.65 | 0.36 | 0.00 | 0.21 |
| SEQID-02481 | 0.03 | 0.02 | 0.03 | 0.04 | 0.05 | 0.00 | 0.06 | 0.05 | -23.72 | 0.21 | 0.14 | 10.93 | 0.26 | 0.30 | 0.00 | 0.00 |
| SEQID-02482 | 0.05 | 0.07 | 0.02 | 0.09 | 0.07 | 0.00 | 0.06 | 0.06 | -24.45 | 0.38 | -0.05 | 4.74 | 0.42 | 0.52 | 0.00 | 0.22 |
| SEQID-02483 | 0.02 | 0.02 | 0.03 | 0.02 | 0.04 | 0.01 | 0.08 | 0.05 | -24.51 | 0.30 | -0.06 | 4.50 | 0.25 | 0.32 | 0.22 | 0.00 |
| SEQID-02484 | 0.03 | 0.07 | 0.04 | 0.06 | 0.04 | 0.03 | 0.05 | 0.04 | -25.47 | 0.32 | -0.03 | 4.91 | 0.22 | 0.32 | 0.00 | 0.23 |
| SEQID-02485 | 0.02 | 0.05 | 0.04 | 0.04 | 0.05 | 0.03 | 0.05 | 0.04 | -19.78 | 0.44 | 0.00 | 6.90 | 0.20 | 0.30 | 0.00 | 0.00 |
| SEQID-02486 | 0.04 | 0.09 | 0.08 | 0.05 | 0.04 | 0.03 | 0.08 | 0.07 | -15.73 | 0.57 | 0.04 | 9.53 | 0.21 | 0.33 | 0.00 | 0.00 |
| SEQID-02487 | 0.03 | 0.05 | 0.05 | 0.04 | 0.04 | 0.01 | 0.05 | 0.06 | -19.73 | 0.11 | 0.00 | 7.19 | 0.21 | 0.33 | 0.00 | 0.19 |
| SEQID-02488 | 0.02 | 0.05 | 0.05 | 0.04 | 0.05 | 0.02 | 0.05 | 0.06 | -20.63 | 0.35 | -0.01 | 6.50 | 0.21 | 0.32 | 0.00 | 0.20 |
| SEQID-02489 | 0.03 | 0.07 | 0.02 | 0.04 | 0.07 | 0.03 | 0.06 | 0.05 | -24.46 | 0.45 | 0.00 | 6.80 | 0.21 | 0.36 | 0.20 | 0.20 |
| SEQID-02490 | 0.03 | 0.07 | 0.03 | 0.03 | 0.09 | 0.02 | 0.04 | 0.04 | -21.89 | 0.31 | 0.00 | 7.33 | 0.22 | 0.30 | 0.00 | 0.21 |
| SEQID-02491 | 0.03 | 0.05 | 0.04 | 0.04 | 0.05 | 0.03 | 0.04 | 0.09 | -18.41 | 0.48 | 0.03 | 9.56 | 0.19 | 0.35 | 0.21 | 0.21 |
| SEQID-02492 | 0.02 | 0.04 | 0.07 | 0.05 | 0.04 | 0.00 | 0.04 | 0.05 | -20.66 | 0.34 | -0.01 | 5.44 | 0.26 | 0.55 | 0.00 | 0.30 |
| SEQID-02493 | 0.03 | 0.05 | 0.03 | 0.06 | 0.04 | 0.02 | 0.05 | 0.05 | -21.97 | 0.38 | -0.02 | 5.70 | 0.19 | 0.34 | 0.20 | 0.20 |
| SEQID-02494 | 0.01 | 0.06 | 0.04 | 0.06 | 0.04 | 0.01 | 0.06 | 0.07 | -17.07 | 0.38 | 0.02 | 9.01 | 0.47 | 0.64 | 0.21 | 0.21 |

TABLE 1-continued

| | | | | | | | | | | | | | | |
|---|---|---|---|---|---|---|---|---|---|---|---|---|---|---|
| SEQID-02495 | 0.01 | 0.06 | 0.04 | 0.06 | 0.04 | 0.01 | 0.06 | 0.07 | −16.80 | 0.38 | 0.02 | 8.77 | 0.46 | 0.63 | 0.20 | 0.21 |
| SEQID-02496 | 0.01 | 0.07 | 0.04 | 0.06 | 0.03 | 0.01 | 0.05 | 0.06 | −16.41 | 0.40 | 0.03 | 9.41 | 0.45 | 0.61 | 0.21 | 0.21 |
| SEQID-02497 | 0.01 | 0.09 | 0.04 | 0.07 | 0.03 | 0.01 | 0.06 | 0.06 | −16.25 | 0.37 | 0.02 | 9.18 | 0.45 | 0.62 | 0.00 | 0.21 |
| SEQID-02498 | 0.02 | 0.07 | 0.04 | 0.04 | 0.03 | 0.01 | 0.05 | 0.06 | −16.80 | 0.40 | 0.02 | 8.96 | 0.45 | 0.61 | 0.00 | 0.21 |
| SEQID-02499 | 0.01 | 0.06 | 0.03 | 0.06 | 0.04 | 0.01 | 0.06 | 0.07 | −17.37 | 0.42 | 0.02 | 8.61 | 0.19 | 0.60 | 0.00 | 0.22 |
| SEQID-02500 | 0.04 | 0.07 | 0.04 | 0.05 | 0.04 | 0.01 | 0.07 | 0.06 | −21.43 | 0.31 | 0.00 | 6.82 | 0.42 | 0.33 | 0.00 | 0.20 |
| SEQID-02501 | 0.01 | 0.07 | 0.04 | 0.04 | 0.03 | 0.01 | 0.05 | 0.06 | −17.67 | 0.44 | 0.03 | 9.55 | 0.41 | 0.56 | 0.00 | 0.22 |
| SEQID-02502 | 0.02 | 0.07 | 0.04 | 0.06 | 0.04 | 0.02 | 0.03 | 0.07 | −16.73 | 0.40 | 0.02 | 8.95 | 0.19 | 0.60 | 0.21 | 0.22 |
| SEQID-02503 | 0.01 | 0.07 | 0.05 | 0.04 | 0.04 | 0.01 | 0.04 | 0.05 | −17.57 | 0.31 | 0.04 | 5.99 | 0.41 | 0.59 | 0.00 | 0.21 |
| SEQID-02504 | 0.04 | 0.07 | 0.04 | 0.05 | 0.03 | 0.03 | 0.07 | 0.06 | −20.04 | 0.40 | −0.02 | 6.20 | 0.19 | 0.36 | 0.00 | 0.21 |
| SEQID-02505 | 0.02 | 0.06 | 0.04 | 0.04 | 0.03 | 0.03 | 0.06 | 0.07 | −18.61 | 0.37 | −0.01 | 3.22 | 0.19 | 0.34 | 0.00 | 0.20 |
| SEQID-02506 | 0.03 | 0.05 | 0.05 | 0.07 | 0.04 | 0.02 | 0.05 | 0.07 | −19.04 | 0.45 | −0.01 | 6.31 | 0.21 | 0.33 | 0.00 | 0.21 |
| SEQID-02507 | 0.04 | 0.05 | 0.04 | 0.04 | 0.05 | 0.01 | 0.03 | 0.08 | −19.62 | 0.43 | −0.01 | 6.59 | 0.20 | 0.35 | 0.00 | 0.21 |
| SEQID-02508 | 0.03 | 0.06 | 0.04 | 0.05 | 0.05 | 0.02 | 0.06 | 0.05 | −20.08 | 0.42 | −0.01 | 5.49 | 0.19 | 0.31 | 0.00 | 0.21 |
| SEQID-02509 | 0.04 | 0.06 | 0.04 | 0.06 | 0.06 | 0.01 | 0.05 | 0.05 | −19.78 | 0.42 | −0.02 | 6.20 | 0.20 | 0.30 | 0.00 | 0.21 |
| SEQID-02510 | 0.03 | 0.05 | 0.04 | 0.04 | 0.05 | 0.02 | 0.05 | 0.06 | −19.00 | 0.46 | 0.00 | 7.04 | 0.21 | 0.32 | 0.00 | 0.20 |
| SEQID-02511 | 0.03 | 0.06 | 0.04 | 0.04 | 0.04 | 0.01 | 0.06 | 0.05 | −20.23 | 0.42 | −0.01 | 6.35 | 0.20 | 0.31 | 0.00 | 0.20 |
| SEQID-02512 | 0.02 | 0.06 | 0.04 | 0.04 | 0.04 | 0.02 | 0.07 | 0.06 | −20.16 | 0.41 | −0.02 | 6.52 | 0.20 | 0.34 | 0.00 | 0.22 |
| SEQID-02513 | 0.01 | 0.09 | 0.03 | 0.05 | 0.05 | 0.03 | 0.10 | 0.06 | −9.08 | 0.66 | 0.01 | 8.91 | 0.31 | 0.41 | 0.21 | 0.21 |
| SEQID-02514 | 0.02 | 0.05 | 0.04 | 0.04 | 0.05 | 0.01 | 0.05 | 0.07 | −21.93 | 0.35 | −0.02 | 5.75 | 0.19 | 0.36 | 0.00 | 0.20 |
| SEQID-02515 | 0.02 | 0.05 | 0.03 | 0.03 | 0.05 | 0.01 | 0.04 | 0.07 | −25.25 | 0.39 | −0.03 | 4.82 | 0.89 | 0.99 | 0.00 | 0.21 |
| SEQID-02516 | 0.04 | 0.05 | 0.05 | 0.06 | 0.05 | 0.02 | 0.05 | 0.06 | −16.46 | 0.49 | 0.01 | 8.09 | 0.23 | 0.33 | 0.00 | 0.20 |
| SEQID-02517 | 0.03 | 0.05 | 0.03 | 0.05 | 0.05 | 0.03 | 0.04 | 0.10 | −19.93 | 0.49 | 0.00 | 8.07 | 0.83 | 0.95 | 0.00 | 0.21 |
| SEQID-02518 | 0.04 | 0.04 | 0.05 | 0.04 | 0.05 | 0.02 | 0.05 | 0.09 | −17.47 | 0.55 | 0.04 | 9.88 | 0.22 | 0.34 | 0.22 | 0.22 |
| SEQID-02519 | 0.01 | 0.05 | 0.04 | 0.05 | 0.03 | 0.01 | 0.03 | 0.06 | −25.87 | 0.41 | 0.01 | 8.23 | 0.37 | 0.51 | 0.18 | 0.21 |
| SEQID-02520 | 0.02 | 0.04 | 0.04 | 0.04 | 0.07 | 0.00 | 0.01 | 0.09 | −21.36 | 0.39 | −0.02 | 4.86 | 0.46 | 0.77 | 0.00 | 0.22 |
| SEQID-02521 | 0.02 | 0.07 | 0.03 | 0.05 | 0.05 | 0.01 | 0.03 | 0.07 | −17.87 | 0.36 | 0.01 | 8.44 | 0.22 | 0.44 | 0.20 | 0.22 |
| SEQID-02522 | 0.03 | 0.04 | 0.04 | 0.07 | 0.04 | 0.01 | 0.06 | 0.09 | −22.21 | 0.39 | 0.03 | 9.56 | 0.22 | 0.35 | 0.21 | 0.22 |
| SEQID-02523 | 0.01 | 0.07 | 0.04 | 0.04 | 0.05 | 0.01 | 0.04 | 0.06 | −17.00 | 0.39 | 0.01 | 8.01 | 0.43 | 0.60 | 0.20 | 0.21 |
| SEQID-02524 | 0.07 | 0.04 | 0.03 | 0.09 | 0.01 | 0.01 | 0.07 | 0.04 | −19.56 | 0.33 | 0.00 | 7.60 | 0.36 | 0.49 | 0.25 | 0.24 |
| SEQID-02525 | 0.01 | 0.03 | 0.04 | 0.05 | 0.06 | 0.01 | 0.05 | 0.07 | −19.79 | 0.39 | 0.01 | 8.33 | 0.21 | 0.33 | 0.00 | 0.00 |
| SEQID-02526 | 0.04 | 0.05 | 0.04 | 0.03 | 0.04 | 0.01 | 0.02 | 0.11 | −19.49 | 0.55 | −0.01 | 6.43 | 0.26 | 0.35 | 0.20 | 0.20 |
| SEQID-02527 | 0.02 | 0.05 | 0.04 | 0.05 | 0.05 | 0.01 | 0.06 | 0.05 | −17.50 | 0.46 | 0.00 | 6.62 | 0.21 | 0.32 | 0.00 | 0.22 |
| SEQID-02528 | 0.01 | 0.09 | 0.05 | 0.05 | 0.03 | 0.02 | 0.05 | 0.07 | −23.43 | 0.40 | −0.04 | 4.76 | 0.24 | 0.63 | 0.19 | 0.21 |
| SEQID-02529 | 0.04 | 0.02 | 0.04 | 0.04 | 0.03 | 0.01 | 0.04 | 0.09 | −15.87 | 0.52 | 0.02 | 7.90 | 1.00 | 1.00 | 0.27 | 0.32 |
| SEQID-02530 | 0.02 | 0.04 | 0.04 | 0.07 | 0.06 | 0.03 | 0.04 | 0.10 | −20.63 | 0.47 | 0.00 | 6.80 | 0.89 | 0.96 | 0.23 | 0.00 |
| SEQID-02531 | 0.01 | 0.06 | 0.03 | 0.05 | 0.04 | 0.01 | 0.03 | 0.07 | −23.43 | 0.45 | −0.02 | 7.26 | 0.39 | 0.54 | 0.00 | 0.23 |
| SEQID-02532 | 0.05 | 0.05 | 0.04 | 0.04 | 0.04 | 0.02 | 0.04 | 0.09 | −21.12 | 0.40 | −0.01 | 6.03 | 0.20 | 0.33 | 0.00 | 0.21 |
| SEQID-02533 | 0.02 | 0.05 | 0.03 | 0.04 | 0.06 | 0.01 | 0.03 | 0.08 | −21.73 | 0.43 | −0.02 | 5.23 | 0.22 | 0.33 | 0.00 | 0.21 |
| SEQID-02534 | 0.04 | 0.07 | 0.04 | 0.04 | 0.05 | 0.01 | 0.04 | 0.07 | −21.79 | 0.40 | −0.02 | 5.35 | 0.22 | 0.33 | 0.21 | 0.20 |
| SEQID-02535 | 0.03 | 0.05 | 0.03 | 0.04 | 0.05 | 0.03 | 0.06 | 0.09 | −20.07 | 0.56 | 0.00 | 5.57 | 0.24 | 0.36 | 0.20 | 0.22 |
| SEQID-02536 | 0.05 | 0.05 | 0.04 | 0.04 | 0.04 | 0.01 | 0.02 | 0.09 | −21.12 | 0.40 | −0.01 | 6.03 | 0.19 | 0.33 | 0.25 | 0.21 |
| SEQID-02537 | 0.05 | 0.08 | 0.04 | 0.06 | 0.03 | 0.02 | 0.04 | 0.06 | −7.72 | 0.63 | 0.02 | 8.14 | 0.33 | 0.48 | 0.27 | 0.26 |
| SEQID-02538 | 0.02 | 0.04 | 0.04 | 0.07 | 0.06 | 0.01 | 0.04 | 0.07 | −19.34 | 0.40 | 0.00 | 6.93 | 0.20 | 0.33 | 0.00 | 0.20 |
| SEQID-02539 | 0.01 | 0.05 | 0.03 | 0.05 | 0.04 | 0.01 | 0.03 | 0.08 | −20.15 | 0.43 | −0.02 | 5.26 | 0.24 | 0.32 | 0.00 | 0.22 |
| SEQID-02540 | 0.03 | 0.03 | 0.05 | 0.04 | 0.06 | 0.02 | 0.06 | 0.10 | −15.06 | 0.53 | 0.02 | 8.09 | 1.00 | 1.00 | 0.28 | 0.33 |
| SEQID-02541 | 0.02 | 0.05 | 0.04 | 0.05 | 0.04 | 0.01 | 0.03 | 0.08 | −19.70 | 0.53 | 0.00 | 6.55 | 0.23 | 0.33 | 0.22 | 0.21 |
| SEQID-02542 | 0.03 | 0.05 | 0.03 | 0.05 | 0.06 | 0.03 | 0.04 | 0.09 | −19.94 | 0.46 | 0.00 | 7.13 | 0.93 | 0.99 | 0.00 | 0.21 |
| SEQID-02543 | 0.03 | 0.05 | 0.04 | 0.04 | 0.05 | 0.01 | 0.06 | 0.05 | −18.88 | 0.46 | 0.00 | 6.64 | 0.21 | 0.31 | 0.00 | 0.21 |
| SEQID-02544 | 0.02 | 0.07 | 0.06 | 0.05 | 0.06 | 0.03 | 0.06 | 0.09 | −15.70 | 0.45 | 0.01 | 8.78 | 0.21 | 0.33 | 0.29 | 0.33 |
| SEQID-02545 | 0.05 | 0.03 | 0.06 | 0.04 | 0.02 | 0.02 | 0.07 | 0.09 | −15.58 | 0.53 | 0.02 | 8.09 | 1.00 | 1.00 | 0.27 | 0.21 |
| SEQID-02546 | 0.07 | 0.04 | 0.07 | 0.07 | 0.03 | 0.02 | 0.06 | 0.09 | −14.38 | 0.66 | 0.03 | 8.41 | 1.00 | 1.00 | 0.29 | 0.30 |
| SEQID-02547 | 0.01 | 0.06 | 0.04 | 0.06 | 0.02 | 0.02 | 0.07 | 0.03 | −7.89 | 0.67 | 0.02 | 8.47 | 0.32 | 0.46 | 0.25 | 0.23 |

TABLE 1-continued

| | | | | | | | | | | | | | | | | |
|---|---|---|---|---|---|---|---|---|---|---|---|---|---|---|---|---|
| SEQID-02548 | 0.03 | 0.04 | 0.04 | 0.05 | 0.05 | 0.03 | 0.03 | 0.07 | 0.43 | 0.02 | 9.64 | 0.00 | 0.30 | 0.00 | 0.00 | −20.17 |
| SEQID-02549 | 0.05 | 0.04 | 0.05 | 0.05 | 0.05 | 0.02 | 0.06 | 0.06 | 0.44 | −0.03 | 5.16 | 0.20 | 0.34 | 0.20 | 0.21 | −19.73 |
| SEQID-02550 | 0.05 | 0.04 | 0.05 | 0.04 | 0.03 | 0.01 | 0.05 | 0.09 | 0.68 | 0.01 | 7.57 | 0.34 | 0.40 | 0.27 | 0.37 | −14.39 |
| SEQID-02551 | 0.04 | 0.09 | 0.05 | 0.05 | 0.04 | 0.04 | 0.07 | 0.06 | 0.37 | −0.03 | 5.44 | 0.20 | 0.34 | 0.00 | 0.22 | −18.24 |
| SEQID-02552 | 0.01 | 0.06 | 0.03 | 0.06 | 0.06 | 0.01 | 0.10 | 0.05 | 0.60 | 0.02 | 9.47 | 0.29 | 0.40 | 0.26 | 0.23 | −9.62 |
| SEQID-02553 | 0.09 | 0.05 | 0.05 | 0.07 | 0.06 | 0.02 | 0.04 | 0.05 | 0.49 | 0.02 | 7.95 | 0.35 | 0.49 | 0.30 | 0.29 | −9.85 |
| SEQID-02554 | 0.01 | 0.07 | 0.04 | 0.06 | 0.07 | 0.02 | 0.09 | 0.07 | 0.65 | 0.00 | 8.46 | 0.31 | 0.48 | 0.26 | 0.24 | −7.89 |
| SEQID-02555 | 0.04 | 0.07 | 0.06 | 0.04 | 0.06 | 0.03 | 0.06 | 0.06 | 0.35 | 0.03 | 6.39 | 0.21 | 0.35 | 0.00 | 0.20 | −21.89 |
| SEQID-02556 | 0.05 | 0.05 | 0.02 | 0.04 | 0.04 | 0.02 | 0.04 | 0.07 | 0.52 | 0.01 | 8.84 | 0.24 | 0.31 | 0.26 | 0.23 | −18.88 |
| SEQID-02557 | 0.06 | 0.03 | 0.04 | 0.06 | 0.06 | 0.01 | 0.09 | 0.09 | 0.71 | 0.02 | 7.57 | 0.33 | 0.39 | 0.26 | 0.38 | −15.43 |
| SEQID-02558 | 0.01 | 0.07 | 0.03 | 0.05 | 0.05 | 0.00 | 0.10 | 0.06 | 0.67 | 0.02 | 8.91 | 0.31 | 0.41 | 0.22 | 0.23 | −9.17 |
| SEQID-02559 | 0.01 | 0.07 | 0.04 | 0.06 | 0.06 | 0.02 | 0.02 | 0.04 | 0.62 | 0.00 | 7.33 | 0.28 | 0.36 | 0.00 | 0.23 | −10.06 |
| SEQID-02560 | 0.05 | 0.04 | 0.05 | 0.06 | 0.05 | 0.02 | 0.06 | 0.07 | 0.43 | −0.03 | 5.15 | 0.21 | 0.32 | 0.19 | 0.19 | −19.68 |
| SEQID-02561 | 0.03 | 0.06 | 0.04 | 0.06 | 0.06 | 0.02 | 0.05 | 0.08 | 0.55 | 0.00 | 7.05 | 0.24 | 0.55 | 0.21 | 0.22 | −15.24 |
| SEQID-02562 | 0.04 | 0.03 | 0.05 | 0.06 | 0.06 | 0.03 | 0.03 | 0.09 | 0.54 | 0.00 | 5.97 | 0.25 | 0.35 | 0.00 | 0.21 | −16.37 |
| SEQID-02563 | 0.02 | 0.04 | 0.06 | 0.05 | 0.05 | 0.05 | 0.10 | 0.06 | 0.41 | 0.00 | 7.12 | 0.70 | 0.91 | 0.00 | 0.21 | −16.23 |
| SEQID-02564 | 0.02 | 0.06 | 0.05 | 0.03 | 0.03 | 0.06 | 0.04 | 0.06 | 0.31 | −0.01 | 6.79 | 0.22 | 0.32 | 0.22 | 0.23 | −20.60 |
| SEQID-02565 | 0.04 | 0.07 | 0.07 | 0.04 | 0.03 | 0.03 | 0.06 | 0.05 | 0.34 | 0.00 | 6.69 | 0.21 | 0.33 | 0.21 | 0.21 | −21.89 |
| SEQID-02566 | 0.03 | 0.07 | 0.04 | 0.07 | 0.06 | 0.01 | 0.05 | 0.06 | 0.44 | 0.00 | 5.28 | 0.21 | 0.33 | 0.00 | 0.25 | −13.93 |
| SEQID-02567 | 0.04 | 0.03 | 0.06 | 0.04 | 0.04 | 0.03 | 0.06 | 0.08 | 0.52 | −0.02 | 5.15 | 1.00 | 1.00 | 0.26 | 0.00 | −15.22 |
| SEQID-02568 | 0.01 | 0.07 | 0.06 | 0.03 | 0.04 | 0.01 | 0.06 | 0.07 | 0.51 | 0.01 | 4.64 | 0.26 | 0.35 | 0.00 | 0.24 | −15.31 |
| SEQID-02569 | 0.01 | 0.04 | 0.03 | 0.09 | 0.06 | 0.06 | 0.05 | 0.09 | 0.41 | −0.03 | 6.41 | 0.21 | 0.32 | 0.00 | 0.22 | −16.43 |
| SEQID-02570 | 0.03 | 0.06 | 0.04 | 0.05 | 0.04 | 0.03 | 0.04 | 0.07 | 0.46 | −0.01 | 7.01 | 0.21 | 0.34 | 0.22 | 0.21 | −19.99 |
| SEQID-02571 | 0.02 | 0.04 | 0.03 | 0.05 | 0.05 | 0.02 | 0.02 | 0.06 | 0.36 | −0.03 | 5.45 | 0.22 | 0.43 | 0.00 | 0.20 | −28.49 |
| SEQID-02572 | 0.03 | 0.04 | 0.03 | 0.04 | 0.04 | 0.01 | 0.03 | 0.06 | 0.37 | −0.03 | 4.84 | 0.71 | 0.91 | 0.00 | 0.21 | −22.92 |
| SEQID-02573 | 0.03 | 0.05 | 0.02 | 0.05 | 0.06 | 0.02 | 0.04 | 0.05 | 0.31 | −0.05 | 4.69 | 0.66 | 0.83 | 0.19 | 0.20 | −28.14 |
| SEQID-02574 | 0.01 | 0.07 | 0.03 | 0.03 | 0.04 | 0.09 | 0.09 | 0.06 | 0.63 | 0.01 | 3.42 | 0.31 | 0.42 | 0.00 | 0.20 | −8.93 |
| SEQID-02575 | 0.01 | 0.04 | 0.03 | 0.06 | 0.06 | 0.05 | 0.02 | 0.08 | 0.51 | −0.01 | 5.15 | 0.87 | 0.93 | 0.23 | 0.25 | −17.90 |
| SEQID-02576 | 0.02 | 0.04 | 0.05 | 0.04 | 0.05 | 0.04 | 0.04 | 0.12 | 0.34 | 0.13 | 11.57 | 0.00 | 0.35 | 0.00 | 0.00 | −19.24 |
| SEQID-02577 | 0.02 | 0.05 | 0.04 | 0.02 | 0.04 | 0.01 | 0.01 | 0.09 | 0.38 | −0.01 | 5.31 | 1.00 | 1.00 | 0.20 | 0.24 | −23.20 |
| SEQID-02578 | 0.04 | 0.07 | 0.06 | 0.04 | 0.04 | 0.03 | 0.03 | 0.06 | 0.34 | 0.00 | 6.40 | 0.21 | 0.33 | 0.00 | 0.22 | −22.11 |
| SEQID-02579 | 0.03 | 0.04 | 0.03 | 0.05 | 0.04 | 0.02 | 0.06 | 0.09 | 0.44 | −0.02 | 5.23 | 0.88 | 0.93 | 0.20 | 0.21 | −19.55 |
| SEQID-02580 | 0.03 | 0.06 | 0.06 | 0.06 | 0.04 | 0.04 | 0.05 | 0.07 | 0.45 | −0.01 | 6.24 | 0.20 | 0.34 | 0.00 | 0.22 | −17.64 |
| SEQID-02581 | 0.03 | 0.04 | 0.04 | 0.04 | 0.03 | 0.03 | 0.05 | 0.08 | 0.39 | −0.02 | 5.14 | 0.20 | 0.34 | 0.00 | 0.22 | −21.18 |
| SEQID-02582 | 0.04 | 0.07 | 0.07 | 0.05 | 0.06 | 0.06 | 0.05 | 0.07 | 0.39 | 0.00 | 6.81 | 0.23 | 0.33 | 0.19 | 0.23 | −20.45 |
| SEQID-02583 | 0.02 | 0.04 | 0.04 | 0.05 | 0.05 | 0.02 | 0.03 | 0.07 | 0.36 | 0.11 | 11.32 | 0.21 | 0.39 | 0.00 | 0.19 | −21.54 |
| SEQID-02584 | 0.03 | 0.07 | 0.04 | 0.04 | 0.04 | 0.03 | 0.04 | 0.09 | 0.45 | 0.00 | 7.77 | 0.00 | 0.32 | 0.26 | 0.22 | −19.60 |
| SEQID-02585 | 0.03 | 0.03 | 0.03 | 0.03 | 0.02 | 0.01 | 0.07 | 0.05 | 0.30 | −0.06 | 4.49 | 0.22 | 0.32 | 0.00 | 0.00 | −25.84 |
| SEQID-02586 | 0.03 | 0.03 | 0.02 | 0.02 | 0.04 | 0.01 | 0.07 | 0.04 | 0.30 | −0.06 | 4.46 | 0.24 | 0.33 | 0.00 | 0.00 | −26.08 |
| SEQID-02587 | 0.02 | 0.07 | 0.05 | 0.07 | 0.05 | 0.03 | 0.03 | 0.09 | 0.51 | −0.01 | 6.05 | 0.26 | 0.48 | 0.00 | 0.23 | −16.51 |
| SEQID-02588 | 0.02 | 0.04 | 0.04 | 0.05 | 0.07 | 0.00 | 0.01 | 0.08 | 0.38 | −0.06 | 4.32 | 0.47 | 0.66 | 0.22 | 0.23 | −22.86 |
| SEQID-02589 | 0.05 | 0.05 | 0.05 | 0.06 | 0.04 | 0.02 | 0.09 | 0.04 | 0.37 | 0.02 | 8.39 | 0.22 | 0.35 | 0.20 | 0.23 | −18.82 |
| SEQID-02590 | 0.04 | 0.03 | 0.04 | 0.03 | 0.05 | 0.02 | 0.02 | 0.07 | 0.41 | 0.00 | 7.05 | 0.22 | 0.34 | 0.20 | 0.22 | −20.00 |
| SEQID-02591 | 0.03 | 0.04 | 0.04 | 0.04 | 0.05 | 0.00 | 0.05 | 0.07 | 0.47 | −0.01 | 5.90 | 0.00 | 0.33 | 0.00 | 0.22 | −18.93 |
| SEQID-02592 | 0.02 | 0.04 | 0.04 | 0.05 | 0.06 | 0.00 | 0.00 | 0.03 | 0.47 | −0.01 | 6.31 | 0.21 | 0.35 | 0.21 | 0.21 | −18.09 |
| SEQID-02593 | 0.04 | 0.04 | 0.05 | 0.06 | 0.04 | 0.00 | 0.03 | 0.08 | 0.50 | 0.01 | 8.18 | 0.20 | 0.33 | 0.19 | 0.20 | −17.29 |
| SEQID-02594 | 0.03 | 0.05 | 0.06 | 0.04 | 0.06 | 0.03 | 0.05 | 0.07 | 0.43 | −0.01 | 6.23 | 0.87 | 0.96 | 0.00 | 0.21 | −19.28 |
| SEQID-02595 | 0.03 | 0.06 | 0.05 | 0.05 | 0.05 | 0.02 | 0.02 | 0.08 | 0.43 | −0.02 | 5.89 | 0.20 | 0.34 | 0.00 | 0.20 | −18.26 |
| SEQID-02596 | 0.02 | 0.02 | 0.05 | 0.07 | 0.04 | 0.01 | 0.01 | 0.07 | 0.36 | −0.10 | 4.09 | 0.19 | 0.40 | 0.20 | 0.21 | −24.35 |
| SEQID-02597 | 0.02 | 0.03 | 0.03 | 0.04 | 0.05 | 0.00 | 0.00 | 0.05 | 0.34 | −0.01 | 5.85 | 0.00 | 0.33 | 0.00 | 0.19 | −25.27 |
| SEQID-02598 | 0.02 | 0.09 | 0.03 | 0.03 | 0.03 | 0.02 | 0.06 | 0.07 | 0.35 | −0.07 | 4.28 | 0.38 | 0.44 | 0.24 | 0.00 | −24.82 |
| SEQID-02599 | 0.02 | 0.05 | 0.02 | 0.05 | 0.03 | 0.07 | 0.04 | 0.05 | 0.87 | 0.03 | 9.59 | 0.24 | 0.35 | 0.23 | 0.24 | −10.38 |
| SEQID-02600 | 0.01 | 0.04 | 0.10 | 0.07 | 0.05 | 0.03 | 0.04 | 0.08 | 0.50 | 0.02 | 8.49 | 0.30 | 0.39 | 0.00 | 1.00 | −17.05 |

TABLE 1-continued

| | | | | | | | | | | | | | | | | |
|---|---|---|---|---|---|---|---|---|---|---|---|---|---|---|---|---|
| SEQID-02601 | 0.04 | 0.05 | 0.04 | 0.04 | 0.04 | 0.01 | 0.04 | 0.08 | 0.06 | -21.61 | 0.44 | 0.05 | 10.15 | 0.21 | 0.31 | 0.00 | 0.21 |
| SEQID-02602 | 0.03 | 0.04 | 0.07 | 0.03 | 0.05 | 0.05 | 0.04 | 0.04 | 0.06 | -17.05 | 0.50 | -0.04 | 4.61 | 0.20 | 0.35 | 0.20 | 0.00 |
| SEQID-02603 | 0.02 | 0.06 | 0.05 | 0.05 | 0.03 | 0.04 | 0.04 | 0.04 | 0.08 | -20.46 | 0.47 | 0.01 | 8.42 | 0.42 | 0.69 | 0.22 | 0.20 |
| SEQID-02604 | 0.03 | 0.03 | 0.04 | 0.03 | 0.04 | 0.02 | 0.06 | 0.06 | 0.08 | -19.79 | 0.39 | 0.00 | 7.19 | 0.21 | 0.31 | 0.00 | 0.19 |
| SEQID-02605 | 0.02 | 0.03 | 0.03 | 0.05 | 0.05 | 0.00 | 0.03 | 0.06 | 0.06 | -24.17 | 0.42 | 0.00 | 7.09 | 0.21 | 0.33 | 0.00 | 0.21 |
| SEQID-02606 | 0.03 | 0.03 | 0.04 | 0.05 | 0.04 | 0.05 | 0.05 | 0.09 | 0.09 | -24.29 | 0.30 | 0.13 | 10.75 | 0.67 | 0.75 | 0.00 | 0.20 |
| SEQID-02607 | 0.03 | 0.03 | 0.07 | 0.05 | 0.03 | 0.02 | 0.05 | 0.05 | 0.07 | -22.97 | 0.41 | 0.01 | 8.58 | 0.41 | 0.60 | 0.21 | 0.20 |
| SEQID-02608 | 0.02 | 0.06 | 0.05 | 0.04 | 0.03 | 0.01 | 0.02 | 0.07 | 0.07 | -20.67 | 0.39 | -0.01 | 6.22 | 0.20 | 0.34 | 0.00 | 0.23 |
| SEQID-02609 | 0.03 | 0.06 | 0.05 | 0.07 | 0.05 | 0.01 | 0.05 | 0.06 | 0.06 | -17.99 | 0.49 | -0.01 | 6.39 | 0.21 | 0.33 | 0.00 | 0.21 |
| SEQID-02610 | 0.01 | 0.09 | 0.05 | 0.05 | 0.05 | 0.01 | 0.04 | 0.07 | 0.07 | -22.39 | 0.44 | -0.06 | 4.53 | 0.21 | 0.51 | 0.00 | 0.21 |
| SEQID-02611 | 0.02 | 0.05 | 0.04 | 0.05 | 0.05 | 0.02 | 0.04 | 0.05 | 0.05 | -21.82 | 0.36 | 0.00 | 6.87 | 0.19 | 0.32 | 0.00 | 0.21 |
| SEQID-02612 | 0.03 | 0.05 | 0.07 | 0.04 | 0.05 | 0.02 | 0.04 | 0.07 | 0.07 | -21.82 | 0.35 | -0.01 | 6.40 | 0.86 | 0.93 | 0.00 | 0.00 |
| SEQID-02613 | 0.03 | 0.05 | 0.04 | 0.05 | 0.02 | 0.02 | 0.04 | 0.04 | 0.09 | -22.91 | 0.24 | 0.14 | 11.03 | 0.22 | 0.31 | 0.24 | 0.26 |
| SEQID-02614 | 0.02 | 0.04 | 0.05 | 0.02 | 0.04 | 0.02 | 0.02 | 0.04 | 0.06 | -25.19 | 0.35 | 0.14 | 11.09 | 0.22 | 0.31 | 0.20 | 0.22 |
| SEQID-02615 | 0.02 | 0.05 | 0.02 | 0.03 | 0.06 | 0.00 | 0.09 | 0.04 | 0.07 | -26.16 | 0.26 | 0.03 | 9.40 | 0.22 | 0.31 | 0.00 | 0.00 |
| SEQID-02616 | 0.02 | 0.06 | 0.05 | 0.04 | 0.04 | 0.06 | 0.02 | 0.05 | 0.04 | -20.47 | 0.36 | 0.01 | 7.28 | 0.19 | 0.33 | 0.22 | 0.00 |
| SEQID-02617 | 0.02 | 0.09 | 0.05 | 0.06 | 0.05 | 0.02 | 0.05 | 0.07 | 0.03 | -14.92 | 0.47 | 0.01 | 7.33 | 0.52 | 0.70 | 0.00 | 0.21 |
| SEQID-02618 | 0.02 | 0.03 | 0.03 | 0.03 | 0.03 | 0.00 | 0.02 | 0.03 | 0.03 | -24.23 | 0.41 | -0.01 | 6.17 | 0.22 | 0.38 | 0.39 | 0.21 |
| SEQID-02619 | 0.04 | 0.01 | 0.06 | 0.04 | 0.05 | 0.01 | 0.06 | 0.03 | 0.03 | -16.32 | 0.61 | 0.01 | 7.57 | 0.51 | 0.55 | 0.26 | 0.56 |
| SEQID-02620 | 0.02 | 0.07 | 0.05 | 0.06 | 0.03 | 0.03 | 0.00 | 0.00 | 0.12 | -27.11 | 0.32 | 0.00 | 6.56 | 0.75 | 0.85 | 0.19 | 0.24 |
| SEQID-02621 | 0.02 | 0.06 | 0.04 | 0.04 | 0.04 | 0.03 | 0.10 | 0.05 | 0.05 | -17.30 | 0.52 | -0.01 | 6.60 | 0.36 | 0.50 | 0.00 | 0.20 |
| SEQID-02622 | 0.03 | 0.04 | 0.05 | 0.06 | 0.04 | 0.00 | 0.05 | 0.05 | 0.10 | -20.36 | 0.59 | -0.02 | 5.14 | 0.20 | 0.53 | 0.21 | 0.23 |
| SEQID-02623 | 0.01 | 0.09 | 0.05 | 0.07 | 0.05 | 0.02 | 0.06 | 0.04 | 0.04 | -20.14 | 0.28 | -0.02 | 5.66 | 0.23 | 0.31 | 0.00 | 0.00 |
| SEQID-02624 | 0.03 | 0.04 | 0.04 | 0.05 | 0.04 | 0.05 | 0.05 | 0.04 | 0.06 | -19.35 | 0.33 | -0.01 | 6.65 | 0.21 | 0.32 | 0.00 | 0.23 |
| SEQID-02625 | 0.04 | 0.05 | 0.06 | 0.06 | 0.03 | 0.01 | 0.04 | 0.04 | 0.07 | -16.45 | 0.59 | 0.04 | 10.09 | 0.21 | 0.34 | 0.00 | 0.22 |
| SEQID-02626 | 0.05 | 0.07 | 0.03 | 0.03 | 0.05 | 0.02 | 0.05 | 0.06 | 0.06 | -19.72 | 0.35 | -0.06 | 4.46 | 0.40 | 0.54 | 0.00 | 0.21 |
| SEQID-02627 | 0.03 | 0.06 | 0.06 | 0.04 | 0.06 | 0.01 | 0.06 | 0.03 | 0.03 | -19.97 | 0.39 | -0.05 | 4.57 | 0.81 | 0.90 | 0.23 | 0.22 |
| SEQID-02628 | 0.03 | 0.04 | 0.04 | 0.04 | 0.05 | 0.05 | 0.06 | 0.09 | 0.09 | -17.24 | 0.44 | 0.01 | 8.43 | 0.22 | 0.34 | 0.21 | 0.22 |
| SEQID-02629 | 0.03 | 0.05 | 0.05 | 0.05 | 0.04 | 0.02 | 0.04 | 0.03 | 0.07 | -15.14 | 0.55 | 0.00 | 7.08 | 0.28 | 0.33 | 0.00 | 0.22 |
| SEQID-02630 | 0.02 | 0.03 | 0.05 | 0.05 | 0.05 | 0.02 | 0.05 | 0.04 | 0.06 | -18.89 | 0.43 | 0.00 | 6.66 | 0.21 | 0.32 | 0.00 | 0.21 |
| SEQID-02631 | 0.03 | 0.07 | 0.03 | 0.03 | 0.05 | 0.02 | 0.05 | 0.06 | 0.06 | -24.34 | 0.34 | 0.02 | 9.28 | 0.38 | 0.61 | 0.20 | 0.21 |
| SEQID-02632 | 0.02 | 0.04 | 0.04 | 0.04 | 0.05 | 0.05 | 0.01 | 0.06 | 0.06 | -21.94 | 0.46 | -0.02 | 5.13 | 0.20 | 0.35 | 0.18 | 0.20 |
| SEQID-02633 | 0.05 | 0.05 | 0.06 | 0.06 | 0.03 | 0.00 | 0.05 | 0.06 | 0.06 | -23.57 | 0.36 | 0.10 | 10.85 | 0.23 | 0.29 | 0.20 | 0.25 |
| SEQID-02634 | 0.01 | 0.09 | 0.06 | 0.06 | 0.03 | 0.03 | 0.00 | 0.06 | 0.06 | -25.01 | 0.26 | -0.01 | 5.86 | 0.72 | 0.35 | 0.18 | 0.22 |
| SEQID-02635 | 0.01 | 0.07 | 0.03 | 0.03 | 0.06 | 0.01 | 0.04 | 0.05 | 0.05 | -21.44 | 0.34 | 0.18 | 11.23 | 0.21 | 0.31 | 0.26 | 0.22 |
| SEQID-02636 | 0.04 | 0.05 | 0.05 | 0.03 | 0.03 | 0.02 | 0.02 | 0.06 | 0.09 | -36.57 | 0.30 | 0.13 | 11.42 | 0.24 | 0.32 | 0.20 | 0.23 |
| SEQID-02637 | 0.02 | 0.03 | 0.03 | 0.04 | 0.05 | 0.01 | 0.02 | 0.05 | 0.06 | -24.26 | 0.31 | 0.12 | 10.98 | 0.31 | 0.30 | 0.20 | 0.23 |
| SEQID-02638 | 0.02 | 0.03 | 0.02 | 0.05 | 0.05 | 0.00 | 0.05 | 0.06 | 0.06 | -25.95 | 0.18 | 0.13 | 11.09 | 0.23 | 0.34 | 0.20 | 0.19 |
| SEQID-02639 | 0.03 | 0.04 | 0.03 | 0.09 | 0.05 | 0.03 | 0.05 | 0.05 | 0.03 | -23.36 | 0.38 | -0.08 | 4.12 | 0.39 | 0.54 | 0.00 | 0.00 |
| SEQID-02640 | 0.02 | 0.06 | 0.05 | 0.09 | 0.04 | 0.01 | 0.01 | 0.05 | 0.07 | -21.08 | 0.37 | 0.00 | 7.15 | 0.20 | 0.30 | 0.23 | 0.20 |
| SEQID-02641 | 0.02 | 0.02 | 0.05 | 0.01 | 0.05 | 0.03 | 0.07 | 0.07 | 0.05 | -25.83 | 0.18 | 0.13 | 11.09 | 0.23 | 0.33 | 0.21 | 0.20 |
| SEQID-02642 | 0.02 | 0.05 | 0.03 | 0.05 | 0.05 | 0.00 | 0.02 | 0.03 | 0.05 | -27.95 | 0.23 | 0.16 | 11.35 | 0.20 | 0.33 | 0.00 | 0.18 |
| SEQID-02643 | 0.03 | 0.05 | 0.07 | 0.03 | 0.03 | 0.00 | 0.02 | 0.03 | 0.05 | -25.27 | 0.31 | 0.08 | 10.53 | 0.30 | 0.30 | 0.17 | 0.00 |
| SEQID-02644 | 0.02 | 0.06 | 0.04 | 0.04 | 0.03 | 0.02 | 0.02 | 0.02 | 0.10 | -21.54 | 0.40 | 0.09 | 10.94 | 0.32 | 0.33 | 0.00 | 0.25 |
| SEQID-02645 | 0.03 | 0.06 | 0.05 | 0.03 | 0.05 | 0.01 | 0.05 | 0.05 | 0.06 | -19.10 | 0.45 | -0.01 | 5.83 | 0.26 | 0.36 | 0.20 | 0.00 |
| SEQID-02646 | 0.02 | 0.05 | 0.05 | 0.04 | 0.02 | 0.00 | 0.03 | 0.05 | 0.10 | -16.61 | 0.56 | 0.01 | 8.30 | 0.53 | 0.71 | 0.00 | 0.23 |
| SEQID-02647 | 0.05 | 0.06 | 0.06 | 0.02 | 0.05 | 0.03 | 0.03 | 0.03 | 0.06 | -17.98 | 0.57 | -0.03 | 5.23 | 0.00 | 0.31 | 0.00 | 0.22 |
| SEQID-02648 | 0.02 | 0.09 | 0.05 | 0.04 | 0.04 | 0.01 | 0.01 | 0.02 | 0.03 | -16.79 | 0.55 | -0.02 | 6.09 | 0.71 | 0.81 | 0.00 | 0.00 |
| SEQID-02649 | 0.01 | 0.09 | 0.04 | 0.04 | 0.04 | 0.04 | 0.02 | 0.03 | 0.06 | -23.65 | 0.39 | 0.00 | 6.74 | 0.24 | 0.31 | 0.00 | 0.20 |
| SEQID-02650 | 0.05 | 0.04 | 0.07 | 0.04 | 0.05 | 0.05 | 0.02 | 0.03 | 0.07 | -19.93 | 0.36 | 0.01 | 6.72 | 0.21 | 0.35 | 0.19 | 1.00 |
| SEQID-02651 | 0.04 | 0.07 | 0.05 | 0.05 | 0.05 | 0.01 | 0.01 | 0.03 | 0.03 | -18.84 | 0.50 | 0.01 | 8.22 | 0.45 | 0.69 | 0.00 | 0.21 |
| SEQID-02652 | 0.03 | 0.09 | 0.03 | 0.03 | 0.05 | 0.02 | 0.02 | 0.06 | 0.07 | -12.69 | 0.92 | 0.00 | 9.25 | 0.21 | 0.33 | 0.00 | 0.21 |
| SEQID-02653 | 0.04 | 0.06 | 0.05 | 0.05 | 0.06 | 0.01 | 0.01 | 0.04 | 0.09 | -18.81 | 0.43 | 0.00 | 7.37 | 0.21 | 0.33 | 0.21 | 0.21 |

TABLE 1-continued

| | | | | | | | | | | | | | | | | |
|---|---|---|---|---|---|---|---|---|---|---|---|---|---|---|---|---|
| SEQID-02654 | 0.03 | 0.06 | 0.04 | 0.04 | 0.04 | 0.05 | 0.05 | 0.05 | 0.07 | −23.42 | 0.31 | 0.00 | 7.06 | 0.20 | 0.33 | 0.20 | 0.21 |
| SEQID-02655 | 0.02 | 0.03 | 0.04 | 0.06 | 0.03 | 0.04 | 0.02 | 0.04 | 0.06 | −19.52 | 0.47 | −0.03 | 4.96 | 0.21 | 0.33 | 0.00 | 0.22 |
| SEQID-02656 | 0.03 | 0.04 | 0.06 | 0.06 | 0.05 | 0.05 | 0.03 | 0.03 | 0.06 | −19.16 | 0.33 | −0.03 | 9.42 | 0.22 | 0.37 | 0.21 | 0.22 |
| SEQID-02657 | 0.03 | 0.05 | 0.04 | 0.04 | 0.04 | 0.04 | 0.02 | 0.04 | 0.09 | −20.62 | 0.40 | −0.02 | 5.39 | 0.20 | 0.33 | 0.21 | 0.22 |
| SEQID-02658 | 0.03 | 0.04 | 0.05 | 0.06 | 0.04 | 0.04 | 0.03 | 0.02 | 0.07 | −18.73 | 0.55 | 0.02 | 9.11 | 0.21 | 0.33 | 0.00 | 0.22 |
| SEQID-02659 | 0.02 | 0.05 | 0.05 | 0.04 | 0.05 | 0.02 | 0.02 | 0.03 | 0.09 | −16.18 | 0.54 | −0.04 | 5.61 | 0.20 | 0.31 | 0.19 | 0.22 |
| SEQID-02660 | 0.03 | 0.04 | 0.04 | 0.05 | 0.02 | 0.04 | 0.03 | 0.03 | 0.03 | −19.63 | 0.60 | 0.00 | 4.66 | 0.21 | 0.34 | 0.00 | 0.22 |
| SEQID-02661 | 0.03 | 0.04 | 0.03 | 0.05 | 0.04 | 0.06 | 0.01 | 0.03 | 0.06 | −23.81 | 0.34 | −0.08 | 6.56 | 0.20 | 0.36 | 0.38 | 0.21 |
| SEQID-02662 | 0.04 | 0.04 | 0.06 | 0.02 | 0.06 | 0.04 | 0.02 | 0.00 | 0.07 | −23.42 | 0.38 | −0.08 | 4.21 | 0.28 | 0.36 | 0.28 | 0.31 |
| SEQID-02663 | 0.01 | 0.00 | 0.04 | 0.09 | 0.05 | 0.05 | 0.00 | 0.01 | 0.09 | −9.95 | 0.75 | 0.08 | 9.58 | 0.71 | 0.80 | 0.28 | 0.28 |
| SEQID-02664 | 0.02 | 0.02 | 0.02 | 0.02 | 0.06 | 0.06 | 0.01 | 0.02 | 0.07 | −30.26 | 0.19 | 0.08 | 10.61 | 0.23 | 0.30 | 0.00 | 0.23 |
| SEQID-02665 | 0.02 | 0.04 | 0.01 | 0.04 | 0.04 | 0.06 | 0.02 | 0.06 | 0.03 | −26.30 | 0.32 | 0.06 | 10.16 | 0.30 | 0.34 | 0.24 | 0.00 |
| SEQID-02666 | 0.05 | 0.04 | 0.03 | 0.05 | 0.06 | 0.03 | 0.01 | 0.03 | 0.08 | −13.01 | 0.91 | 0.03 | 10.18 | 0.59 | 0.80 | 0.29 | 0.23 |
| SEQID-02667 | 0.02 | 0.06 | 0.03 | 0.06 | 0.03 | 0.04 | 0.04 | 0.05 | 0.08 | −18.21 | 0.45 | 0.05 | 10.66 | 0.52 | 0.63 | 0.26 | 0.00 |
| SEQID-02668 | 0.03 | 0.04 | 0.04 | 0.05 | 0.09 | 0.05 | 0.00 | 0.02 | 0.06 | −23.27 | 0.33 | 0.03 | 11.13 | 0.23 | 0.30 | 0.18 | 0.23 |
| SEQID-02669 | 0.02 | 0.06 | 0.04 | 0.06 | 0.04 | 0.06 | 0.05 | 0.03 | 0.07 | −15.40 | 0.43 | −0.01 | 6.65 | 0.26 | 0.30 | 0.26 | 0.26 |
| SEQID-02670 | 0.04 | 0.10 | 0.04 | 0.05 | 0.04 | 0.06 | 0.01 | 0.03 | 0.09 | −17.99 | 0.40 | 0.02 | 8.49 | 0.82 | 0.85 | 0.00 | 0.24 |
| SEQID-02671 | 0.03 | 0.05 | 0.01 | 0.03 | 0.01 | 0.07 | 0.03 | 0.03 | 0.09 | −22.31 | 0.39 | 0.05 | 10.24 | 0.22 | 0.31 | 0.00 | 0.21 |
| SEQID-02672 | 0.03 | 0.03 | 0.03 | 0.05 | 0.03 | 0.04 | 0.01 | 0.04 | 0.06 | −21.21 | 0.39 | 0.05 | 10.27 | 0.00 | 0.30 | 0.00 | 0.13 |
| SEQID-02673 | 0.02 | 0.06 | 0.02 | 0.05 | 0.05 | 0.07 | 0.04 | 0.04 | 0.03 | −22.00 | 0.39 | 0.01 | 8.44 | 0.23 | 0.30 | 0.16 | 0.23 |
| SEQID-02674 | 0.06 | 0.03 | 0.05 | 0.05 | 0.03 | 0.03 | 0.03 | 0.01 | 0.10 | −24.56 | 0.35 | 0.00 | 7.53 | 0.00 | 0.45 | 0.22 | 0.24 |
| SEQID-02675 | 0.03 | 0.06 | 0.06 | 0.03 | 0.06 | 0.05 | 0.04 | 0.05 | 0.08 | −10.14 | 0.90 | 0.01 | 8.79 | 0.32 | 0.33 | 0.00 | 0.25 |
| SEQID-02676 | 0.00 | 0.04 | 0.06 | 0.02 | 0.06 | 0.02 | 0.02 | 0.09 | 0.10 | −19.85 | 0.53 | −0.03 | 5.34 | 0.50 | 0.79 | 0.20 | 0.24 |
| SEQID-02677 | 0.02 | 0.05 | 0.04 | 0.03 | 0.02 | 0.09 | 0.09 | 0.01 | 0.06 | −22.73 | 0.36 | 0.10 | 10.80 | 0.20 | 0.31 | 0.00 | 0.00 |
| SEQID-02678 | 0.03 | 0.06 | 0.02 | 0.05 | 0.04 | 0.05 | 0.05 | 0.03 | 0.05 | −20.62 | 0.36 | 0.02 | 8.92 | 0.20 | 0.31 | 0.00 | 0.20 |
| SEQID-02679 | 0.02 | 0.06 | 0.03 | 0.06 | 0.06 | 0.04 | 0.04 | 0.01 | 0.07 | −22.98 | 0.35 | −0.05 | 4.65 | 0.21 | 0.33 | 0.19 | 0.23 |
| SEQID-02680 | 0.01 | 0.06 | 0.04 | 0.06 | 0.06 | 0.06 | 0.04 | 0.04 | 0.09 | −18.07 | 0.45 | −0.01 | 6.84 | 0.21 | 0.35 | 0.26 | 0.22 |
| SEQID-02681 | 0.04 | 0.06 | 0.05 | 0.02 | 0.06 | 0.05 | 0.02 | 0.01 | 0.07 | −17.09 | 0.51 | −0.01 | 6.28 | 0.30 | 0.43 | 0.00 | 0.21 |
| SEQID-02682 | 0.04 | 0.02 | 0.02 | 0.03 | 0.05 | 0.06 | 0.00 | 0.02 | 0.09 | −20.90 | 0.43 | −0.01 | 5.39 | 0.21 | 0.33 | 0.22 | 0.22 |
| SEQID-02683 | 0.02 | 0.03 | 0.03 | 0.07 | 0.02 | 0.05 | 0.00 | 0.01 | 0.09 | −20.47 | 0.54 | −0.02 | 5.11 | 0.21 | 0.33 | 0.20 | 0.22 |
| SEQID-02684 | 0.01 | 0.04 | 0.07 | 0.03 | 0.04 | 0.03 | 0.04 | 0.04 | 0.05 | −28.42 | 0.38 | −0.07 | 4.45 | 0.43 | 0.73 | 0.19 | 0.21 |
| SEQID-02685 | 0.02 | 0.05 | 0.05 | 0.05 | 0.05 | 0.05 | 0.00 | 0.00 | 0.10 | −17.41 | 0.58 | 0.00 | 7.33 | 0.21 | 0.35 | 0.22 | 0.21 |
| SEQID-02686 | 0.03 | 0.04 | 0.02 | 0.06 | 0.05 | 0.06 | 0.01 | 0.05 | 0.07 | −17.37 | 0.46 | 0.00 | 7.27 | 0.20 | 0.35 | 0.00 | 0.22 |
| SEQID-02687 | 0.02 | 0.04 | 0.04 | 0.07 | 0.03 | 0.04 | 0.02 | 0.05 | 0.05 | −28.42 | 0.24 | −0.05 | 4.61 | 0.44 | 0.69 | 0.00 | 0.20 |
| SEQID-02688 | 0.04 | 0.07 | 0.07 | 0.07 | 0.04 | 0.05 | 0.05 | 0.04 | 0.05 | −22.43 | 0.31 | −0.01 | 5.79 | 0.19 | 0.55 | 0.00 | 0.20 |
| SEQID-02689 | 0.03 | 0.05 | 0.05 | 0.03 | 0.05 | 0.03 | 0.04 | 0.02 | 0.07 | −22.87 | 0.32 | −0.05 | 4.72 | 0.18 | 0.33 | 0.19 | 0.19 |
| SEQID-02690 | 0.04 | 0.09 | 0.03 | 0.04 | 0.01 | 0.02 | 0.05 | 0.06 | 0.09 | −9.31 | 0.92 | 0.09 | 9.06 | 0.32 | 0.31 | 0.29 | 0.30 |
| SEQID-02691 | 0.02 | 0.05 | 0.05 | 0.06 | 0.04 | 0.05 | 0.05 | 0.09 | 0.04 | −16.79 | 0.43 | −0.02 | 5.65 | 0.26 | 0.33 | 0.20 | 0.00 |
| SEQID-02692 | 0.04 | 0.07 | 0.02 | 0.02 | 0.04 | 0.03 | 0.06 | 0.04 | 0.09 | −21.68 | 0.56 | 0.07 | 10.55 | 0.00 | 0.33 | 0.23 | 0.26 |
| SEQID-02693 | 0.02 | 0.05 | 0.02 | 0.07 | 0.05 | 0.04 | 0.04 | 0.05 | 0.06 | −10.89 | 0.88 | 0.03 | 10.62 | 0.47 | 0.64 | 0.26 | 0.22 |
| SEQID-02694 | 0.02 | 0.02 | 0.05 | 0.05 | 0.04 | 0.05 | 0.00 | 0.05 | 0.05 | −27.06 | 0.27 | 0.15 | 11.62 | 0.22 | 0.30 | 0.17 | 0.22 |
| SEQID-02695 | 0.03 | 0.01 | 0.04 | 0.05 | 0.02 | 0.06 | 0.01 | 0.01 | 0.11 | −23.24 | 0.48 | 0.03 | 9.90 | 0.21 | 0.31 | 0.00 | 0.21 |
| SEQID-02696 | 0.03 | 0.04 | 0.03 | 0.06 | 0.05 | 0.05 | 0.00 | 0.00 | 0.11 | −23.44 | 0.37 | −0.03 | 5.87 | 0.00 | 0.30 | 0.23 | 0.25 |
| SEQID-02697 | 0.04 | 0.01 | 0.02 | 0.05 | 0.03 | 0.03 | 0.03 | 0.04 | 0.07 | −20.38 | 0.49 | 0.00 | 6.79 | 0.00 | 0.31 | 0.00 | 0.23 |
| SEQID-02698 | 0.03 | 0.05 | 0.01 | 0.01 | 0.02 | 0.06 | 0.01 | 0.06 | 0.09 | −23.35 | 0.29 | 0.09 | 10.48 | 0.22 | 0.33 | 0.00 | 0.23 |
| SEQID-02699 | 0.04 | 0.09 | 0.04 | 0.02 | 0.05 | 0.05 | 0.03 | 0.06 | 0.04 | −22.58 | 0.23 | 0.16 | 11.08 | 0.22 | 0.28 | 0.20 | 0.30 |
| SEQID-02700 | 0.02 | 0.05 | 0.02 | 0.02 | 0.07 | 0.04 | 0.00 | 0.04 | 0.09 | −26.58 | 0.31 | 0.07 | 10.37 | 0.00 | 0.30 | 0.23 | 0.00 |
| SEQID-02701 | 0.04 | 0.07 | 0.05 | 0.04 | 0.05 | 0.07 | 0.01 | 0.03 | 0.07 | −24.24 | 0.30 | 0.03 | 10.90 | 0.47 | 0.64 | 0.26 | 0.26 |
| SEQID-02702 | 0.02 | 0.05 | 0.03 | 0.03 | 0.03 | 0.05 | 0.00 | 0.01 | 0.05 | −14.83 | 0.34 | 0.10 | 10.81 | 0.00 | 0.32 | 0.22 | 0.00 |
| SEQID-02703 | 0.01 | 0.06 | 0.06 | 0.04 | 0.04 | 0.04 | 0.01 | 0.01 | 0.06 | −14.35 | 0.68 | 0.01 | 7.78 | 0.23 | 0.33 | 0.21 | 0.22 |
| SEQID-02704 | 0.02 | 0.03 | 0.07 | 0.05 | 0.02 | 0.06 | 0.01 | 0.01 | 0.10 | −13.24 | 0.60 | 0.01 | 7.83 | 0.25 | 0.34 | 0.00 | 0.23 |
| SEQID-02705 | 0.01 | 0.07 | 0.06 | 0.09 | 0.07 | 0.02 | 0.01 | 0.04 | 0.06 | −20.80 | 0.49 | −0.01 | 5.77 | 0.24 | 0.41 | 0.22 | 0.23 |
| SEQID-02706 | 0.03 | 0.05 | 0.03 | 0.06 | 0.04 | 0.04 | 0.01 | 0.06 | 0.06 | | 0.37 | −0.02 | 5.22 | 0.00 | 0.34 | 0.00 | 0.17 |

TABLE 1-continued

| | | | | | | | | | | | | | | | |
|---|---|---|---|---|---|---|---|---|---|---|---|---|---|---|---|
| SEQID-02707 | 0.02 | 0.09 | 0.04 | 0.04 | 0.05 | 0.03 | 0.06 | 0.08 | -10.43 | 0.97 | 0.02 | 8.57 | 0.19 | 0.33 | 0.22 | 0.22 |
| SEQID-02708 | 0.04 | 0.07 | 0.04 | 0.07 | 0.07 | 0.02 | 0.04 | 0.07 | -11.61 | 0.98 | 0.00 | 6.52 | 0.00 | 0.34 | 0.20 | 0.22 |
| SEQID-02709 | 0.04 | 0.07 | 0.05 | 0.03 | 0.05 | 0.01 | 0.02 | 0.09 | -18.52 | 0.51 | -0.01 | 6.63 | 0.24 | 0.32 | 0.00 | 0.20 |
| SEQID-02710 | 0.04 | 0.07 | 0.06 | 0.04 | 0.04 | 0.04 | 0.06 | 0.06 | -19.76 | 0.38 | -0.01 | 6.06 | 0.21 | 0.33 | 0.00 | 0.22 |
| SEQID-02711 | 0.03 | 0.05 | 0.04 | 0.04 | 0.06 | 0.03 | 0.05 | 0.05 | -22.74 | 0.35 | 0.00 | 6.86 | 0.22 | 0.31 | 0.00 | 0.20 |
| SEQID-02712 | 0.01 | 0.06 | 0.05 | 0.04 | 0.05 | 0.02 | 0.03 | 0.07 | -18.77 | 0.43 | 0.00 | 6.33 | 0.21 | 0.32 | 0.20 | 0.23 |
| SEQID-02713 | 0.01 | 0.07 | 0.04 | 0.07 | 0.03 | 0.03 | 0.03 | 0.08 | -19.54 | 0.47 | -0.02 | 5.25 | 0.21 | 0.37 | 0.00 | 0.23 |
| SEQID-02714 | 0.04 | 0.05 | 0.04 | 0.06 | 0.06 | 0.03 | 0.09 | 0.07 | -20.73 | 0.39 | -0.02 | 5.64 | 0.22 | 0.32 | 0.21 | 0.22 |
| SEQID-02715 | 0.02 | 0.04 | 0.05 | 0.05 | 0.04 | 0.04 | 0.06 | 0.06 | -18.43 | 0.36 | 0.00 | 6.00 | 0.21 | 0.33 | 0.00 | 0.23 |
| SEQID-02716 | 0.03 | 0.06 | 0.04 | 0.06 | 0.06 | 0.02 | 0.04 | 0.06 | -19.43 | 0.47 | 0.00 | 7.43 | 0.22 | 0.33 | 0.00 | 0.22 |
| SEQID-02717 | 0.02 | 0.05 | 0.06 | 0.06 | 0.05 | 0.03 | 0.04 | 0.06 | -17.83 | 0.44 | 0.00 | 6.87 | 0.21 | 0.34 | 0.00 | 0.22 |
| SEQID-02718 | 0.03 | 0.07 | 0.0G | 0.06 | 0.04 | 0.02 | 0.04 | 0.09 | -15.17 | 0.68 | -0.01 | 5.53 | 0.20 | 0.33 | 0.00 | 0.22 |
| SEQID-02719 | 0.03 | 0.05 | 0.05 | 0.05 | 0.05 | 0.01 | 0.06 | 0.06 | -18.34 | 0.42 | -0.01 | 6.38 | 0.21 | 0.33 | 0.00 | 0.21 |
| SEQID-02720 | 0.03 | 0.06 | 0.04 | 0.06 | 0.05 | 0.01 | 0.05 | 0.07 | -17.71 | 0.48 | 0.01 | 7.76 | 0.21 | 0.35 | 0.00 | 0.21 |
| SEQID-02721 | 0.03 | 0.04 | 0.07 | 0.04 | 0.05 | 0.02 | 0.04 | 0.08 | -16.52 | 0.52 | 0.00 | 6.96 | 0.20 | 0.34 | 0.21 | 0.21 |
| SEQID-02722 | 0.04 | 0.05 | 0.05 | 0.05 | 0.04 | 0.01 | 0.03 | 0.06 | -17.69 | 0.56 | 0.02 | 9.42 | 0.21 | 0.33 | 0.19 | 0.21 |
| SEQID-02723 | 0.03 | 0.05 | 0.05 | 0.03 | 0.05 | 0.01 | 0.04 | 0.07 | -23.11 | 0.36 | -0.03 | 4.91 | 0.41 | 0.59 | 0.00 | 0.20 |
| SEQID-02724 | 0.04 | 0.05 | 0.03 | 0.04 | 0.04 | 0.01 | 0.05 | 0.06 | -18.16 | 0.55 | -0.05 | 4.33 | 0.19 | 0.33 | 0.00 | 0.20 |
| SEQID-02725 | 0.02 | 0.05 | 0.03 | 0.05 | 0.06 | 0.01 | 0.04 | 0.07 | -16.41 | 0.39 | 0.00 | 6.82 | 0.38 | 0.65 | 0.00 | 0.23 |
| SEQID-02726 | 0.04 | 0.04 | 0.03 | 0.03 | 0.05 | 0.02 | 0.04 | 0.06 | -19.70 | 0.45 | -0.03 | 5.16 | 0.19 | 0.35 | 0.00 | 0.21 |
| SEQID-02727 | 0.05 | 0.05 | 0.02 | 0.02 | 0.06 | 0.02 | 0.06 | 0.07 | -16.67 | 0.51 | 0.00 | 6.78 | 0.20 | 0.69 | 0.51 | 0.00 |
| SEQID-02728 | 0.04 | 0.05 | 0.05 | 0.06 | 0.05 | 0.07 | 0.06 | 0.06 | -19.71 | 0.44 | -0.03 | 5.16 | 0.19 | 0.33 | 0.00 | 0.20 |
| SEQID-02729 | 0.06 | 0.04 | 0.04 | 0.05 | 0.06 | 0.01 | 0.04 | 0.08 | -21.97 | 0.41 | -0.03 | 9.64 | 0.21 | 0.35 | 0.00 | 0.22 |
| SEQID-02730 | 0.03 | 0.04 | 0.05 | 0.03 | 0.05 | 0.05 | 0.06 | 0.03 | -17.45 | 0.53 | 0.02 | 8.69 | 0.21 | 0.68 | 0.51 | 0.21 |
| SEQID-02731 | 0.01 | 0.05 | 0.28 | 0.07 | 0.02 | 0.00 | 0.07 | 0.10 | -20.31 | 0.50 | 0.01 | 8.19 | 0.24 | 0.94 | 0.22 | 0.00 |
| SEQID-02732 | 0.02 | 0.07 | 0.04 | 0.05 | 0.06 | 0.01 | 0.05 | 0.07 | -19.63 | 0.47 | -0.02 | 5.66 | 0.20 | 0.31 | 0.00 | 0.22 |
| SEQID-02733 | 0.04 | 0.03 | 0.05 | 0.06 | 0.07 | 0.02 | 0.04 | 0.06 | -19.85 | 0.43 | 0.00 | 3.30 | 0.21 | 0.58 | 0.46 | 0.20 |
| SEQID-02734 | 0.02 | 0.06 | 0.03 | 0.03 | 0.04 | 0.02 | 0.04 | 0.03 | -19.88 | 0.45 | 0.01 | 3.72 | 0.54 | 0.91 | 0.00 | 0.22 |
| SEQID-02735 | 0.04 | 0.04 | 0.05 | 0.03 | 0.05 | 0.03 | 0.06 | 0.10 | -32.67 | 0.27 | 0.00 | 7.00 | 0.21 | 0.31 | 0.00 | 0.21 |
| SEQID-02736 | 0.01 | 0.05 | 0.02 | 0.06 | 0.05 | 0.00 | 0.05 | 0.02 | -25.93 | 0.25 | 0.13 | 10.85 | 0.28 | 0.31 | 0.24 | 0.27 |
| SEQID-02737 | 0.02 | 0.04 | 0.06 | 0.04 | 0.04 | 0.00 | 0.03 | 0.05 | -17.54 | 0.44 | 0.01 | 8.66 | 0.59 | 0.88 | 0.00 | 0.00 |
| SEQID-02738 | 0.03 | 0.04 | 0.04 | 0.04 | 0.09 | 0.02 | 0.04 | 0.09 | -16.83 | 0.38 | -0.02 | 5.73 | 0.99 | 1.00 | 0.12 | 0.21 |
| SEQID-02739 | 0.01 | 0.05 | 0.05 | 0.05 | 0.07 | 0.05 | 0.06 | 0.07 | -10.31 | 0.32 | 0.00 | 6.61 | 0.20 | 1.00 | 0.00 | 0.21 |
| SEQID-02740 | 0.01 | 0.07 | 0.28 | 0.07 | 0.02 | 0.00 | 0.07 | 0.05 | -18.93 | 0.33 | 0.00 | 7.69 | 0.22 | 0.41 | 0.21 | 0.22 |
| SEQID-02741 | 0.02 | 0.03 | 0.04 | 0.05 | 0.06 | 0.01 | 0.05 | 0.07 | -20.59 | 0.35 | -0.02 | 5.81 | 0.21 | 0.34 | 0.00 | 0.27 |
| SEQID-02742 | 0.01 | 0.06 | 0.04 | 0.06 | 0.03 | 0.02 | 0.04 | 0.06 | -19.66 | 0.44 | 0.00 | 6.93 | 0.20 | 0.33 | 0.24 | 0.20 |
| SEQID-02743 | 0.03 | 0.04 | 0.04 | 0.04 | 0.03 | 0.01 | 0.06 | 0.05 | -18.64 | 0.49 | 0.00 | 6.93 | 0.21 | 0.32 | 0.00 | 0.21 |
| SEQID-02744 | 0.03 | 0.06 | 0.04 | 0.07 | 0.05 | 0.02 | 0.05 | 0.08 | -13.87 | 0.30 | 0.02 | 8.68 | 0.21 | 0.33 | 0.20 | 0.22 |
| SEQID-02745 | 0.01 | 0.05 | 0.22 | 0.09 | 0.06 | 0.01 | 0.07 | 0.04 | -21.23 | 0.37 | -0.01 | 6.06 | 0.00 | 0.45 | 0.24 | 0.00 |
| SEQID-02746 | 0.05 | 0.05 | 0.04 | 0.04 | 0.04 | 0.05 | 0.04 | 0.08 | -24.99 | 0.36 | -0.01 | 6.46 | 0.22 | 0.35 | 0.00 | 0.22 |
| SEQID-02747 | 0.01 | 0.05 | 0.05 | 0.05 | 0.05 | 0.03 | 0.04 | 0.06 | -18.14 | 0.36 | -0.01 | 8.81 | 0.19 | 0.35 | 0.00 | 0.21 |
| SEQID-02748 | 0.06 | 0.12 | 0.03 | 0.01 | 0.09 | 0.04 | 0.06 | 0.05 | -20.01 | 0.53 | 0.08 | 7.73 | 0.30 | 0.29 | 0.30 | 0.23 |
| SEQID-02749 | 0.07 | 0.06 | 0.05 | 0.05 | 0.07 | 0.04 | 0.05 | 0.04 | -19.01 | 0.71 | 0.01 | 10.44 | 0.26 | 0.28 | 0.25 | 0.26 |
| SEQID-02750 | 0.01 | 0.04 | 0.02 | 0.01 | 0.07 | 0.04 | 0.06 | 0.05 | -15.35 | 0.28 | 0.11 | 4.81 | 0.24 | 0.31 | 0.24 | 0.28 |
| SEQID-02751 | 0.01 | 0.03 | 0.05 | 0.05 | 0.04 | 0.04 | 0.04 | 0.08 | -26.09 | 0.55 | -0.03 | 6.25 | 0.20 | 0.31 | 0.00 | 0.22 |
| SEQID-02752 | 0.03 | 0.05 | 0.05 | 0.06 | 0.04 | 0.02 | 0.04 | 0.10 | -18.50 | 0.56 | -0.01 | 4.97 | 0.26 | 0.34 | 0.20 | 0.22 |
| SEQID-02753 | 0.03 | 0.09 | 0.05 | 0.05 | 0.06 | 0.02 | 0.05 | 0.04 | -16.97 | 0.32 | -0.03 | 4.92 | 0.00 | 0.34 | 0.00 | 0.00 |
| SEQID-02754 | 0.05 | 0.05 | 0.02 | 0.02 | 0.04 | 0.02 | 0.05 | 0.06 | -18.54 | 0.39 | 0.01 | 9.15 | 0.22 | 0.33 | 0.24 | 0.21 |
| SEQID-02755 | 0.02 | 0.03 | 0.05 | 0.05 | 0.03 | 0.05 | 0.03 | 0.06 | -24.99 | 0.38 | -0.03 | 4.88 | 0.23 | 0.35 | 0.00 | 0.22 |
| SEQID-02756 | 0.01 | 0.05 | 0.04 | 0.07 | 0.05 | 0.03 | 0.05 | 0.06 | -18.14 | 0.38 | 0.01 | 5.32 | 0.70 | 0.93 | 0.20 | 0.21 |
| SEQID-02757 | 0.03 | 0.04 | 0.03 | 0.04 | 0.06 | 0.01 | 0.03 | 0.07 | -23.11 | 0.49 | -0.03 | 5.35 | 0.19 | 1.00 | 0.00 | 0.22 |
| SEQID-02758 | 0.02 | 0.05 | 0.04 | 0.05 | 0.05 | 0.00 | 0.05 | 0.08 | -18.71 | 0.41 | -0.01 | 6.97 | 0.88 | 0.33 | 0.00 | 0.20 |
| SEQID-02759 | 0.03 | 0.06 | 0.05 | 0.05 | 0.05 | 0.03 | 0.05 | 0.07 | -19.94 | 0.43 | 0.00 | 5.35 | 0.19 | 1.00 | 0.20 | 0.21 |
| | 0.02 | 0.04 | 0.04 | 0.02 | 0.07 | 0.00 | 0.03 | 0.04 | -24.18 | 0.30 | 0.15 | 11.74 | 0.24 | 0.30 | 0.00 | 0.26 |

TABLE 1-continued

| | | | | | | | | | | | | | | | |
|---|---|---|---|---|---|---|---|---|---|---|---|---|---|---|---|
| SEQID-02760 | 0.03 | 0.04 | 0.05 | 0.04 | 0.05 | 0.03 | 0.04 | 0.06 | −16.13 | 0.48 | 0.02 | 9.09 | 0.20 | 0.33 | 0.20 | 0.19 |
| SEQID-02761 | 0.02 | 0.08 | 0.04 | 0.07 | 0.05 | 0.03 | 0.05 | 0.04 | −16.70 | 0.36 | 0.05 | 9.16 | 0.22 | 0.32 | 0.00 | 0.21 |
| SEQID-02762 | 0.02 | 0.07 | 0.07 | 0.07 | 0.07 | 0.04 | 0.06 | 0.03 | −14.12 | 0.35 | 0.02 | 8.29 | 0.70 | 0.35 | 0.21 | 0.23 |
| SEQID-02763 | 0.03 | 0.06 | 0.01 | 0.07 | 0.05 | 0.00 | 0.03 | 0.07 | −15.16 | 0.53 | −0.02 | 4.73 | 0.00 | 0.32 | 0.00 | 0.21 |
| SEQID-02764 | 0.03 | 0.04 | 0.05 | 0.07 | 0.05 | 0.03 | 0.05 | 0.09 | −16.89 | 0.42 | 0.01 | 8.17 | 0.21 | 0.34 | 0.00 | 0.20 |
| SEQID-02765 | 0.03 | 0.05 | 0.04 | 0.05 | 0.06 | 0.04 | 0.03 | 0.09 | −19.66 | 0.54 | −0.01 | 5.85 | 0.23 | 0.33 | 0.23 | 0.21 |
| SEQID-02766 | 0.02 | 0.06 | 0.03 | 0.03 | 0.06 | 0.02 | 0.05 | 0.07 | −24.03 | 0.34 | 0.13 | 10.76 | 0.67 | 0.75 | 0.00 | 0.22 |
| SEQID-02767 | 0.04 | 0.07 | 0.03 | 0.04 | 0.05 | 0.01 | 0.04 | 0.07 | −21.28 | 0.43 | −0.01 | 5.55 | 0.22 | 0.33 | 0.21 | 0.20 |
| SEQID-02768 | 0.02 | 0.04 | 0.03 | 0.05 | 0.04 | 0.02 | 0.05 | 0.09 | −20.12 | 0.41 | −0.01 | 5.75 | 0.39 | 0.95 | 0.22 | 0.23 |
| SEQID-02769 | 0.02 | 0.05 | 0.05 | 0.03 | 0.06 | 0.01 | 0.05 | 0.07 | −24.92 | 0.41 | −0.03 | 4.83 | 0.91 | 0.99 | 0.00 | 0.21 |
| SEQID-02770 | 0.03 | 0.05 | 0.02 | 0.05 | 0.04 | 0.01 | 0.05 | 0.05 | −28.29 | 0.30 | −0.04 | 4.75 | 0.68 | 0.33 | 0.00 | 0.20 |
| SEQID-02771 | 0.03 | 0.07 | 0.04 | 0.05 | 0.03 | 0.03 | 0.07 | 0.06 | −21.30 | 0.29 | −0.02 | 6.00 | 0.19 | 0.32 | 0.00 | 0.20 |
| SEQID-02772 | 0.09 | 0.09 | 0.03 | 0.06 | 0.06 | 0.00 | 0.00 | 0.05 | −18.31 | 0.55 | 0.07 | 8.61 | 0.31 | 0.29 | 0.34 | 0.30 |
| SEQID-02773 | 0.02 | 0.04 | 0.00 | 0.04 | 0.03 | 0.02 | 0.09 | 0.03 | −19.07 | 0.13 | −0.01 | 5.32 | 0.31 | 0.54 | 0.28 | 0.32 |
| SEQID-02774 | 0.01 | 0.04 | 0.03 | 0.05 | 0.05 | 0.03 | 0.03 | 0.05 | −21.86 | 0.45 | −0.02 | 6.41 | 0.36 | 0.44 | 0.23 | 0.20 |
| SEQID-02775 | 0.02 | 0.05 | 0.02 | 0.05 | 0.06 | 0.00 | 0.06 | 0.09 | −21.70 | 0.35 | −0.03 | 5.54 | 0.74 | 0.89 | 0.24 | 0.22 |
| SEQID-02776 | 0.02 | 0.07 | 0.01 | 0.03 | 0.07 | 0.04 | 0.07 | 0.06 | −16.91 | 0.43 | 0.00 | 5.77 | 0.26 | 0.32 | 0.00 | 0.22 |
| SEQID-02777 | 0.03 | 0.05 | 0.02 | 0.03 | 0.03 | 0.01 | 0.05 | 0.06 | −26.92 | 0.30 | 0.09 | 10.85 | 0.22 | 0.32 | 0.00 | 0.21 |
| SEQID-02778 | 0.03 | 0.02 | 0.03 | 0.04 | 0.04 | 0.04 | 0.08 | 0.07 | −24.90 | 0.20 | 0.20 | 12.00 | 0.22 | 0.31 | 0.20 | 0.23 |
| SEQID-02779 | 0.04 | 0.02 | 0.04 | 0.04 | 0.02 | 0.01 | 0.03 | 0.04 | −29.43 | 0.17 | 0.22 | 12.05 | 0.00 | 0.30 | 0.22 | 0.24 |
| SEQID-02780 | 0.02 | 0.03 | 0.08 | 0.04 | 0.09 | 0.03 | 0.06 | 0.04 | −13.34 | 0.33 | 0.02 | 7.96 | 1.00 | 1.00 | 0.22 | 0.50 |
| SEQID-02781 | 0.03 | 0.03 | 0.02 | 0.06 | 0.04 | 0.01 | 0.07 | 0.04 | −24.89 | 0.32 | −0.06 | 4.37 | 0.21 | 0.34 | 0.21 | 0.00 |
| SEQID-02782 | 0.02 | 0.02 | 0.11 | 0.05 | 0.05 | 0.00 | 0.02 | 0.08 | −25.13 | 0.22 | −0.01 | 11.32 | 0.24 | 0.38 | 0.24 | 0.25 |
| SEQID-02783 | 0.01 | 0.02 | 0.12 | 0.04 | 0.06 | 0.00 | 0.01 | 0.06 | −24.43 | 0.15 | 0.22 | 11.47 | 0.29 | 0.43 | 0.25 | 0.29 |
| SEQID-02784 | 0.04 | 0.09 | 0.05 | 0.04 | 0.05 | 0.03 | 0.05 | 0.06 | −12.46 | 0.86 | 0.01 | 8.31 | 0.21 | 0.34 | 0.00 | 0.20 |
| SEQID-02785 | 0.02 | 0.09 | 0.04 | 0.03 | 0.05 | 0.03 | 0.07 | 0.09 | −11.82 | 0.99 | 0.01 | 8.30 | 0.22 | 0.34 | 0.00 | 0.00 |
| SEQID-02786 | 0.04 | 0.05 | 0.05 | 0.04 | 0.04 | 0.00 | 0.02 | 0.06 | −18.30 | 0.52 | −0.01 | 6.24 | 0.25 | 0.33 | 0.00 | 0.23 |
| SEQID-02787 | 0.03 | 0.06 | 0.04 | 0.04 | 0.05 | 0.01 | 0.03 | 0.10 | −18.28 | 0.54 | −0.01 | 6.43 | 0.26 | 0.35 | 0.00 | 0.20 |
| SEQID-02788 | 0.03 | 0.05 | 0.05 | 0.07 | 0.04 | 0.02 | 0.06 | 0.09 | −17.31 | 0.52 | 0.00 | 6.63 | 0.21 | 0.33 | 0.22 | 0.21 |
| SEQID-02789 | 0.03 | 0.06 | 0.02 | 0.04 | 0.06 | 0.03 | 0.05 | 0.05 | −22.14 | 0.37 | 0.00 | 6.79 | 0.22 | 0.34 | 0.21 | 0.21 |
| SEQID-02790 | 0.02 | 0.05 | 0.05 | 0.06 | 0.05 | 0.03 | 0.03 | 0.09 | −19.53 | 0.41 | −0.01 | 6.03 | 0.21 | 0.33 | 0.24 | 0.21 |
| SEQID-02791 | 0.01 | 0.06 | 0.04 | 0.06 | 0.06 | 0.01 | 0.04 | 0.08 | −16.00 | 0.52 | −0.01 | 6.30 | 0.20 | 0.32 | 0.25 | 0.21 |
| SEQID-02792 | 0.01 | 0.05 | 0.07 | 0.04 | 0.07 | 0.02 | 0.04 | 0.09 | −25.79 | 0.30 | −0.07 | 4.36 | 0.20 | 0.41 | 0.00 | 0.22 |
| SEQID-02793 | 0.04 | 0.06 | 0.05 | 0.05 | 0.04 | 0.02 | 0.06 | 0.07 | −19.92 | 0.39 | −0.02 | 5.10 | 0.20 | 0.36 | 0.17 | 0.22 |
| SEQID-02794 | 0.03 | 0.02 | 0.04 | 0.04 | 0.05 | 0.02 | 0.05 | 0.02 | −24.57 | 0.38 | −0.01 | 6.02 | 0.23 | 0.38 | 0.00 | 0.21 |
| SEQID-02795 | 0.05 | 0.06 | 0.05 | 0.06 | 0.05 | 0.02 | 0.05 | 0.06 | −18.56 | 0.53 | −0.01 | 6.68 | 0.21 | 0.33 | 0.38 | 0.21 |
| SEQID-03796 | 0.05 | 0.04 | 0.05 | 0.04 | 0.06 | 0.01 | 0.04 | 0.06 | −19.72 | 0.44 | −0.01 | 5.17 | 0.20 | 0.34 | 0.00 | 0.23 |
| SEQID-02797 | 0.05 | 0.04 | 0.04 | 0.05 | 0.05 | 0.02 | 0.06 | 0.07 | −19.74 | 0.43 | −0.03 | 5.16 | 0.21 | 0.31 | 0.00 | 0.20 |
| SEQID-02798 | 0.03 | 0.04 | 0.04 | 0.05 | 0.04 | 0.02 | 0.06 | 0.09 | −20.29 | 0.44 | −0.03 | 6.53 | 0.91 | 1.00 | 0.22 | 0.22 |
| SEQID-02799 | 0.03 | 0.05 | 0.04 | 0.05 | 0.04 | 0.02 | 0.04 | 0.03 | −21.22 | 0.38 | 0.00 | 5.73 | 0.21 | 0.33 | 0.20 | 0.22 |
| SEQID-02800 | 0.05 | 0.05 | 0.03 | 0.04 | 0.05 | 0.02 | 0.05 | 0.03 | −21.15 | 0.39 | −0.02 | 5.97 | 0.19 | 0.32 | 0.00 | 0.21 |
| SEQID-02801 | 0.02 | 0.04 | 0.04 | 0.04 | 0.04 | 0.02 | 0.02 | 0.08 | −19.95 | 0.44 | −0.01 | 5.53 | 0.39 | 0.99 | 0.20 | 0.22 |
| SEQID-02802 | 0.03 | 0.05 | 0.04 | 0.05 | 0.05 | 0.03 | 0.03 | 0.07 | −18.37 | 0.70 | −0.01 | 5.50 | 0.19 | 0.33 | 0.00 | 0.20 |
| SEQID-02803 | 0.04 | 0.04 | 0.04 | 0.04 | 0.04 | 0.02 | 0.04 | 0.07 | −19.89 | 0.43 | −0.02 | 6.30 | 0.21 | 0.33 | 0.18 | 0.21 |
| SEQID-02804 | 0.03 | 0.04 | 0.03 | 0.04 | 0.04 | 0.01 | 0.04 | 0.06 | −22.76 | 0.37 | −0.01 | 4.91 | 0.71 | 0.91 | 0.00 | 0.21 |
| SEQID-02805 | 0.02 | 0.03 | 0.04 | 0.03 | 0.04 | 0.01 | 0.03 | 0.07 | −19.40 | 0.41 | 0.01 | 8.03 | 0.23 | 0.34 | 0.00 | 0.22 |
| SEQID-02806 | 0.02 | 0.05 | 0.04 | 0.06 | 0.06 | 0.01 | 0.03 | 0.09 | −20.35 | 0.54 | 0.00 | 6.70 | 0.24 | 0.33 | 0.20 | 0.21 |
| SEQID-02807 | 0.03 | 0.05 | 0.05 | 0.04 | 0.05 | 0.01 | 0.04 | 0.03 | −22.17 | 0.41 | 0.03 | 9.53 | 0.22 | 0.33 | 0.21 | 0.21 |
| SEQID-02808 | 0.03 | 0.07 | 0.04 | 0.05 | 0.04 | 0.01 | 0.04 | 0.09 | −19.02 | 0.51 | −0.01 | 6.35 | 0.25 | 0.34 | 0.00 | 0.21 |
| SEQID-02809 | 0.03 | 0.05 | 0.04 | 0.04 | 0.04 | 0.01 | 0.02 | 0.07 | −22.81 | 0.37 | −0.01 | 4.91 | 0.71 | 0.91 | 0.20 | 0.20 |
| SEQID-02810 | 0.03 | 0.05 | 0.03 | 0.07 | 0.05 | 0.03 | 0.03 | 0.10 | −20.69 | 0.47 | −0.02 | 7.21 | 0.86 | 0.93 | 0.00 | 0.21 |
| SEQID-02811 | 0.03 | 0.04 | 0.04 | 0.06 | 0.04 | 0.03 | 0.04 | 0.06 | −21.89 | 0.38 | 0.00 | 6.31 | 0.19 | 0.33 | 0.20 | 0.19 |
| SEQID-02812 | 0.03 | 0.06 | 0.04 | 0.05 | 0.04 | 0.02 | 0.06 | 0.06 | −20.34 | 0.41 | −0.02 | 6.02 | 0.19 | 0.35 | 0.00 | 0.21 |

TABLE 1-continued

| | | | | | | | | | | | | | | | |
|---|---|---|---|---|---|---|---|---|---|---|---|---|---|---|---|
| SEQID-02813 | 0.01 | 0.03 | 0.07 | 0.05 | 0.04 | 0.00 | 0.01 | 0.05 | -38.34 | 0.12 | -0.07 | 4.92 | 0.28 | 0.45 | 0.13 | 0.26 |
| SEQID-02814 | 0.03 | 0.06 | 0.03 | 0.05 | 0.06 | 0.03 | 0.04 | 0.10 | -20.33 | 0.49 | 0.01 | 8.08 | 0.84 | 0.94 | 0.19 | 0.22 |
| SEQID-02815 | 0.03 | 0.07 | 0.04 | 0.07 | 0.04 | 0.02 | 0.05 | 0.06 | -19.57 | 0.42 | 0.00 | 6.53 | 0.20 | 0.34 | 0.00 | 0.21 |
| SEQID-02816 | 0.03 | 0.06 | 0.05 | 0.04 | 0.04 | 0.03 | 0.05 | 0.05 | -22.17 | 0.35 | -0.03 | 5.57 | 0.12 | 0.32 | 0.00 | 0.20 |
| SEQID-02817 | 0.04 | 0.07 | 0.03 | 0.04 | 0.05 | 0.01 | 0.05 | 0.08 | -21.34 | 0.43 | -0.02 | 5.22 | 0.21 | 0.33 | 0.00 | 0.20 |
| SEQID-02818 | 0.02 | 0.05 | 0.04 | 0.05 | 0.04 | 0.06 | 0.03 | 0.06 | -19.05 | 0.50 | -0.07 | 6.68 | 0.20 | 0.32 | 0.20 | 0.21 |
| SEQID-02819 | 0.01 | 0.05 | 0.09 | 0.03 | 0.05 | 0.02 | 0.03 | 0.09 | -25.75 | 0.35 | -0.03 | 4.40 | 0.20 | 0.48 | 0.19 | 0.21 |
| SEQID-02820 | 0.02 | 0.05 | 0.04 | 0.03 | 0.04 | 0.00 | 0.03 | 0.06 | -24.83 | 0.35 | 0.01 | 4.89 | 0.23 | 0.31 | 0.00 | 0.21 |
| SEQID-02821 | 0.01 | 0.03 | 0.01 | 0.05 | 0.07 | 0.02 | 0.05 | 0.04 | -24.60 | 0.40 | 0.00 | 7.68 | 0.22 | 0.32 | 0.00 | 0.00 |
| SEQID-02822 | 0.03 | 0.04 | 0.04 | 0.06 | 0.06 | 0.02 | 0.05 | 0.07 | -18.84 | 0.46 | -0.05 | 7.93 | 0.20 | 0.32 | 0.00 | 0.22 |
| SEQID-02823 | 0.02 | 0.08 | 0.04 | 0.06 | 0.03 | 0.00 | 0.05 | 0.06 | -24.66 | 0.39 | 0.00 | 4.72 | 0.20 | 0.32 | 0.00 | 0.23 |
| SEQID-02824 | 0.03 | 0.06 | 0.05 | 0.07 | 0.05 | 0.03 | 0.02 | 0.07 | -17.72 | 0.41 | 0.00 | 7.12 | 0.18 | 0.38 | 0.20 | 0.21 |
| SEQID-02825 | 0.03 | 0.06 | 0.04 | 0.04 | 0.04 | 0.01 | 0.05 | 0.07 | -19.88 | 0.46 | -0.02 | 5.18 | 0.19 | 0.36 | 0.18 | 0.19 |
| SEQID-02826 | 0.05 | 0.00 | 0.00 | 0.00 | 0.02 | 0.00 | 0.06 | 0.00 | -27.63 | 0.13 | 0.00 | 6.97 | 0.43 | 0.28 | 0.33 | 0.36 |
| SEQID-02827 | 0.03 | 0.07 | 0.03 | 0.03 | 0.04 | 0.03 | 0.00 | 0.13 | -23.66 | 0.49 | -0.04 | 4.98 | 0.56 | 0.68 | 0.00 | 0.00 |
| SEQID-02828 | 0.02 | 0.07 | 0.07 | 0.04 | 0.04 | 0.04 | 0.04 | 0.04 | -22.83 | 0.33 | -0.02 | 5.93 | 0.24 | 0.35 | 0.20 | 0.23 |
| SEQID-02829 | 0.03 | 0.06 | 0.06 | 0.06 | 0.04 | 0.01 | 0.05 | 0.07 | -17.67 | 0.51 | -0.01 | 5.99 | 0.22 | 0.33 | 0.00 | 0.23 |
| SEQID-02830 | 0.01 | 0.06 | 0.03 | 0.03 | 0.04 | 0.03 | 0.07 | 0.08 | -20.80 | 0.48 | 0.00 | 6.69 | 0.22 | 0.33 | 0.00 | 0.22 |
| SEQID-02831 | 0.01 | 0.05 | 0.05 | 0.05 | 0.04 | 0.01 | 0.03 | 0.09 | -19.87 | 0.44 | 0.00 | 8.05 | 0.21 | 0.33 | 0.00 | 0.22 |
| SEQID-02832 | 0.02 | 0.04 | 0.04 | 0.05 | 0.05 | 0.03 | 0.05 | 0.06 | -18.85 | 0.43 | 0.00 | 7.06 | 0.20 | 0.35 | 0.00 | 0.21 |
| SEQID-02833 | 0.03 | 0.05 | 0.04 | 0.06 | 0.05 | 0.02 | 0.05 | 0.07 | -20.31 | 0.41 | -0.01 | 6.47 | 0.87 | 0.98 | 0.00 | 0.20 |
| SEQID-02834 | 0.04 | 0.05 | 0.05 | 0.06 | 0.05 | 0.02 | 0.05 | 0.03 | -18.23 | 0.43 | 0.00 | 6.85 | 0.20 | 0.34 | 0.00 | 0.21 |
| SEQID-02835 | 0.01 | 0.05 | 0.04 | 0.05 | 0.04 | 0.04 | 0.02 | 0.12 | -17.44 | 0.54 | 0.00 | 6.77 | 0.79 | 0.86 | 0.23 | 0.23 |
| SEQID-02836 | 0.00 | 0.02 | 0.10 | 0.09 | 0.01 | 0.00 | 0.19 | 0.01 | -27.00 | 0.03 | -0.08 | 4.40 | 0.25 | 0.38 | 0.21 | 0.26 |
| SEQID-02837 | 0.03 | 0.05 | 0.04 | 0.09 | 0.01 | 0.02 | 0.04 | 0.09 | -17.36 | 0.45 | 0.02 | 8.78 | 0.57 | 0.89 | 0.23 | 0.22 |
| SEQID-02838 | 0.02 | 0.04 | 0.02 | 0.03 | 0.07 | 0.00 | 0.02 | 0.05 | -23.65 | 0.34 | 0.00 | 7.88 | 0.22 | 0.31 | 0.22 | 0.21 |
| SEQID-02839 | 0.03 | 0.03 | 0.02 | 0.06 | 0.09 | 0.03 | 0.03 | 0.06 | -20.86 | 0.43 | 0.00 | 7.03 | 0.22 | 0.35 | 0.00 | 0.21 |
| SEQID-02840 | 0.02 | 0.05 | 0.05 | 0.05 | 0.03 | 0.05 | 0.05 | 0.09 | -15.77 | 0.52 | -0.01 | 6.24 | 0.22 | 0.33 | 0.00 | 0.21 |
| SEQID-02841 | 0.03 | 0.06 | 0.04 | 0.04 | 0.05 | 0.03 | 0.04 | 0.07 | -18.06 | 0.42 | -0.02 | 5.81 | 0.19 | 0.32 | 0.00 | 0.20 |
| SEQID-02842 | 0.02 | 0.07 | 0.05 | 0.07 | 0.05 | 0.02 | 0.04 | 0.06 | -22.46 | 0.30 | -0.01 | 6.38 | 0.20 | 0.58 | 0.00 | 0.21 |
| SEQID-02843 | 0.02 | 0.07 | 0.04 | 0.07 | 0.03 | 0.05 | 0.04 | 0.07 | -19.11 | 0.43 | 0.00 | 7.78 | 0.25 | 0.33 | 0.00 | 0.21 |
| SEQID-02844 | 0.04 | 0.10 | 0.04 | 0.04 | 0.07 | 0.01 | 0.02 | 0.09 | -16.02 | 0.43 | 0.03 | 8.97 | 0.91 | 0.96 | 0.00 | 0.27 |
| SEQID-02845 | 0.04 | 0.10 | 0.04 | 0.05 | 0.07 | 0.01 | 0.02 | 0.03 | -18.91 | 0.35 | 0.01 | 7.97 | 0.88 | 0.94 | 0.00 | 0.27 |
| SEQID-02846 | 0.01 | 0.00 | 0.12 | 0.02 | 0.08 | 0.00 | 0.00 | 0.11 | -32.61 | 0.13 | -0.25 | 3.61 | 0.42 | 0.48 | 0.26 | 0.28 |
| SEQID-02847 | 0.05 | 0.08 | 0.04 | 0.07 | 0.03 | 0.01 | 0.06 | 0.05 | -20.86 | 0.34 | 0.00 | 7.29 | 0.22 | 0.31 | 0.00 | 0.23 |
| SEQID-02848 | 0.05 | 0.02 | 0.04 | 0.05 | 0.06 | 0.02 | 0.02 | 0.09 | -19.41 | 0.56 | 0.00 | 7.59 | 0.21 | 0.33 | 0.00 | 0.21 |
| SEQID-02849 | 0.03 | 0.04 | 0.04 | 0.04 | 0.05 | 0.02 | 0.05 | 0.07 | -21.14 | 0.40 | -0.01 | 6.25 | 0.20 | 0.31 | 0.00 | 0.22 |
| SEQID-02850 | 0.04 | 0.03 | 0.04 | 0.07 | 0.03 | 0.01 | 0.06 | 0.03 | -25.82 | 0.32 | -0.07 | 4.40 | 0.22 | 0.33 | 0.00 | 0.22 |
| SEQID-02851 | 0.01 | 0.07 | 0.02 | 0.02 | 0.05 | 0.05 | 0.07 | 0.05 | -20.48 | 0.38 | 0.04 | 9.21 | 0.21 | 0.34 | 0.19 | 0.21 |
| SEQID-02852 | 0.03 | 0.02 | 0.04 | 0.05 | 0.04 | 0.02 | 0.07 | 0.10 | -16.82 | 0.56 | 0.00 | 6.62 | 0.68 | 0.38 | 0.00 | 0.00 |
| SEQID-02853 | 0.03 | 0.04 | 0.05 | 0.05 | 0.04 | 0.03 | 0.03 | 0.06 | -17.53 | 0.38 | 0.01 | 8.99 | 0.21 | 0.33 | 0.00 | 0.23 |
| SEQID-02854 | 0.03 | 0.05 | 0.05 | 0.06 | 0.05 | 0.02 | 0.06 | 0.06 | -17.07 | 0.49 | 0.00 | 7.38 | 0.25 | 0.35 | 0.22 | 0.22 |
| SEQID-02855 | 0.06 | 0.06 | 0.04 | 0.06 | 0.06 | 0.02 | 0.06 | 0.06 | -19.18 | 0.33 | -0.05 | 4.51 | 0.40 | 0.53 | 0.00 | 0.23 |
| SEQID-02856 | 0.06 | 0.07 | 0.03 | 0.05 | 0.06 | 0.05 | 0.05 | 0.06 | -19.74 | 0.35 | -0.05 | 4.49 | 0.40 | 0.54 | 0.00 | 0.23 |
| SEQID-02857 | 0.03 | 0.07 | 0.04 | 0.04 | 0.04 | 0.02 | 0.05 | 0.07 | -19.73 | 0.45 | -0.02 | 5.50 | 0.21 | 0.32 | 0.00 | 0.21 |
| SEQID-02858 | 0.04 | 0.04 | 0.04 | 0.03 | 0.05 | 0.01 | 0.05 | 0.07 | -19.33 | 0.50 | 0.00 | 5.62 | 0.21 | 0.34 | 0.19 | 0.22 |
| SEQID-02859 | 0.03 | 0.05 | 0.05 | 0.05 | 0.06 | 0.05 | 0.07 | 0.08 | -17.75 | 0.42 | -0.07 | 4.19 | 0.68 | 0.38 | 0.00 | 0.22 |
| SEQID-02860 | 0.01 | 0.05 | 0.05 | 0.05 | 0.04 | 0.02 | 0.05 | 0.07 | -16.60 | 0.51 | -0.02 | 5.87 | 0.21 | 0.32 | 0.17 | 0.21 |
| SEQID-02861 | 0.02 | 0.04 | 0.03 | 0.04 | 0.06 | 0.01 | 0.03 | 0.08 | -24.91 | 0.41 | -0.03 | 4.78 | 0.90 | 1.00 | 0.00 | 0.21 |
| SEQID-02862 | 0.02 | 0.06 | 0.04 | 0.05 | 0.04 | 0.03 | 0.07 | 0.07 | -20.75 | 0.43 | 0.00 | 7.12 | 0.20 | 0.34 | 0.18 | 0.21 |
| SEQID-02863 | 0.04 | 0.09 | 0.03 | 0.07 | 0.06 | 0.02 | 0.04 | 0.09 | -12.26 | 0.95 | -0.01 | 5.12 | 0.20 | 0.32 | 0.00 | 0.30 |
| SEQID-02864 | 0.03 | 0.04 | 0.04 | 0.04 | 0.04 | 0.02 | 0.05 | 0.05 | -22.85 | 0.36 | 0.01 | 6.07 | 0.20 | 0.34 | 0.00 | 0.21 |
| SEQID-02865 | 0.02 | 0.05 | 0.00 | 0.09 | 0.02 | 0.02 | 0.09 | 0.02 | -18.40 | 0.16 | 0.00 | 6.75 | 0.31 | 0.49 | 0.29 | 0.32 |

TABLE 1-continued

| | | | | | | | | | | | | | | | |
|---|---|---|---|---|---|---|---|---|---|---|---|---|---|---|---|
| SEQID-02866 | 0.02 | 0.06 | 0.05 | 0.04 | 0.06 | 0.00 | 0.06 | 0.09 | -21.29 | 0.39 | -0.02 | 6.39 | 0.62 | 0.68 | 0.00 | 0.25 |
| SEQID-02867 | 0.02 | 0.03 | 0.04 | 0.05 | 0.04 | 0.03 | 0.02 | 0.09 | -19.69 | 0.49 | 0.00 | 6.52 | 0.26 | 0.33 | 0.00 | 0.25 |
| SEQID-02868 | 0.03 | 0.06 | 0.04 | 0.03 | 0.02 | 0.04 | 0.07 | 0.05 | -26.81 | 0.28 | -0.06 | 4.66 | 0.21 | 0.31 | 0.00 | 0.24 |
| SEQID-02869 | 0.02 | 0.03 | 0.06 | 0.09 | 0.06 | 0.03 | 0.02 | 0.07 | -14.19 | 0.47 | -0.03 | 4.73 | 0.66 | 0.89 | 0.24 | 0.24 |
| SEQID-02870 | 0.04 | 0.03 | 0.02 | 0.07 | 0.05 | 0.02 | 0.07 | 0.05 | -23.48 | 0.40 | -0.06 | 4.51 | 0.23 | 0.34 | 0.21 | 0.00 |
| SEQID-02871 | 0.03 | 0.09 | 0.09 | 0.04 | 0.04 | 0.03 | 0.05 | 0.06 | -12.89 | 0.89 | 0.01 | 8.58 | 0.20 | 0.33 | 0.23 | 0.23 |
| SEQID-02872 | 0.02 | 0.04 | 0.06 | 0.04 | 0.04 | 0.05 | 0.05 | 0.05 | -19.05 | 0.32 | -0.02 | 5.27 | 0.22 | 0.34 | 0.00 | 0.23 |
| SEQID-02873 | 0.02 | 0.07 | 0.05 | 0.06 | 0.05 | 0.05 | 0.07 | 0.03 | -16.01 | 0.52 | -0.01 | 5.46 | 0.28 | 0.41 | 0.00 | 0.34 |
| SEQID-02874 | 0.05 | 0.05 | 0.05 | 0.04 | 0.03 | 0.02 | 0.06 | 0.11 | -18.46 | 0.52 | -0.01 | 6.41 | 0.25 | 0.33 | 0.00 | 0.23 |
| SEQID-02875 | 0.05 | 0.05 | 0.04 | 0.05 | 0.03 | 0.01 | 0.02 | 0.09 | -21.45 | 0.46 | -0.03 | 5.01 | 0.00 | 0.30 | 0.00 | 0.25 |
| SEQID-02876 | 0.04 | 0.03 | 0.05 | 0.05 | 0.03 | 0.03 | 0.05 | 0.07 | -21.33 | 0.34 | 0.10 | 11.11 | 0.22 | 0.36 | 0.00 | 0.19 |
| SEQID-02877 | 0.03 | 0.07 | 0.07 | 0.07 | 0.05 | 0.04 | 0.04 | 0.06 | -20.45 | 0.39 | 0.01 | 7.72 | 0.22 | 0.33 | 0.23 | 0.22 |
| SEQID-02878 | 0.02 | 0.09 | 0.07 | 0.05 | 0.04 | 0.03 | 0.06 | 0.05 | -20.84 | 0.28 | 0.01 | 7.39 | 0.39 | 0.59 | 0.00 | 0.21 |
| SEQID-02879 | 0.01 | 0.09 | 0.06 | 0.04 | 0.04 | 0.02 | 0.06 | 0.06 | -21.17 | 0.28 | 0.00 | 7.21 | 0.39 | 0.61 | 0.00 | 0.21 |
| SEQID-02880 | 0.03 | 0.07 | 0.04 | 0.06 | 0.04 | 0.02 | 0.03 | 0.09 | -21.19 | 0.53 | 0.00 | 7.50 | 0.20 | 0.34 | 0.00 | 0.22 |
| SEQID-02881 | 0.02 | 0.04 | 0.05 | 0.06 | 0.04 | 0.00 | 0.03 | 0.09 | -18.04 | 0.48 | -0.01 | 6.31 | 0.21 | 0.33 | 0.00 | 0.22 |
| SEQID-02882 | 0.03 | 0.04 | 0.10 | 0.10 | 0.04 | 0.00 | 0.05 | 0.05 | -14.55 | 0.27 | -0.02 | 5.91 | 0.22 | 0.49 | 0.19 | 0.21 |
| SEQID-02883 | 0.05 | 0.05 | 0.05 | 0.07 | 0.05 | 0.03 | 0.04 | 0.08 | -13.95 | 0.84 | -0.03 | 4.60 | 0.19 | 0.36 | 0.00 | 0.24 |
| SEQID-02884 | 0.03 | 0.05 | 0.05 | 0.05 | 0.05 | 0.01 | 0.03 | 0.08 | -22.71 | 0.37 | -0.03 | 4.87 | 0.39 | 0.60 | 0.00 | 0.23 |
| SEQID-02885 | 0.04 | 0.04 | 0.06 | 0.06 | 0.04 | 0.03 | 0.06 | 0.03 | -19.93 | 0.30 | -0.01 | 6.37 | 0.19 | 0.40 | 0.00 | 0.20 |
| SEQID-02886 | 0.02 | 0.09 | 0.03 | 0.03 | 0.04 | 0.02 | 0.06 | 0.07 | -24.09 | 0.38 | -0.08 | 4.23 | 0.38 | 0.43 | 0.21 | 0.21 |
| SEQID-02887 | 0.03 | 0.07 | 0.06 | 0.06 | 0.06 | 0.01 | 0.03 | 0.10 | -14.57 | 0.56 | 0.01 | 3.69 | 0.31 | 0.40 | 0.00 | 0.25 |
| SEQID-02888 | 0.01 | 0.06 | 0.05 | 0.05 | 0.05 | 0.01 | 0.02 | 0.07 | -28.50 | 0.34 | -0.06 | 4.50 | 0.00 | 0.38 | 0.00 | 0.26 |
| SEQID-02889 | 0.05 | 0.02 | 0.03 | 0.02 | 0.02 | 0.00 | 0.03 | 0.05 | -30.76 | 0.15 | 0.22 | 11.99 | 0.21 | 0.31 | 0.21 | 0.23 |
| SEQID-02890 | 0.03 | 0.06 | 0.03 | 0.05 | 0.06 | 0.03 | 0.03 | 0.13 | -17.01 | 0.60 | -0.01 | 6.50 | 0.27 | 0.32 | 0.00 | 0.00 |
| SEQID-02891 | 0.01 | 0.10 | 0.05 | 0.05 | 0.04 | 0.01 | 0.04 | 0.08 | -18.28 | 0.49 | -0.02 | 5.59 | 0.23 | 0.34 | 0.22 | 0.24 |
| SEQID-02892 | 0.02 | 0.05 | 0.05 | 0.07 | 0.03 | 0.05 | 0.06 | 0.09 | -22.47 | 0.39 | -0.03 | 10.89 | 0.22 | 0.33 | 0.00 | 0.23 |
| SEQID-02893 | 0.02 | 0.09 | 0.04 | 0.04 | 0.06 | 0.03 | 0.07 | 0.08 | -11.49 | 0.93 | 0.01 | 8.30 | 0.20 | 0.33 | 0.21 | 0.23 |
| SEQID-02894 | 0.01 | 0.06 | 0.05 | 0.05 | 0.04 | 0.01 | 0.05 | 0.03 | -19.70 | 0.42 | -0.01 | 6.07 | 0.75 | 0.85 | 0.00 | 0.00 |
| SEQID-02895 | 0.01 | 0.03 | 0.05 | 0.05 | 0.05 | 0.03 | 0.05 | 0.05 | -21.54 | 0.35 | -0.01 | 6.12 | 0.22 | 0.33 | 0.00 | 0.00 |
| SEQID-02896 | 0.04 | 0.05 | 0.06 | 0.04 | 0.05 | 0.01 | 0.07 | 0.07 | -20.51 | 0.34 | -0.01 | 6.96 | 0.19 | 0.33 | 0.20 | 0.23 |
| SEQID-02897 | 0.02 | 0.03 | 0.06 | 0.05 | 0.04 | 0.04 | 0.06 | 0.06 | -18.54 | 0.42 | 0.00 | 6.73 | 0.00 | 0.36 | 0.00 | 0.23 |
| SEQID-02898 | 0.03 | 0.05 | 0.03 | 0.03 | 0.05 | 0.02 | 0.05 | 0.07 | -24.52 | 0.30 | 0.13 | 10.89 | 0.66 | 0.75 | 0.22 | 0.21 |
| SEQID-02899 | 0.04 | 0.05 | 0.05 | 0.07 | 0.04 | 0.01 | 0.02 | 0.09 | -17.42 | 0.63 | 0.00 | 7.36 | 0.22 | 0.34 | 0.00 | 0.22 |
| SEQID-02900 | 0.03 | 0.04 | 0.09 | 0.07 | 0.05 | 0.00 | 0.06 | 0.07 | -20.10 | 0.43 | 0.02 | 9.93 | 0.21 | 0.36 | 0.00 | 0.23 |
| SEQID-02901 | 0.03 | 0.05 | 0.03 | 0.07 | 0.05 | 0.01 | 0.03 | 0.09 | -19.38 | 0.56 | 0.00 | 7.33 | 0.23 | 0.33 | 0.22 | 0.22 |
| SEQID-02902 | 0.04 | 0.06 | 0.06 | 0.07 | 0.04 | 0.00 | 0.06 | 0.09 | -21.33 | 0.44 | -0.02 | 5.43 | 0.21 | 0.33 | 0.00 | 0.21 |
| SEQID-02903 | 0.02 | 0.10 | 0.04 | 0.06 | 0.06 | 0.03 | 0.05 | 0.06 | -18.75 | 0.41 | -0.02 | 5.54 | 0.21 | 0.35 | 0.20 | 0.21 |
| SEQID-02904 | 0.01 | 0.03 | 0.03 | 0.03 | 0.04 | 0.01 | 0.04 | 0.05 | -14.76 | 0.16 | -0.01 | 6.40 | 0.22 | 0.46 | 0.22 | 0.23 |
| SEQID-02905 | 0.03 | 0.06 | 0.06 | 0.04 | 0.06 | 0.02 | 0.03 | 0.09 | -16.86 | 0.58 | -0.01 | 6.30 | 0.21 | 0.33 | 0.00 | 0.22 |
| SEQID-02906 | 0.03 | 0.05 | 0.04 | 0.05 | 0.06 | 0.01 | 0.05 | 0.06 | -17.48 | 0.43 | 0.01 | 7.80 | 0.21 | 0.33 | 0.20 | 0.22 |
| SEQID-02907 | 0.02 | 0.05 | 0.05 | 0.06 | 0.05 | 0.02 | 0.05 | 0.07 | -19.25 | 0.37 | 0.00 | 7.77 | 0.20 | 0.31 | 0.00 | 0.21 |
| SEQID-02908 | 0.03 | 0.06 | 0.03 | 0.04 | 0.04 | 0.01 | 0.04 | 0.05 | -27.98 | 0.32 | -0.04 | 4.71 | 0.66 | 0.40 | 0.22 | 0.21 |
| SEQID-02909 | 0.01 | 0.06 | 0.28 | 0.09 | 0.02 | 0.00 | 0.06 | 0.05 | -10.68 | 0.33 | -0.01 | 6.22 | 0.22 | 0.36 | 0.00 | 0.23 |
| SEQID-02910 | 0.01 | 0.01 | 0.01 | 0.07 | 0.05 | 0.00 | 0.00 | 0.13 | -28.57 | 0.28 | -0.15 | 3.96 | 0.20 | 0.33 | 0.00 | 0.20 |
| SEQID-02911 | 0.04 | 0.04 | 0.04 | 0.06 | 0.04 | 0.03 | 0.03 | 0.05 | -19.16 | 0.55 | -0.05 | 4.51 | 0.19 | 0.35 | 0.20 | 0.21 |
| SEQID-02912 | 0.01 | 0.05 | 0.03 | 0.06 | 0.07 | 0.01 | 0.05 | 0.05 | -24.87 | 0.26 | -0.06 | 4.92 | 0.34 | 0.46 | 0.22 | 0.23 |
| SEQID-02913 | 0.02 | 0.04 | 0.03 | 0.06 | 0.06 | 0.00 | 0.04 | 0.07 | -23.29 | 0.37 | -0.03 | 5.87 | 0.22 | 0.28 | 0.00 | 0.20 |
| SEQID-02914 | 0.05 | 0.05 | 0.06 | 0.05 | 0.07 | 0.04 | 0.07 | 0.05 | -17.27 | 0.37 | 0.04 | 9.15 | 0.25 | 0.29 | 0.00 | 0.23 |
| SEQID-02915 | 0.04 | 0.09 | 0.04 | 0.06 | 0.07 | 0.02 | 0.02 | 0.07 | -18.33 | 0.49 | 0.03 | 9.69 | 0.58 | 0.31 | 0.00 | 0.25 |
| SEQID-02916 | 0.02 | 0.04 | 0.05 | 0.05 | 0.03 | 0.02 | 0.01 | 0.06 | -29.07 | 0.23 | 0.01 | 8.19 | 0.24 | 0.35 | 0.20 | 0.24 |
| SEQID-02917 | 0.01 | 0.09 | 0.07 | 0.06 | 0.11 | 0.02 | 0.05 | 0.02 | -14.45 | 0.36 | -0.01 | 4.89 | 0.76 | 0.39 | 0.21 | 0.54 |
| SEQID-02918 | 0.03 | 0.03 | 0.04 | 0.07 | 0.05 | 0.01 | 0.04 | 0.06 | -19.39 | 0.45 | -0.07 | 4.26 | 0.00 | 0.31 | 0.00 | 0.20 |

TABLE 1-continued

| | | | | | | | | | | | | | | |
|---|---|---|---|---|---|---|---|---|---|---|---|---|---|---|
| SEQID-02919 | 0.02 | 0.02 | 0.03 | 0.07 | 0.05 | 0.02 | 0.05 | 0.09 | -23.16 | 0.51 | -0.07 | 4.38 | 0.37 | 0.57 | 0.00 | 0.00 |
| SEQID-02920 | 0.01 | 0.07 | 0.03 | 0.12 | 0.03 | 0.00 | 0.11 | 0.05 | -14.97 | 0.20 | -0.03 | 4.47 | 0.26 | 0.49 | 0.26 | 0.27 |
| SEQID-02921 | 0.04 | 0.06 | 0.05 | 0.05 | 0.06 | 0.01 | 0.05 | 0.09 | -18.77 | 0.48 | -0.04 | 5.01 | 0.19 | 0.31 | 0.00 | 0.22 |
| SEQID-02922 | 0.01 | 0.02 | 0.10 | 0.04 | 0.03 | 0.02 | 0.10 | 0.08 | -20.10 | 0.34 | -0.05 | 4.42 | 0.24 | 0.38 | 0.23 | 0.26 |
| SEQID-02923 | 0.03 | 0.07 | 0.03 | 0.05 | 0.05 | 0.03 | 0.04 | 0.07 | -20.52 | 0.39 | 0.00 | 7.13 | 0.22 | 0.31 | 0.00 | 0.31 |
| SEQID-02924 | 0.01 | 0.07 | 0.05 | 0.07 | 0.09 | 0.00 | 0.04 | 0.06 | -19.54 | 0.35 | 0.00 | 6.12 | 0.23 | 0.33 | 0.20 | 0.23 |
| SEQID-02925 | 0.01 | 0.03 | 0.02 | 0.08 | 0.07 | 0.06 | 0.04 | 0.07 | -19.59 | 0.44 | 0.01 | 7.81 | 0.21 | 0.31 | 0.00 | 0.00 |
| SEQID-02926 | 0.03 | 0.03 | 0.04 | 0.06 | 0.08 | 0.06 | 0.04 | 0.09 | -19.09 | 0.55 | 0.01 | 6.17 | 0.22 | 0.32 | 0.00 | 0.19 |
| SEQID-02927 | 0.04 | 0.03 | 0.04 | 0.03 | 0.04 | 0.03 | 0.05 | 0.07 | -18.99 | 0.43 | 0.01 | 7.43 | 0.21 | 0.31 | 0.00 | 0.19 |
| SEQID-02928 | 0.03 | 0.09 | 0.02 | 0.07 | 0.03 | 0.02 | 0.05 | 0.06 | -16.20 | 0.47 | 0.06 | 10.25 | 0.22 | 0.31 | 0.21 | 0.21 |
| SEQID-02929 | 0.02 | 0.07 | 0.05 | 0.06 | 0.03 | 0.03 | 0.09 | 0.04 | -15.04 | 0.41 | 0.00 | 7.03 | 0.46 | 0.69 | 0.18 | 0.20 |
| SEQID-02930 | 0.04 | 0.07 | 0.03 | 0.05 | 0.03 | 0.03 | 0.05 | 0.05 | -20.89 | 0.33 | -0.01 | 6.44 | 0.21 | 0.32 | 0.00 | 0.71 |
| SEQID-02931 | 0.03 | 0.04 | 0.02 | 0.04 | 0.04 | 0.00 | 0.02 | 0.09 | -20.45 | 0.50 | -0.01 | 5.86 | 0.24 | 0.33 | 0.00 | 0.19 |
| SEQID-02932 | 0.03 | 0.06 | 0.05 | 0.05 | 0.03 | 0.07 | 0.04 | 0.05 | -21.27 | 0.39 | -0.04 | 4.86 | 0.21 | 0.32 | 0.00 | 0.20 |
| SEQID-02933 | 0.03 | 0.06 | 0.04 | 0.06 | 0.06 | 0.03 | 0.07 | 0.05 | -19.56 | 0.32 | -0.01 | 5.95 | 0.22 | 0.33 | 0.00 | 0.20 |
| SEQID-02934 | 0.02 | 0.05 | 0.03 | 0.04 | 0.05 | 0.00 | 0.04 | 0.05 | -22.41 | 0.31 | -0.04 | 4.85 | 0.21 | 0.30 | 0.00 | 0.20 |
| SEQID-02935 | 0.01 | 0.05 | 0.05 | 0.07 | 0.04 | 0.02 | 0.04 | 0.06 | -20.31 | 0.35 | -0.01 | 6.72 | 0.20 | 0.31 | 0.19 | 0.22 |
| SEQID-02936 | 0.03 | 0.06 | 0.04 | 0.06 | 0.05 | 0.01 | 0.06 | 0.09 | -19.63 | 0.38 | -0.05 | 4.64 | 0.82 | 0.90 | 0.20 | 0.21 |
| SEQID-02937 | 0.02 | 0.05 | 0.06 | 0.06 | 0.06 | 0.01 | 0.05 | 0.05 | -19.29 | 0.30 | -0.01 | 5.88 | 0.19 | 0.31 | 0.18 | 0.20 |
| SEQID-02938 | 0.04 | 0.06 | 0.04 | 0.08 | 0.04 | 0.01 | 0.07 | 0.07 | -18.49 | 0.41 | -0.01 | 6.29 | 0.21 | 0.33 | 0.21 | 0.22 |
| SEQID-02939 | 0.02 | 0.06 | 0.04 | 0.03 | 0.06 | 0.03 | 0.05 | 0.06 | -19.69 | 0.38 | 0.00 | 6.79 | 0.20 | 0.33 | 0.18 | 0.22 |
| SEQID-02940 | 0.03 | 0.04 | 0.04 | 0.05 | 0.05 | 0.01 | 0.05 | 0.07 | -18.93 | 0.42 | 0.00 | 7.40 | 0.21 | 0.34 | 0.19 | 0.21 |
| SEQID-02941 | 0.03 | 0.05 | 0.03 | 0.04 | 0.03 | 0.03 | 0.04 | 0.06 | -20.20 | 0.55 | -0.02 | 6.29 | 0.20 | 0.34 | 0.19 | 0.20 |
| SEQID-02942 | 0.02 | 0.06 | 0.04 | 0.06 | 0.05 | 0.03 | 0.05 | 0.07 | -17.95 | 0.49 | 0.00 | 7.37 | 0.21 | 0.35 | 0.00 | 0.21 |
| SEQID-02943 | 0.04 | 0.05 | 0.05 | 0.03 | 0.06 | 0.02 | 0.05 | 0.07 | -19.44 | 0.39 | -0.02 | 5.02 | 0.20 | 0.33 | 0.00 | 0.22 |
| SEQID-02944 | 0.02 | 0.06 | 0.04 | 0.05 | 0.04 | 0.01 | 0.05 | 0.07 | -21.66 | 0.38 | -0.01 | 6.19 | 0.21 | 0.33 | 0.00 | 0.20 |
| SEQID-02945 | 0.02 | 0.05 | 0.06 | 0.09 | 0.06 | 0.03 | 0.05 | 0.07 | -17.43 | 0.38 | -0.03 | 4.85 | 0.18 | 0.40 | 0.19 | 0.19 |
| SEQID-02946 | 0.01 | 0.01 | 0.00 | 0.07 | 0.04 | 0.00 | 0.01 | 0.05 | -28.23 | 0.22 | -0.09 | 4.43 | 0.21 | 0.40 | 0.19 | 0.18 |
| SEQID-02947 | 0.02 | 0.07 | 0.06 | 0.07 | 0.03 | 0.02 | 0.06 | 0.10 | -17.49 | 0.42 | 0.01 | 8.20 | 0.29 | 0.36 | 0.21 | 0.25 |
| SEQID-02948 | 0.05 | 0.03 | 0.05 | 0.02 | 0.07 | 0.03 | 0.06 | 0.04 | -15.48 | 0.46 | -0.05 | 4.33 | 0.90 | 0.94 | 0.25 | 0.26 |
| SEQID-02949 | 0.01 | 0.07 | 0.04 | 0.05 | 0.05 | 0.01 | 0.03 | 0.09 | -19.80 | 0.54 | -0.03 | 4.97 | 0.40 | 0.50 | 0.20 | 0.24 |
| SEQID-02950 | 0.06 | 0.03 | 0.06 | 0.03 | 0.06 | 0.02 | 0.04 | 0.06 | -20.78 | 0.34 | -0.04 | 4.59 | 0.19 | 0.30 | 0.21 | 0.21 |
| SEQID-02951 | 0.06 | 0.08 | 0.02 | 0.03 | 0.03 | 0.00 | 0.04 | 0.08 | -17.44 | 0.49 | 0.04 | 9.84 | 0.20 | 0.28 | 0.00 | 0.21 |
| SEQID-02952 | 0.04 | 0.05 | 0.03 | 0.05 | 0.04 | 0.01 | 0.08 | 0.07 | -19.06 | 0.55 | -0.01 | 6.24 | 0.25 | 0.32 | 0.00 | 0.24 |
| SEQID-02953 | 0.04 | 0.05 | 0.06 | 0.06 | 0.01 | 0.03 | 0.06 | 0.05 | -22.91 | 0.40 | -0.02 | 5.85 | 0.23 | 0.32 | 0.21 | 0.21 |
| SEQID-02954 | 0.02 | 0.02 | 0.04 | 0.04 | 0.03 | 0.05 | 0.09 | 0.06 | -25.46 | 0.19 | 0.21 | 11.95 | 0.21 | 0.31 | 0.00 | 0.20 |
| SEQID-02955 | 0.01 | 0.08 | 0.03 | 0.06 | 0.06 | 0.01 | 0.02 | 0.10 | -19.22 | 0.48 | -0.02 | 5.00 | 0.23 | 0.34 | 0.00 | 0.00 |
| SEQID-02956 | 0.04 | 0.04 | 0.05 | 0.07 | 0.03 | 0.02 | 0.09 | 0.05 | -17.31 | 0.47 | 0.00 | 7.36 | 0.19 | 0.30 | 0.21 | 0.22 |
| SEQID-02957 | 0.02 | 0.06 | 0.04 | 0.04 | 0.05 | 0.03 | 0.06 | 0.07 | -17.40 | 0.53 | -0.01 | 6.15 | 0.00 | 0.35 | 0.00 | 0.25 |
| SEQID-02958 | 0.03 | 0.07 | 0.06 | 0.03 | 0.04 | 0.04 | 0.04 | 0.11 | -19.49 | 0.49 | -0.03 | 4.99 | 0.20 | 0.33 | 0.00 | 0.24 |
| SEQID-02959 | 0.04 | 0.07 | 0.04 | 0.04 | 0.01 | 0.05 | 0.06 | 0.05 | -23.42 | 0.35 | -0.02 | 5.65 | 0.54 | 0.65 | 0.20 | 0.22 |
| SEQID-02960 | 0.02 | 0.05 | 0.03 | 0.05 | 0.04 | 0.00 | 0.03 | 0.05 | -27.13 | 0.26 | 0.15 | 11.29 | 0.22 | 0.33 | 0.21 | 0.19 |
| SEQID-02961 | 0.02 | 0.07 | 0.05 | 0.05 | 0.03 | 0.02 | 0.04 | 0.06 | -21.97 | 0.48 | -0.03 | 4.82 | 0.21 | 0.31 | 0.00 | 0.23 |
| SEQID-02962 | 0.01 | 0.07 | 0.04 | 0.04 | 0.04 | 0.03 | 0.03 | 0.06 | -18.34 | 0.73 | 0.02 | 8.87 | 0.23 | 0.31 | 0.23 | 0.00 |
| SEQID-02963 | 0.03 | 0.08 | 0.03 | 0.06 | 0.06 | 0.05 | 0.06 | 0.06 | -11.63 | 0.39 | 0.03 | 6.84 | 0.29 | 0.37 | 0.00 | 0.19 |
| SEQID-02964 | 0.05 | 0.09 | 0.05 | 0.07 | 0.03 | 0.02 | 0.05 | 0.06 | -17.63 | 0.47 | -0.01 | 6.39 | 0.22 | 0.33 | 0.00 | 0.24 |
| SEQID-02965 | 0.02 | 0.03 | 0.05 | 0.04 | 0.06 | 0.06 | 0.06 | 0.09 | -19.23 | 0.41 | -0.03 | 5.74 | 0.21 | 0.34 | 0.21 | 0.18 |
| SEQID-02966 | 0.03 | 0.05 | 0.04 | 0.03 | 0.03 | 0.01 | 0.03 | 0.07 | -27.55 | 0.31 | 0.00 | 6.78 | 0.21 | 0.31 | 0.00 | 0.20 |
| SEQID-02967 | 0.01 | 0.05 | 0.01 | 0.04 | 0.04 | 0.02 | 0.06 | 0.04 | -24.79 | 0.29 | -0.04 | 4.81 | 0.23 | 0.32 | 0.00 | 0.00 |
| SEQID-02968 | 0.03 | 0.08 | 0.05 | 0.06 | 0.04 | 0.03 | 0.03 | 0.04 | -17.45 | 0.36 | 0.00 | 6.84 | 0.21 | 0.34 | 0.21 | 0.00 |
| SEQID-02969 | 0.02 | 0.07 | 0.06 | 0.06 | 0.03 | 0.04 | 0.05 | 0.09 | -20.02 | 0.45 | -0.04 | 5.20 | 0.22 | 0.33 | 0.00 | 0.00 |
| SEQID-02970 | 0.02 | 0.06 | 0.04 | 0.04 | 0.05 | 0.01 | 0.04 | 0.06 | -21.16 | 0.42 | 0.10 | 10.87 | 0.19 | 0.31 | 0.00 | 0.19 |
| SEQID-02971 | 0.03 | 0.07 | 0.05 | 0.05 | 0.04 | 0.03 | 0.03 | 0.05 | -22.23 | 0.31 | -0.01 | 6.60 | 0.23 | 0.31 | 0.00 | 0.21 |

TABLE 1-continued

| | | | | | | | | | | | | | | | |
|---|---|---|---|---|---|---|---|---|---|---|---|---|---|---|---|
| SEQID-02972 | 0.03 | 0.07 | 0.06 | 0.05 | 0.02 | 0.03 | 0.05 | 0.07 | −18.72 | 0.44 | −0.01 | 6.56 | 0.22 | 0.30 | 0.00 | 0.00 |
| SEQID-02973 | 0.03 | 0.06 | 0.04 | 0.04 | 0.04 | 0.03 | 0.06 | 0.07 | −19.70 | 0.48 | −0.02 | 5.27 | 0.19 | 0.31 | 0.00 | 0.21 |
| SEQID-02974 | 0.02 | 0.07 | 0.06 | 0.05 | 0.07 | 0.03 | 0.05 | 0.05 | −16.20 | 0.43 | 0.00 | 6.87 | 0.32 | 0.56 | 0.00 | 0.21 |
| SEQID-02975 | 0.02 | 0.08 | 0.05 | 0.07 | 0.04 | 0.03 | 0.03 | 0.09 | −17.95 | 0.53 | −0.02 | 5.26 | 0.27 | 0.43 | 0.00 | 0.23 |
| SEQID-02976 | 0.04 | 0.07 | 0.04 | 0.05 | 0.02 | 0.02 | 0.04 | 0.06 | −22.45 | 0.37 | −0.01 | 6.32 | 0.22 | 0.31 | 0.00 | 0.00 |
| SEQID-02977 | 0.02 | 0.09 | 0.06 | 0.08 | 0.06 | 0.01 | 0.03 | 0.03 | −16.20 | 0.41 | 0.03 | 8.98 | 0.19 | 0.39 | 0.00 | 0.21 |
| SEQID-02978 | 0.02 | 0.10 | 0.07 | 0.06 | 0.05 | 0.01 | 0.03 | 0.06 | −16.32 | 0.50 | 0.01 | 7.98 | 0.22 | 0.31 | 0.00 | 0.18 |
| SEQID-02979 | 0.03 | 0.06 | 0.05 | 0.04 | 0.05 | 0.01 | 0.01 | 0.08 | −15.90 | 0.61 | −0.02 | 5.54 | 0.21 | 0.33 | 0.00 | 0.22 |
| SEQID-02980 | 0.02 | 0.08 | 0.06 | 0.06 | 0.03 | 0.04 | 0.04 | 0.03 | −19.54 | 0.34 | −0.02 | 6.05 | 0.22 | 0.36 | 0.00 | 0.20 |
| SEQID-02981 | 0.01 | 0.08 | 0.04 | 0.04 | 0.03 | 0.02 | 0.03 | 0.06 | −23.94 | 0.40 | −0.01 | 6.61 | 0.21 | 0.32 | 0.00 | 0.21 |
| SEQID-02982 | 0.04 | 0.04 | 0.05 | 0.05 | 0.03 | 0.03 | 0.06 | 0.09 | −17.80 | 0.47 | 0.00 | 6.52 | 0.22 | 0.32 | 0.00 | 0.22 |
| SEQID-02983 | 0.02 | 0.06 | 0.04 | 0.03 | 0.06 | 0.02 | 0.03 | 0.07 | −21.58 | 0.39 | −0.02 | 5.91 | 0.22 | 0.33 | 0.00 | 0.20 |
| SEQID-02984 | 0.03 | 0.05 | 0.04 | 0.04 | 0.04 | 0.00 | 0.04 | 0.05 | −24.33 | 0.21 | −0.01 | 5.95 | 0.22 | 0.33 | 0.00 | 0.22 |
| SEQID-02985 | 0.03 | 0.04 | 0.05 | 0.06 | 0.06 | 0.00 | 0.02 | 0.06 | −25.10 | 0.40 | −0.04 | 4.72 | 0.22 | 0.33 | 0.00 | 0.22 |
| SEQID-02986 | 0.02 | 0.06 | 0.06 | 0.09 | 0.09 | 0.02 | 0.05 | 0.04 | −19.85 | 0.35 | 0.00 | 7.65 | 0.22 | 0.35 | 0.21 | 0.23 |
| SEQID-02987 | 0.03 | 0.07 | 0.02 | 0.05 | 0.05 | 0.01 | 0.04 | 0.05 | −22.33 | 0.36 | −0.02 | 5.27 | 0.21 | 0.33 | 0.00 | 0.21 |
| SEQID-02988 | 0.03 | 0.07 | 0.06 | 0.04 | 0.03 | 0.33 | 0.05 | 0.06 | −22.46 | 0.33 | 0.02 | 8.89 | 0.22 | 0.35 | 0.19 | 0.22 |
| SEQID-02989 | 0.04 | 0.04 | 0.09 | 0.07 | 0.05 | 0.03 | 0.07 | 0.05 | −14.73 | 0.27 | −0.01 | 5.49 | 0.24 | 0.45 | 0.21 | 0.21 |
| SEQID-02990 | 0.02 | 0.09 | 0.04 | 0.05 | 0.05 | 0.03 | 0.02 | 0.04 | −21.06 | 0.34 | −0.02 | 6.17 | 0.21 | 0.32 | 0.20 | 0.21 |
| SEQID-02991 | 0.03 | 0.07 | 0.06 | 0.06 | 0.04 | 0.03 | 0.02 | 0.06 | −21.11 | 0.38 | 0.00 | 7.00 | 0.22 | 0.33 | 0.20 | 0.71 |
| SEQID-02992 | 0.03 | 0.04 | 0.04 | 0.04 | 0.04 | 0.02 | 0.06 | 0.07 | −20.54 | 0.41 | 0.01 | 7.74 | 0.21 | 0.32 | 0.00 | 0.22 |
| SEQID-02993 | 0.04 | 0.05 | 0.05 | 0.06 | 0.06 | 0.01 | 0.04 | 0.06 | −20.34 | 0.41 | 0.03 | 9.69 | 0.21 | 0.31 | 0.00 | 0.20 |
| SEQID-02994 | 0.02 | 0.06 | 0.05 | 0.06 | 0.06 | 0.03 | 0.03 | 0.06 | −14.67 | 0.58 | 0.00 | 7.11 | 0.22 | 0.33 | 0.00 | 0.22 |
| SEQID-02995 | 0.03 | 0.04 | 0.04 | 0.04 | 0.05 | 0.02 | 0.02 | 0.09 | −16.75 | 0.60 | −0.03 | 4.83 | 0.20 | 0.33 | 0.19 | 0.22 |
| SEQID-02996 | 0.03 | 0.05 | 0.05 | 0.05 | 0.03 | 0.01 | 0.01 | 0.07 | −19.38 | 0.11 | −0.01 | 6.00 | 0.28 | 0.41 | 0.20 | 0.24 |
| SEQID-02997 | 0.02 | 0.01 | 0.12 | 0.09 | 0.06 | 0.01 | 0.10 | 0.03 | −11.88 | 0.45 | −0.02 | 6.09 | 0.19 | 0.32 | 0.00 | 0.21 |
| SEQID-02998 | 0.03 | 0.06 | 0.03 | 0.07 | 0.04 | 0.00 | 0.03 | 0.06 | −20.23 | 0.63 | −0.01 | 7.14 | 0.20 | 0.35 | 0.00 | 0.21 |
| SEQID-02999 | 0.02 | 0.09 | 0.04 | 0.05 | 0.05 | 0.07 | 0.05 | 0.04 | −12.06 | 0.31 | −0.04 | 5.06 | 0.19 | 0.32 | 0.00 | 0.21 |
| SEQID-03000 | 0.03 | 0.07 | 0.06 | 0.04 | 0.04 | 0.03 | 0.04 | 0.06 | −21.11 | 0.26 | −0.02 | 5.67 | 0.22 | 0.37 | 0.19 | 0.22 |
| SEQID-03001 | 0.04 | 0.03 | 0.07 | 0.03 | 0.04 | 0.00 | 0.05 | 0.07 | −15.56 | 0.47 | −0.03 | 5.03 | 0.19 | 0.32 | 0.00 | 0.20 |
| SEQID-03002 | 0.02 | 0.07 | 0.03 | 0.06 | 0.05 | 0.03 | 0.06 | 0.06 | −19.76 | 0.39 | −0.04 | 4.80 | 0.19 | 0.33 | 0.00 | 0.20 |
| SEQID-03003 | 0.03 | 0.05 | 0.04 | 0.05 | 0.05 | 0.03 | 0.04 | 0.06 | −20.82 | 0.57 | −0.04 | 5.64 | 0.19 | 0.32 | 0.19 | 0.20 |
| SEQID-03004 | 0.03 | 0.03 | 0.05 | 0.06 | 0.05 | 0.01 | 0.04 | 0.07 | −19.78 | 0.42 | −0.01 | 4.91 | 0.19 | 0.34 | 0.00 | 0.20 |
| SEQID-03005 | 0.02 | 0.09 | 0.04 | 0.06 | 0.04 | 0.02 | 0.04 | 0.06 | −20.40 | 0.26 | −0.03 | 5.83 | 0.19 | 0.32 | 0.19 | 0.19 |
| SEQID-03006 | 0.03 | 0.07 | 0.04 | 0.04 | 0.04 | 0.02 | 0.07 | 0.06 | −24.11 | 0.41 | −0.02 | 6.63 | 0.56 | 0.74 | 0.13 | 0.22 |
| SEQID-03007 | 0.01 | 0.08 | 0.04 | 0.06 | 0.09 | 0.01 | 0.04 | 0.04 | −31.51 | 0.55 | −0.01 | 6.35 | 0.50 | 0.91 | 0.19 | 0.22 |
| SEQID-03008 | 0.01 | 0.07 | 0.04 | 0.03 | 0.02 | 0.00 | 0.01 | 0.07 | −33.03 | 0.43 | −0.01 | 6.37 | 0.86 | 0.98 | 0.00 | 0.20 |
| SEQID-03009 | 0.02 | 0.06 | 0.04 | 0.04 | 0.05 | 0.03 | 0.06 | 0.10 | −30.05 | 0.29 | 0.00 | 8.37 | 0.21 | 0.30 | 0.00 | 0.00 |
| SEQID-03010 | 0.02 | 0.11 | 0.03 | 0.05 | 0.06 | 0.01 | 0.11 | 0.07 | −20.47 | 0.49 | 0.01 | 5.21 | 0.68 | 0.78 | 0.24 | 0.28 |
| SEQID-03011 | 0.03 | 0.11 | 0.05 | 0.05 | 0.03 | 0.01 | 0.03 | 0.03 | −19.04 | 0.39 | −0.02 | 9.63 | 0.22 | 0.35 | 0.00 | 0.22 |
| SEQID-03012 | 0.05 | 0.04 | 0.06 | 0.06 | 0.04 | 0.04 | 0.04 | 0.09 | −21.63 | 0.44 | 0.03 | 5.16 | 0.20 | 0.33 | 0.00 | 0.19 |
| SEQID-03013 | 0.02 | 0.06 | 0.03 | 0.05 | 0.05 | 0.04 | 0.04 | 0.06 | −19.72 | 0.45 | −0.03 | 4.56 | 0.22 | 0.30 | 0.23 | 0.22 |
| SEQID-03014 | 0.01 | 0.03 | 0.04 | 0.05 | 0.06 | 0.01 | 0.05 | 0.07 | −25.34 | 0.43 | −0.06 | 6.64 | 0.31 | 0.32 | 0.00 | 0.21 |
| SEQID-03015 | 0.03 | 0.04 | 0.04 | 0.07 | 0.04 | 0.01 | 0.01 | 0.07 | −18.24 | 0.43 | 0.00 | 6.94 | 0.21 | 0.32 | 0.00 | 0.22 |
| SEQID-03016 | 0.01 | 0.06 | 0.04 | 0.04 | 0.03 | 0.01 | 0.06 | 0.10 | −18.93 | 0.53 | −0.02 | 5.04 | 0.83 | 0.93 | 0.19 | 0.20 |
| SEQID-03017 | 0.04 | 0.06 | 0.03 | 0.05 | 0.06 | 0.01 | 0.07 | 0.07 | −19.58 | 0.44 | −0.02 | 5.82 | 0.21 | 0.32 | 0.00 | 0.21 |
| SEQID-03018 | 0.02 | 0.06 | 0.05 | 0.06 | 0.03 | 0.03 | 0.05 | 0.06 | −21.13 | 0.36 | −0.01 | 6.46 | 0.20 | 0.31 | 0.00 | 0.22 |
| SEQID-03019 | 0.02 | 0.10 | 0.06 | 0.04 | 0.04 | 0.01 | 0.01 | 0.08 | −20.23 | 0.29 | 0.03 | 9.63 | 0.25 | 0.96 | 0.25 | 0.29 |
| SEQID-03020 | 0.03 | 0.03 | 0.04 | 0.05 | 0.05 | 0.01 | 0.03 | 0.09 | −17.15 | 0.56 | −0.01 | 6.25 | 0.23 | 0.33 | 0.00 | 0.22 |
| SEQID-03021 | 0.03 | 0.05 | 0.02 | 0.03 | 0.02 | 0.02 | 0.05 | 0.03 | −16.97 | 0.45 | 0.04 | 8.97 | 0.23 | 0.35 | 0.20 | 0.24 |
| SEQID-03022 | 0.03 | 0.04 | 0.03 | 0.06 | 0.04 | 0.01 | 0.06 | 0.04 | −22.71 | 0.32 | −0.06 | 4.42 | 0.20 | 0.32 | 0.00 | 0.00 |
| SEQID-03023 | 0.01 | 0.08 | 0.05 | 0.01 | 0.05 | 0.06 | 0.06 | 0.07 | −24.82 | 0.34 | 0.00 | 6.86 | 0.20 | 0.34 | 0.00 | 0.00 |
| SEQID-03024 | 0.02 | 0.04 | 0.02 | 0.04 | 0.10 | 0.00 | 0.01 | 0.06 | −23.57 | 0.35 | −0.01 | 5.90 | 0.23 | 0.30 | 0.24 | 0.00 |

TABLE 1-continued

| | | | | | | | | | | | | | | | |
|---|---|---|---|---|---|---|---|---|---|---|---|---|---|---|---|
| SEQID-03025 | 0.03 | 0.04 | 0.02 | 0.04 | 0.04 | 0.04 | 0.06 | 0.07 | -24.54 | 0.25 | -0.02 | 6.43 | 0.34 | 0.45 | 0.26 | 0.22 |
| SEQID-03026 | 0.03 | 0.03 | 0.02 | 0.06 | 0.05 | 0.01 | 0.07 | 0.05 | -25.35 | 0.27 | -0.06 | 4.51 | 0.20 | 0.31 | 0.00 | 0.00 |
| SEQID-03027 | 0.01 | 0.04 | 0.05 | 0.06 | 0.05 | 0.04 | 0.06 | 0.05 | -19.12 | 0.36 | -0.02 | 5.88 | 0.21 | 0.33 | 0.19 | 0.21 |
| SEQID-03028 | 0.02 | 0.03 | 0.03 | 0.06 | 0.04 | 0.01 | 0.04 | 0.08 | -21.36 | 0.43 | 0.06 | 10.49 | 0.00 | 0.31 | 0.00 | 0.00 |
| SEQID-03029 | 0.03 | 0.04 | 0.03 | 0.04 | 0.06 | 0.02 | 0.04 | 0.07 | -19.49 | 0.49 | -0.02 | 5.52 | 0.21 | 0.33 | 0.21 | 0.23 |
| SEQID-03030 | 0.02 | 0.09 | 0.03 | 0.04 | 0.05 | 0.01 | 0.02 | 0.05 | -22.57 | 0.60 | 0.00 | 7.12 | 0.34 | 0.32 | 0.33 | 0.29 |
| SEQID-03031 | 0.01 | 0.06 | 0.01 | 0.05 | 0.05 | 0.00 | 0.03 | 0.07 | -24.45 | 0.29 | 0.12 | 10.85 | 0.00 | 0.32 | 0.18 | 0.23 |
| SEQID-03032 | 0.03 | 0.04 | 0.07 | 0.06 | 0.05 | 0.01 | 0.03 | 0.05 | -35.70 | 0.25 | 0.13 | 10.82 | 0.25 | 0.34 | 0.19 | 0.21 |
| SEQID-03033 | 0.02 | 0.04 | 0.05 | 0.03 | 0.06 | 0.00 | 0.08 | 0.09 | -20.37 | 0.36 | -0.03 | 5.31 | 0.69 | 0.32 | 0.00 | 0.00 |
| SEQID-03034 | 0.03 | 0.04 | 0.04 | 0.05 | 0.05 | 0.00 | 0.03 | 0.05 | -17.12 | 0.45 | -0.03 | 4.86 | 0.21 | 0.73 | 0.00 | 0.00 |
| SEQID-03035 | 0.07 | 0.00 | 0.08 | 0.03 | 0.13 | 0.04 | 0.02 | 0.06 | -20.21 | 0.09 | 0.03 | 9.81 | 0.25 | 0.13 | 0.19 | 0.24 |
| SEQID-03036 | 0.04 | 0.03 | 0.04 | 0.04 | 0.00 | 0.00 | 0.06 | 0.12 | -21.66 | 0.60 | 0.03 | 6.08 | 0.21 | 0.34 | 0.27 | 0.22 |
| SEQID-03037 | 0.04 | 0.05 | 0.03 | 0.03 | 0.04 | 0.01 | 0.03 | 0.06 | -19.45 | 0.37 | -0.02 | 5.34 | 0.22 | 0.29 | 0.00 | 0.20 |
| SEQID-03038 | 0.03 | 0.05 | 0.05 | 0.06 | 0.05 | 0.02 | 0.04 | 0.06 | -20.55 | 0.32 | -0.01 | 7.69 | 0.21 | 0.33 | 0.00 | 0.20 |
| SEQID-03039 | 0.02 | 0.07 | 0.01 | 0.04 | 0.06 | 0.00 | 0.02 | 0.03 | -20.98 | 0.57 | 0.01 | 9.26 | 0.37 | 0.32 | 0.00 | 0.20 |
| SEQID-03040 | 0.01 | 0.08 | 0.02 | 0.05 | 0.06 | 0.03 | 0.03 | 0.07 | -16.75 | 0.76 | 0.03 | 3.49 | 0.91 | 0.26 | 0.00 | 0.24 |
| SEQID-03041 | 0.01 | 0.03 | 0.04 | 0.07 | 0.03 | 0.00 | 0.03 | 0.07 | -18.61 | 0.39 | 0.02 | 11.01 | 0.26 | 0.95 | 0.21 | 0.00 |
| SEQID-03042 | 0.04 | 0.03 | 0.01 | 0.04 | 0.13 | 0.00 | 0.01 | 0.01 | -25.65 | 0.04 | 0.09 | 9.76 | 0.23 | 0.30 | 0.25 | 0.25 |
| SEQID-03043 | 0.03 | 0.07 | 0.06 | 0.06 | 0.04 | 0.04 | 0.06 | 0.09 | -17.32 | 0.45 | 0.02 | 9.14 | 0.21 | 0.32 | 0.22 | 0.23 |
| SEQID-03044 | 0.01 | 0.06 | 0.04 | 0.06 | 0.05 | 0.04 | 0.08 | 0.03 | -19.15 | 0.23 | 0.03 | 7.43 | 0.21 | 0.32 | 0.00 | 0.23 |
| SEQID-03045 | 0.01 | 0.08 | 0.05 | 0.04 | 0.07 | 0.03 | 0.10 | 0.06 | -20.02 | 0.37 | 0.00 | 6.24 | 0.21 | 0.33 | 0.00 | 0.21 |
| SEQID-03046 | 0.03 | 0.06 | 0.04 | 0.04 | 0.06 | 0.02 | 0.05 | 0.07 | -23.48 | 0.33 | -0.01 | 10.99 | 0.79 | 0.90 | 0.00 | 0.23 |
| SEQID-03047 | 0.02 | 0.06 | 0.06 | 0.03 | 0.06 | 0.04 | 0.03 | 0.09 | -16.16 | 0.52 | 0.12 | 6.97 | 0.26 | 0.35 | 0.00 | 0.00 |
| SEQID-03048 | 0.02 | 0.06 | 0.05 | 0.06 | 0.07 | 0.01 | 0.03 | 0.09 | -15.02 | 0.50 | 0.01 | 8.45 | 0.35 | 0.45 | 0.00 | 0.20 |
| SEQID-03049 | 0.02 | 0.05 | 0.04 | 0.04 | 0.06 | 0.03 | 0.05 | 0.06 | -22.62 | 0.39 | -0.01 | 5.23 | 0.57 | 0.81 | 0.00 | 0.21 |
| SEQID-03050 | 0.03 | 0.06 | 0.04 | 0.04 | 0.03 | 0.01 | 0.04 | 0.08 | -21.59 | 0.42 | 0.00 | 6.52 | 0.19 | 0.34 | 0.00 | 0.21 |
| SEQID-03051 | 0.00 | 0.05 | 0.03 | 0.07 | 0.09 | 0.02 | 0.04 | 0.09 | -17.58 | 0.35 | 0.02 | 9.31 | 0.21 | 0.32 | 0.00 | 0.00 |
| SEQID-03052 | 0.03 | 0.05 | 0.05 | 0.05 | 0.04 | 0.04 | 0.08 | 0.06 | -20.46 | 0.29 | 0.00 | 7.34 | 0.20 | 0.31 | 0.00 | 0.21 |
| SEQID-03053 | 0.03 | 0.04 | 0.04 | 0.06 | 0.05 | 0.01 | 0.04 | 0.07 | -18.67 | 0.44 | 0.02 | 9.52 | 0.22 | 0.33 | 0.00 | 0.22 |
| SEQID-03054 | 0.02 | 0.04 | 0.04 | 0.06 | 0.05 | 0.02 | 0.05 | 0.09 | -19.24 | 0.43 | -0.01 | 5.92 | 0.19 | 0.34 | 0.19 | 0.20 |
| SEQID-03055 | 0.03 | 0.05 | 0.04 | 0.05 | 0.06 | 0.01 | 0.04 | 0.09 | -19.08 | 0.41 | 0.00 | 6.72 | 0.19 | 0.32 | 0.20 | 0.20 |
| SEQID-03056 | 0.01 | 0.04 | 0.03 | 0.04 | 0.05 | 0.03 | 0.05 | 0.09 | -19.53 | 0.43 | 0.01 | 7.61 | 0.00 | 0.34 | 0.00 | 0.21 |
| SEQID-03057 | 0.01 | 0.05 | 0.06 | 0.05 | 0.07 | 0.04 | 0.04 | 0.06 | -19.12 | 0.43 | 0.00 | 6.92 | 0.22 | 0.34 | 0.00 | 0.21 |
| SEQID-03058 | 0.02 | 0.05 | 0.04 | 0.06 | 0.06 | 0.01 | 0.04 | 0.06 | -22.49 | 0.34 | -0.03 | 4.80 | 0.77 | 0.94 | 0.00 | 0.22 |
| SEQID-03059 | 0.02 | 0.05 | 0.04 | 0.05 | 0.05 | 0.02 | 0.04 | 0.07 | -20.31 | 0.50 | 0.00 | 6.69 | 0.19 | 0.32 | 0.00 | 0.21 |
| SEQID-03060 | 0.02 | 0.06 | 0.05 | 0.06 | 0.03 | 0.00 | 0.05 | 0.09 | -22.21 | 0.35 | 0.02 | 9.07 | 0.00 | 0.31 | 0.00 | 0.20 |
| SEQID-03061 | 0.01 | 0.04 | 0.04 | 0.04 | 0.06 | 0.02 | 0.04 | 0.06 | -19.15 | 0.39 | -0.01 | 5.92 | 0.69 | 0.81 | 0.21 | 0.20 |
| SEQID-03062 | 0.04 | 0.07 | 0.04 | 0.04 | 0.03 | 0.02 | 0.04 | 0.07 | -16.48 | 0.42 | 0.01 | 7.99 | 0.52 | 0.66 | 0.21 | 0.22 |
| SEQID-03063 | 0.01 | 0.03 | 0.04 | 0.05 | 0.06 | 0.01 | 0.05 | 0.08 | -20.11 | 0.35 | 0.13 | 11.50 | 0.00 | 0.33 | 0.23 | 0.21 |
| SEQID-03064 | 0.02 | 0.06 | 0.06 | 0.04 | 0.05 | 0.03 | 0.05 | 0.06 | -18.36 | 0.44 | 0.00 | 6.68 | 0.22 | 0.33 | 0.20 | 0.00 |
| SEQID-03065 | 0.03 | 0.05 | 0.04 | 0.04 | 0.06 | 0.02 | 0.05 | 0.08 | -21.98 | 0.43 | 0.03 | 9.72 | 0.21 | 0.33 | 0.20 | 0.21 |
| SEQID-03066 | 0.02 | 0.09 | 0.03 | 0.05 | 0.05 | 0.03 | 0.04 | 0.05 | -18.92 | 0.43 | 0.00 | 6.98 | 0.30 | 0.34 | 0.20 | 0.20 |
| SEQID-03067 | 0.02 | 0.05 | 0.05 | 0.04 | 0.05 | 0.02 | 0.07 | 0.08 | -19.81 | 0.42 | 0.01 | 7.32 | 0.21 | 0.33 | 0.23 | 0.20 |
| SEQID-03068 | 0.02 | 0.06 | 0.02 | 0.06 | 0.04 | 0.02 | 0.05 | 0.06 | -19.97 | 0.37 | -0.02 | 5.11 | 0.20 | 0.35 | 0.00 | 0.21 |
| SEQID-03069 | 0.01 | 0.05 | 0.04 | 0.04 | 0.06 | 0.05 | 0.04 | 0.09 | -19.66 | 0.39 | 0.00 | 6.90 | 0.19 | 0.47 | 0.19 | 0.00 |
| SEQID-03070 | 0.03 | 0.07 | 0.05 | 0.05 | 0.04 | 0.04 | 0.07 | 0.04 | -18.54 | 0.56 | -0.02 | 5.09 | 0.00 | 0.33 | 0.00 | 0.00 |
| SEQID-03071 | 0.01 | 0.07 | 0.03 | 0.04 | 0.04 | 0.01 | 0.07 | 0.11 | -28.05 | 0.24 | 0.01 | 8.70 | 0.23 | 0.85 | 0.00 | 0.21 |
| SEQID-03072 | 0.03 | 0.04 | 0.03 | 0.04 | 0.04 | 0.02 | 0.05 | 0.06 | -18.60 | 0.46 | 0.01 | 7.87 | 0.67 | 0.31 | 0.00 | 0.22 |
| SEQID-03073 | 0.03 | 0.06 | 0.05 | 0.06 | 0.06 | 0.02 | 0.05 | 0.05 | -19.47 | 0.46 | -0.03 | 5.16 | 0.21 | 0.34 | 0.00 | 0.22 |
| SEQID-03074 | 0.02 | 0.05 | 0.04 | 0.04 | 0.05 | 0.03 | 0.06 | 0.04 | -18.35 | 0.42 | -0.01 | 5.93 | 0.21 | 0.32 | 0.22 | 0.21 |
| SEQID-03075 | 0.02 | 0.08 | 0.02 | 0.05 | 0.04 | 0.05 | 0.06 | 0.05 | -21.86 | 0.28 | -0.01 | 6.47 | 0.20 | 0.33 | 0.00 | 0.00 |
| SEQID-03076 | 0.02 | 0.07 | 0.04 | 0.06 | 0.06 | 0.01 | 0.06 | 0.05 | -19.88 | 0.35 | 0.00 | 5.88 | 0.18 | 0.32 | 0.20 | 0.20 |
| SEQID-03077 | 0.02 | 0.05 | 0.05 | 0.05 | 0.02 | 0.01 | 0.04 | 0.07 | -22.48 | 0.31 | 0.15 | 11.36 | 0.21 | 0.33 | 0.24 | 0.00 |

TABLE 1-continued

| | | | | | | | | | | | | | | | | |
|---|---|---|---|---|---|---|---|---|---|---|---|---|---|---|---|---|
| SEQID-03078 | 0.01 | 0.05 | 0.04 | 0.03 | 0.04 | 0.04 | 0.01 | 0.05 | 0.05 | 0.05 | -23.11 | 0.29 | 0.10 | 10.88 | 0.19 | 0.34 | 0.23 | 0.18 |
| SEQID-03079 | 0.01 | 0.04 | 0.05 | 0.05 | 0.05 | 0.02 | 0.02 | 0.02 | 0.09 | 0.05 | -20.31 | 0.40 | 0.12 | 11.80 | 0.00 | 0.34 | 0.00 | 0.22 |
| SEQID-03080 | 0.02 | 0.04 | 0.06 | 0.05 | 0.06 | 0.03 | 0.03 | 0.06 | 0.06 | 0.06 | -19.58 | 0.48 | 0.01 | 3.06 | 0.22 | 0.31 | 0.00 | 0.22 |
| SEQID-03081 | 0.01 | 0.07 | 0.05 | 0.05 | 0.04 | 0.03 | 0.01 | 0.04 | 0.05 | 0.06 | -21.85 | 0.36 | -0.02 | 5.16 | 0.20 | 0.37 | 0.00 | 0.21 |
| SEQID-03082 | 0.03 | 0.05 | 0.03 | 0.05 | 0.05 | 0.01 | 0.01 | 0.06 | 0.04 | 0.05 | -21.22 | 0.37 | 0.01 | 8.03 | 0.27 | 0.34 | 0.00 | 0.21 |
| SEQID-03083 | 0.02 | 0.07 | 0.05 | 0.04 | 0.07 | 0.02 | 0.03 | 0.04 | 0.06 | 0.06 | -18.74 | 0.45 | 0.00 | 7.52 | 0.20 | 0.41 | 0.00 | 0.21 |
| SEQID-03084 | 0.03 | 0.02 | 0.05 | 0.04 | 0.06 | 0.03 | 0.04 | 0.07 | 0.06 | 0.07 | -18.74 | 0.50 | -0.01 | 6.52 | 0.20 | 0.32 | 0.00 | 0.21 |
| SEQID-03085 | 0.02 | 0.06 | 0.05 | 0.04 | 0.07 | 0.01 | 0.01 | 0.04 | 0.06 | 0.05 | -20.33 | 0.31 | 0.00 | 5.48 | 0.47 | 0.31 | 0.00 | 0.21 |
| SEQID-03086 | 0.02 | 0.06 | 0.05 | 0.06 | 0.05 | 0.03 | 0.04 | 0.05 | 0.05 | 0.07 | -20.38 | 0.42 | -0.03 | 7.06 | 0.21 | 0.79 | 0.00 | 0.21 |
| SEQID-03087 | 0.04 | 0.06 | 0.05 | 0.05 | 0.07 | 0.03 | 0.03 | 0.06 | 0.05 | 0.05 | -19.20 | 0.47 | 0.00 | 8.45 | 0.21 | 0.29 | 0.26 | 0.00 |
| SEQID-03088 | 0.01 | 0.03 | 0.02 | 0.03 | 0.05 | 0.02 | 0.02 | 0.02 | 0.06 | 0.06 | -24.99 | 0.26 | 0.01 | 11.41 | 0.22 | 0.31 | 0.22 | 0.23 |
| SEQID-03089 | 0.03 | 0.05 | 0.01 | 0.04 | 0.06 | 0.02 | 0.01 | 0.05 | 0.05 | 0.07 | -23.22 | 0.37 | 0.12 | 10.11 | 0.23 | 0.30 | 0.00 | 0.23 |
| SEQID-03090 | 0.02 | 0.05 | 0.04 | 0.04 | 0.03 | 0.07 | 0.01 | 0.06 | 0.06 | 0.06 | -23.97 | 0.27 | 0.05 | 10.81 | 0.24 | 0.33 | 0.21 | 0.24 |
| SEQID-03091 | 0.04 | 0.02 | 0.02 | 0.06 | 0.06 | 0.06 | 0.01 | 0.05 | 0.05 | 0.05 | -26.20 | 0.23 | 0.13 | 4.33 | 0.22 | 0.33 | 0.18 | 0.20 |
| SEQID-03092 | 0.02 | 0.05 | 0.06 | 0.00 | 0.05 | 0.03 | 0.01 | 0.03 | 0.03 | 0.06 | -21.77 | 0.43 | -0.08 | 11.07 | 0.24 | 0.32 | 0.00 | 0.21 |
| SEQID-03093 | 0.01 | 0.04 | 0.05 | 0.07 | 0.05 | 0.01 | 0.01 | 0.04 | 0.07 | 0.07 | -16.57 | 0.61 | 0.12 | 8.40 | 0.50 | 0.78 | 0.22 | 0.21 |
| SEQID-03094 | 0.03 | 0.03 | 0.02 | 0.04 | 0.06 | 0.02 | 0.02 | 0.04 | 0.06 | 0.11 | -18.75 | 0.45 | 0.01 | 6.56 | 0.22 | 0.33 | 0.00 | 0.22 |
| SEQID-03095 | 0.02 | 0.06 | 0.05 | 0.03 | 0.05 | 0.05 | 0.05 | 0.07 | 0.07 | 0.07 | -19.90 | 0.35 | -0.01 | 4.93 | 0.21 | 0.31 | 0.00 | 0.22 |
| SEQID-03096 | 0.01 | 0.05 | 0.04 | 0.06 | 0.06 | 0.06 | 0.02 | 0.05 | 0.06 | 0.05 | -16.33 | 0.42 | -0.04 | 6.83 | 0.20 | 0.31 | 0.00 | 0.21 |
| SEQID-03097 | 0.02 | 0.04 | 0.04 | 0.05 | 0.07 | 0.00 | 0.02 | 0.06 | 0.05 | 0.04 | -24.94 | 0.30 | 0.00 | 10.64 | 0.19 | 0.31 | 0.00 | 0.26 |
| SEQID-03098 | 0.03 | 0.06 | 0.04 | 0.06 | 0.06 | 0.01 | 0.01 | 0.04 | 0.03 | 0.05 | -23.63 | 0.37 | 0.13 | 10.91 | 0.19 | 0.33 | 0.00 | 0.23 |
| SEQID-03099 | 0.01 | 0.03 | 0.04 | 0.03 | 0.02 | 0.01 | 0.01 | 0.03 | 0.04 | 0.05 | -25.92 | 0.31 | 0.09 | 11.08 | 0.23 | 0.31 | 0.00 | 0.22 |
| SEQID-03100 | 0.03 | 0.05 | 0.05 | 0.04 | 0.05 | 0.02 | 0.04 | 0.02 | 0.05 | 0.05 | -19.28 | 0.44 | 0.10 | 6.29 | 0.27 | 0.39 | 0.24 | 0.21 |
| SEQID-03101 | 0.01 | 0.04 | 0.04 | 0.03 | 0.04 | 0.01 | 0.01 | 0.04 | 0.04 | 0.06 | -27.30 | 0.32 | -0.01 | 11.16 | 0.00 | 0.30 | 0.21 | 0.00 |
| SEQID-03102 | 0.01 | 0.05 | 0.06 | 0.05 | 0.06 | 0.02 | 0.01 | 0.05 | 0.05 | 0.06 | -22.87 | 0.31 | 0.14 | 10.73 | 0.20 | 0.31 | 0.00 | 0.00 |
| SEQID-03103 | 0.04 | 0.09 | 0.02 | 0.07 | 0.04 | 0.02 | 0.02 | 0.08 | 0.07 | 0.07 | -15.74 | 0.53 | 0.09 | 10.38 | 0.00 | 0.35 | 0.00 | 0.21 |
| SEQID-03104 | 0.02 | 0.04 | 0.04 | 0.04 | 0.04 | 0.03 | 0.05 | 0.03 | 0.09 | 0.05 | -21.48 | 0.38 | 0.06 | 8.42 | 0.22 | 0.31 | 0.00 | 0.20 |
| SEQID-03105 | 0.02 | 0.04 | 0.05 | 0.05 | 0.06 | 0.06 | 0.02 | 0.05 | 0.05 | 0.09 | -19.87 | 0.41 | 0.01 | 7.00 | 0.21 | 0.32 | 0.22 | 0.21 |
| SEQID-03106 | 0.01 | 0.05 | 0.05 | 0.05 | 0.07 | 0.01 | 0.04 | 0.05 | 0.06 | 0.07 | -22.28 | 0.37 | 0.00 | 5.36 | 0.54 | 0.74 | 0.00 | 0.20 |
| SEQID-03107 | 0.02 | 0.07 | 0.05 | 0.05 | 0.05 | 0.03 | 0.05 | 0.02 | 0.05 | 0.07 | -16.48 | 0.71 | 0.01 | 8.20 | 0.19 | 0.32 | 0.00 | 0.20 |
| SEQID-03108 | 0.03 | 0.03 | 0.03 | 0.06 | 0.11 | 0.04 | 0.02 | 0.05 | 0.04 | 0.09 | -11.10 | 0.46 | 0.02 | 9.37 | 0.22 | 0.30 | 0.28 | 0.24 |
| SEQID-03109 | 0.01 | 0.02 | 0.02 | 0.03 | 0.03 | 0.02 | 0.01 | 0.03 | 0.02 | 0.06 | -28.09 | 0.25 | -0.03 | 5.14 | 0.21 | 0.30 | 0.25 | 0.23 |
| SEQID-03110 | 0.01 | 0.01 | 0.04 | 0.04 | 0.02 | 0.03 | 0.03 | 0.10 | 0.07 | 0.08 | -25.01 | 0.16 | 0.21 | 11.85 | 0.23 | 0.33 | 0.00 | 0.23 |
| SEQID-03111 | 0.02 | 0.05 | 0.06 | 0.04 | 0.04 | 0.04 | 0.04 | 0.04 | 0.05 | 0.07 | -20.07 | 0.33 | -0.01 | 6.71 | 0.22 | 0.30 | 0.00 | 0.20 |
| SEQID-03112 | 0.01 | 0.05 | 0.04 | 0.04 | 0.06 | 0.05 | 0.02 | 0.05 | 0.05 | 0.07 | -20.65 | 0.42 | 0.00 | 6.93 | 0.21 | 0.35 | 0.20 | 0.22 |
| SEQID-03113 | 0.04 | 0.07 | 0.06 | 0.05 | 0.07 | 0.02 | 0.03 | 0.03 | 0.05 | 0.05 | -17.86 | 0.33 | -0.01 | 6.64 | 0.21 | 0.32 | 0.21 | 0.22 |
| SEQID-03114 | 0.02 | 0.04 | 0.04 | 0.03 | 0.04 | 0.03 | 0.06 | 0.03 | 0.03 | 0.07 | -23.81 | 0.31 | -0.02 | 5.72 | 0.19 | 0.34 | 0.00 | 0.21 |
| SEQID-03115 | 0.01 | 0.05 | 0.05 | 0.07 | 0.06 | 0.00 | 0.02 | 0.07 | 0.03 | 0.06 | -26.40 | 0.31 | 0.01 | 4.56 | 0.64 | 0.90 | 0.25 | 0.21 |
| SEQID-03116 | 0.02 | 0.06 | 0.03 | 0.04 | 0.05 | 0.02 | 0.01 | 0.05 | 0.05 | 0.06 | -20.22 | 0.39 | -0.05 | 6.30 | 0.21 | 0.33 | 0.00 | 0.20 |
| SEQID-03117 | 0.02 | 0.04 | 0.06 | 0.04 | 0.04 | 0.01 | 0.03 | 0.06 | 0.04 | 0.07 | -19.40 | 0.43 | -0.02 | 6.39 | 0.19 | 0.31 | 0.00 | 0.21 |
| SEQID-03118 | 0.02 | 0.05 | 0.05 | 0.05 | 0.05 | 0.02 | 0.06 | 0.02 | 0.04 | 0.06 | -18.56 | 0.40 | -0.01 | 5.83 | 0.20 | 0.34 | 0.22 | 0.22 |
| SEQID-03119 | 0.01 | 0.07 | 0.04 | 0.05 | 0.05 | 0.06 | 0.01 | 0.06 | 0.05 | 0.07 | -18.92 | 0.35 | -0.01 | 9.48 | 0.74 | 0.39 | 0.19 | 0.20 |
| SEQID-03120 | 0.03 | 0.11 | 0.02 | 0.01 | 0.08 | 0.01 | 0.03 | 0.03 | 0.05 | 0.09 | -18.42 | 0.35 | -0.02 | 7.03 | 0.22 | 0.31 | 0.21 | 0.23 |
| SEQID-03121 | 0.02 | 0.08 | 0.04 | 0.04 | 0.06 | 0.02 | 0.05 | 0.05 | 0.05 | 0.07 | -20.86 | 0.42 | 0.02 | 10.96 | 0.74 | 0.35 | 0.00 | 0.00 |
| SEQID-03122 | 0.03 | 0.07 | 0.05 | 0.05 | 0.05 | 0.03 | 0.02 | 0.03 | 0.03 | 0.07 | -20.22 | 0.50 | 0.00 | 5.17 | 0.22 | 0.35 | 0.00 | 0.23 |
| SEQID-03123 | 0.02 | 0.04 | 0.06 | 0.03 | 0.06 | 0.03 | 0.06 | 0.03 | 0.03 | 0.06 | -18.08 | 0.50 | 0.09 | 9.02 | 0.21 | 0.35 | 0.00 | 0.20 |
| SEQID-03124 | 0.01 | 0.05 | 0.06 | 0.07 | 0.05 | 0.06 | 0.00 | 0.07 | 0.03 | 0.09 | -16.57 | 0.58 | -0.02 | 5.13 | 0.64 | 0.76 | 0.25 | 0.21 |
| SEQID-03125 | 0.02 | 0.05 | 0.04 | 0.04 | 0.05 | 0.02 | 0.02 | 0.05 | 0.07 | 0.06 | -20.22 | 0.36 | 0.01 | 9.02 | 0.21 | 0.31 | 0.00 | 0.20 |
| SEQID-03126 | 0.02 | 0.08 | 0.04 | 0.05 | 0.06 | 0.01 | 0.01 | 0.05 | 0.06 | 0.06 | -18.92 | 0.41 | -0.02 | 7.29 | 0.20 | 0.31 | 0.22 | 0.20 |
| SEQID-03127 | 0.02 | 0.04 | 0.04 | 0.04 | 0.06 | 0.02 | 0.06 | 0.06 | 0.06 | 0.07 | -18.56 | 0.40 | 0.00 | 7.20 | 0.21 | 0.34 | 0.19 | 0.22 |
| SEQID-03128 | 0.02 | 0.06 | 0.05 | 0.04 | 0.09 | 0.03 | 0.03 | 0.09 | 0.02 | 0.08 | -17.56 | 0.43 | -0.01 | 6.33 | 0.56 | 0.71 | 0.00 | 0.20 |
| SEQID-03129 | 0.03 | 0.07 | 0.07 | 0.04 | 0.07 | 0.02 | 0.02 | 0.02 | 0.05 | 0.05 | -17.23 | 0.44 | 0.00 | 7.69 | 0.54 | 0.70 | 0.20 | 0.23 |
| SEQID-03130 | 0.03 | 0.09 | 0.04 | 0.06 | 0.05 | 0.06 | 0.03 | 0.03 | 0.05 | 0.03 | -13.47 | 0.77 | 0.03 | 9.36 | 0.20 | 0.33 | 0.20 | 0.21 |

TABLE 1-continued

| | | | | | | | | | | | | | | |
|---|---|---|---|---|---|---|---|---|---|---|---|---|---|---|
| SEQID-03131 | 0.02 | 0.05 | 0.04 | 0.06 | 0.05 | 0.00 | 0.05 | 0.06 | −21.15 | 0.40 | −0.01 | 5.88 | 0.19 | 0.33 | 0.00 | 0.22 |
| SEQID-03132 | 0.02 | 0.07 | 0.05 | 0.06 | 0.06 | 0.02 | 0.06 | 0.06 | −20.38 | 0.37 | −0.01 | 6.55 | 0.20 | 0.33 | 0.20 | 0.20 |
| SEQID-03133 | 0.02 | 0.07 | 0.04 | 0.07 | 0.07 | 0.03 | 0.05 | 0.06 | −18.93 | 0.32 | −0.01 | 6.24 | 0.18 | 0.35 | 0.19 | 0.20 |
| SEQID-03134 | 0.02 | 0.05 | 0.02 | 0.04 | 0.10 | 0.03 | 0.09 | 0.07 | −13.89 | 0.33 | −0.01 | 5.92 | 0.24 | 0.31 | 0.00 | 0.26 |
| SEQID-03135 | 0.04 | 0.07 | 0.03 | 0.08 | 0.09 | 0.04 | 0.02 | 0.08 | −11.66 | 0.50 | 0.03 | 9.90 | 0.00 | 0.30 | 0.28 | 0.25 |
| SEQID-03136 | 0.02 | 0.05 | 0.04 | 0.07 | 0.07 | 0.06 | 0.03 | 0.07 | −25.76 | 0.21 | 0.09 | 10.74 | 0.22 | 0.31 | 0.20 | 0.00 |
| SEQID-03137 | 0.01 | 0.04 | 0.02 | 0.09 | 0.09 | 0.06 | 0.04 | 0.09 | −19.09 | 0.44 | −0.02 | 5.99 | 0.22 | 0.31 | 0.00 | 0.20 |
| SEQID-03138 | 0.01 | 0.06 | 0.04 | 0.05 | 0.06 | 0.04 | 0.06 | 0.05 | −21.71 | 0.32 | −0.02 | 6.32 | 0.21 | 0.33 | 0.00 | 0.00 |
| SEQID-03139 | 0.02 | 0.07 | 0.04 | 0.06 | 0.05 | 0.03 | 0.05 | 0.06 | −16.14 | 0.42 | −0.03 | 4.74 | 0.36 | 0.50 | 0.00 | 0.22 |
| SEQID-03140 | 0.02 | 0.05 | 0.07 | 0.09 | 0.05 | 0.03 | 0.02 | 0.05 | −17.71 | 0.32 | 0.00 | 6.92 | 0.21 | 0.34 | 0.00 | 0.23 |
| SEQID-03141 | 0.02 | 0.05 | 0.04 | 0.05 | 0.06 | 0.01 | 0.03 | 0.03 | −20.24 | 0.46 | 0.00 | 7.17 | 0.21 | 0.33 | 0.21 | 0.22 |
| SEQID-03142 | 0.01 | 0.07 | 0.04 | 0.07 | 0.05 | 0.03 | 0.01 | 0.06 | −17.74 | 0.41 | −0.01 | 6.16 | 0.20 | 0.33 | 0.00 | 0.22 |
| SEQID-03143 | 0.01 | 0.06 | 0.04 | 0.10 | 0.08 | 0.05 | 0.06 | 0.06 | −12.84 | 0.45 | −0.01 | 5.65 | 0.21 | 0.34 | 0.00 | 0.21 |
| SEQID-03144 | 0.02 | 0.03 | 0.05 | 0.04 | 0.05 | 0.03 | 0.07 | 0.07 | −19.25 | 0.38 | 0.00 | 6.95 | 0.26 | 0.40 | 0.18 | 0.20 |
| SEQID-03145 | 0.02 | 0.05 | 0.03 | 0.04 | 0.04 | 0.03 | 0.05 | 0.07 | −21.13 | 0.34 | −0.01 | 6.35 | 0.21 | 0.33 | 0.00 | 0.21 |
| SEQID-03146 | 0.03 | 0.06 | 0.04 | 0.04 | 0.05 | 0.02 | 0.04 | 0.06 | −18.57 | 0.66 | −0.02 | 5.13 | 0.19 | 0.34 | 0.00 | 0.21 |
| SEQID-03147 | 0.01 | 0.01 | 0.03 | 0.04 | 0.04 | 0.00 | 0.07 | 0.08 | −18.97 | 0.52 | −0.01 | 5.70 | 0.31 | 0.36 | 0.00 | 0.30 |
| SEQID-03148 | 0.00 | 0.08 | 0.03 | 0.04 | 0.05 | 0.01 | 0.06 | 0.06 | −24.21 | 0.19 | 0.11 | 10.65 | 0.26 | 0.32 | 0.24 | 0.25 |
| SEQID-03149 | 0.02 | 0.03 | 0.02 | 0.06 | 0.02 | 0.01 | 0.04 | 0.09 | −19.28 | 0.56 | 0.10 | 11.02 | 0.23 | 0.30 | 0.24 | 0.00 |
| SEQID-03150 | 0.02 | 0.05 | 0.01 | 0.04 | 0.10 | 0.05 | 0.10 | 0.07 | −19.52 | 0.31 | 0.00 | 7.18 | 0.00 | 0.30 | 0.24 | 0.22 |
| SEQID-03151 | 0.02 | 0.04 | 0.07 | 0.04 | 0.03 | 0.04 | 0.05 | 0.07 | −20.14 | 0.43 | 0.00 | 7.41 | 0.24 | 0.31 | 0.25 | 0.25 |
| SEQID-03152 | 0.03 | 0.07 | 0.05 | 0.05 | 0.03 | 0.02 | 0.05 | 0.06 | −23.90 | 0.27 | 0.13 | 11.56 | 0.21 | 0.29 | 0.00 | 0.00 |
| SEQID-03153 | 0.01 | 0.05 | 0.03 | 0.02 | 0.05 | 0.05 | 0.04 | 0.06 | −23.46 | 0.29 | 0.11 | 11.09 | 0.20 | 0.31 | 0.00 | 0.23 |
| SEQID-03154 | 0.02 | 0.03 | 0.03 | 0.05 | 0.05 | 0.03 | 0.09 | 0.09 | −22.13 | 0.44 | 0.06 | 10.50 | 0.20 | 0.33 | 0.00 | 0.25 |
| SEQID-03155 | 0.02 | 0.07 | 0.06 | 0.04 | 0.05 | 0.04 | 0.03 | 0.04 | −20.56 | 0.29 | 0.00 | 7.23 | 0.24 | 0.31 | 0.22 | 0.23 |
| SEQID-03156 | 0.02 | 0.10 | 0.07 | 0.05 | 0.06 | 0.04 | 0.08 | 0.03 | −18.82 | 0.29 | 0.00 | 8.30 | 0.24 | 0.31 | 0.00 | 0.00 |
| SEQID-03157 | 0.03 | 0.07 | 0.07 | 0.06 | 0.10 | 0.03 | 0.05 | 0.06 | −15.40 | 0.39 | 0.01 | 7.78 | 0.43 | 0.64 | 0.00 | 0.21 |
| SEQID-03158 | 0.05 | 0.12 | 0.06 | 0.07 | 0.05 | 0.04 | 0.06 | 0.05 | −19.34 | 0.32 | −0.01 | 5.15 | 0.25 | 0.33 | 0.19 | 0.00 |
| SEQID-03159 | 0.04 | 0.05 | 0.03 | 0.04 | 0.06 | 0.01 | 0.06 | 0.05 | −20.81 | 0.42 | 0.00 | 6.80 | 0.21 | 0.34 | 0.00 | 0.24 |
| SEQID-03160 | 0.03 | 0.02 | 0.04 | 0.05 | 0.04 | 0.04 | 0.05 | 0.06 | −17.94 | 0.47 | −0.02 | 5.16 | 0.34 | 0.50 | 0.00 | 0.00 |
| SEQID-03161 | 0.04 | 0.06 | 0.04 | 0.04 | 0.05 | 0.03 | 0.04 | 0.09 | −20.27 | 0.40 | 0.01 | 7.31 | 0.21 | 0.31 | 0.22 | 0.20 |
| SEQID-03162 | 0.01 | 0.03 | 0.04 | 0.04 | 0.03 | 0.05 | 0.09 | 0.04 | −21.74 | 0.27 | −0.01 | 6.72 | 0.20 | 0.33 | 0.00 | 0.00 |
| SEQID-03163 | 0.02 | 0.05 | 0.03 | 0.03 | 0.05 | 0.02 | 0.05 | 0.07 | −21.91 | 0.44 | 0.00 | 6.81 | 0.21 | 0.33 | 0.00 | 0.20 |
| SEQID-03164 | 0.03 | 0.05 | 0.04 | 0.03 | 0.03 | 0.01 | 0.06 | 0.07 | −19.32 | 0.48 | −0.01 | 6.16 | 0.25 | 0.39 | 0.00 | 0.21 |
| SEQID-03165 | 0.01 | 0.06 | 0.05 | 0.06 | 0.06 | 0.01 | 0.05 | 0.05 | −20.50 | 0.34 | 0.00 | 6.93 | 0.21 | 0.31 | 0.00 | 0.00 |
| SEQID-03166 | 0.02 | 0.05 | 0.06 | 0.05 | 0.05 | 0.01 | 0.04 | 0.05 | −19.02 | 0.38 | −0.02 | 5.74 | 0.22 | 0.35 | 0.00 | 0.22 |
| SEQID-03167 | 0.02 | 0.06 | 0.05 | 0.07 | 0.07 | 0.01 | 0.04 | 0.09 | −15.61 | 0.47 | 0.00 | 6.34 | 0.49 | 0.84 | 0.00 | 0.21 |
| SEQID-03168 | 0.02 | 0.05 | 0.05 | 0.05 | 0.06 | 0.03 | 0.04 | 0.07 | −18.10 | 0.42 | −0.01 | 6.13 | 0.51 | 0.71 | 0.21 | 0.21 |
| SEQID-03169 | 0.03 | 0.05 | 0.07 | 0.07 | 0.10 | 0.00 | 0.04 | 0.03 | −18.31 | 0.47 | −0.01 | 5.40 | 0.22 | 0.34 | 0.20 | 0.23 |
| SEQID-03170 | 0.02 | 0.09 | 0.06 | 0.05 | 0.05 | 0.03 | 0.05 | 0.06 | −18.69 | 0.25 | 0.00 | 6.94 | 0.35 | 0.55 | 0.22 | 0.21 |
| SEQID-03171 | 0.01 | 0.04 | 0.05 | 0.06 | 0.04 | 0.03 | 0.04 | 0.05 | −19.15 | 0.39 | −0.02 | 6.05 | 0.20 | 0.33 | 0.00 | 0.21 |
| SEQID-03172 | 0.02 | 0.04 | 0.04 | 0.05 | 0.06 | 0.02 | 0.05 | 0.09 | −18.65 | 0.46 | −0.01 | 6.13 | 0.21 | 0.35 | 0.00 | 0.21 |
| SEQID-03173 | 0.02 | 0.05 | 0.04 | 0.06 | 0.05 | 0.02 | 0.05 | 0.09 | −19.08 | 0.43 | −0.01 | 5.87 | 0.00 | 0.36 | 0.00 | 0.19 |
| SEQID-03174 | 0.01 | 0.01 | 0.04 | 0.06 | 0.07 | 0.01 | 0.04 | 0.08 | −23.53 | 0.27 | 0.07 | 10.34 | 0.26 | 0.30 | 0.00 | 0.25 |
| SEQID-03175 | 0.03 | 0.05 | 0.04 | 0.04 | 0.03 | 0.02 | 0.01 | 0.09 | −24.39 | 0.38 | 0.13 | 11.46 | 0.22 | 0.29 | 0.00 | 0.24 |
| SEQID-03176 | 0.02 | 0.04 | 0.03 | 0.04 | 0.04 | 0.00 | 0.09 | 0.07 | −20.30 | 0.46 | 0.11 | 10.74 | 0.22 | 0.30 | 0.21 | 0.00 |
| SEQID-03177 | 0.02 | 0.03 | 0.06 | 0.07 | 0.05 | 0.02 | 0.04 | 0.05 | −21.07 | 0.32 | 0.03 | 11.31 | 0.00 | 0.30 | 0.24 | 0.21 |
| SEQID-03178 | 0.02 | 0.02 | 0.05 | 0.06 | 0.06 | 0.01 | 0.01 | 0.03 | −21.32 | 0.43 | 0.12 | 9.87 | 0.26 | 0.33 | 0.18 | 0.24 |
| SEQID-03179 | 0.01 | 0.07 | 0.02 | 0.04 | 0.06 | 0.01 | 0.06 | 0.09 | −22.64 | 0.21 | 0.16 | 11.37 | 0.21 | 0.29 | 0.23 | 0.23 |
| SEQID-03180 | 0.02 | 0.03 | 0.03 | 0.05 | 0.04 | 0.00 | 0.00 | 0.07 | −25.68 | 0.26 | 0.14 | 11.09 | 0.24 | 0.30 | 0.19 | 0.00 |
| SEQID-03181 | 0.04 | 0.05 | 0.04 | 0.03 | 0.05 | 0.00 | 0.06 | 0.06 | −21.97 | 0.25 | 0.11 | 10.99 | 0.22 | 0.28 | 0.00 | 0.19 |
| SEQID-03182 | 0.01 | 0.05 | 0.04 | 0.05 | 0.06 | 0.02 | 0.02 | 0.04 | −23.82 | 0.39 | 0.15 | 11.77 | 0.00 | 0.32 | 0.00 | 0.24 |
| SEQID-03183 | 0.03 | 0.04 | 0.04 | 0.06 | 0.03 | 0.01 | 0.03 | 0.07 | −22.66 | 0.40 | 0.09 | 10.61 | 0.23 | 0.32 | 0.20 | 0.20 |

TABLE 1-continued

| | | | | | | | | | | | | | | |
|---|---|---|---|---|---|---|---|---|---|---|---|---|---|---|
| SEQID-03184 | 0.01 | 0.08 | 0.03 | 0.04 | 0.07 | 0.04 | 0.02 | 0.05 | -13.56 | 0.91 | 0.04 | 9.96 | 0.21 | 0.32 | 0.22 | 0.19 |
| SEQID-03185 | 0.01 | 0.05 | 0.05 | 0.06 | 0.05 | 0.03 | 0.05 | 0.10 | -20.75 | 0.33 | -0.01 | 6.52 | 0.20 | 0.31 | 0.00 | 0.00 |
| SEQID-03186 | 0.04 | 0.04 | 0.05 | 0.04 | 0.04 | 0.02 | 0.05 | 0.09 | -17.89 | 0.52 | -0.04 | 5.16 | 0.24 | 0.32 | 0.00 | 0.20 |
| SEQID-03187 | 0.06 | 0.03 | 0.03 | 0.06 | 0.05 | 0.02 | 0.03 | 0.09 | -19.76 | 0.43 | 0.00 | 7.02 | 0.19 | 0.29 | 0.00 | 0.00 |
| SEQID-03188 | 0.04 | 0.05 | 0.04 | 0.06 | 0.05 | 0.03 | 0.09 | 0.05 | -17.81 | 0.34 | -0.01 | 6.51 | 0.18 | 0.31 | 0.00 | 0.21 |
| SEQID-03189 | 0.02 | 0.03 | 0.04 | 0.05 | 0.05 | 0.00 | 0.05 | 0.07 | -19.54 | 0.34 | -0.05 | 6.92 | 0.22 | 0.33 | 0.18 | 0.00 |
| SEQID-03190 | 0.03 | 0.06 | 0.06 | 0.03 | 0.05 | 0.02 | 0.03 | 0.05 | -21.71 | 0.44 | 0.00 | 4.46 | 0.21 | 0.34 | 0.00 | 0.17 |
| SEQID-03191 | 0.03 | 0.03 | 0.03 | 0.07 | 0.04 | 0.02 | 0.03 | 0.05 | -17.00 | 0.45 | -0.01 | 6.52 | 0.20 | 0.30 | 0.00 | 0.20 |
| SEQID-03192 | 0.03 | 0.03 | 0.04 | 0.06 | 0.05 | 0.02 | 0.03 | 0.10 | -19.23 | 0.37 | -0.01 | 6.52 | 0.21 | 0.33 | 0.00 | 0.00 |
| SEQID-03193 | 0.03 | 0.04 | 0.04 | 0.05 | 0.04 | 0.01 | 0.08 | 0.07 | -19.80 | 0.43 | -0.01 | 6.29 | 0.20 | 0.33 | 0.00 | 0.21 |
| SEQID-03194 | 0.02 | 0.10 | 0.05 | 0.08 | 0.03 | 0.05 | 0.06 | 0.08 | -17.54 | 0.41 | 0.01 | 7.55 | 0.00 | 0.32 | 0.00 | 0.20 |
| SEQID-03195 | 0.03 | 0.04 | 0.04 | 0.06 | 0.07 | 0.01 | 0.05 | 0.06 | -17.53 | 0.44 | 0.01 | 8.79 | 0.19 | 0.33 | 0.00 | 0.00 |
| SEQID-03196 | 0.01 | 0.05 | 0.07 | 0.06 | 0.05 | 0.04 | 0.03 | 0.08 | -16.08 | 0.54 | 0.00 | 6.79 | 0.23 | 0.32 | 0.00 | 0.20 |
| SEQID-03197 | 0.03 | 0.04 | 0.05 | 0.04 | 0.06 | 0.03 | 0.05 | 0.05 | -21.77 | 0.37 | -0.01 | 6.53 | 0.10 | 0.31 | 0.00 | 0.21 |
| SEQID-03198 | 0.02 | 0.05 | 0.05 | 0.04 | 0.04 | 0.03 | 0.04 | 0.05 | -19.67 | 0.43 | -0.02 | 6.25 | 0.21 | 0.31 | 0.00 | 0.21 |
| SEQID-03199 | 0.02 | 0.04 | 0.06 | 0.05 | 0.07 | 0.04 | 0.03 | 0.05 | -18.77 | 0.41 | -0.03 | 4.85 | 0.21 | 0.33 | 0.00 | 0.22 |
| SEQID-03200 | 0.03 | 0.03 | 0.02 | 0.09 | 0.06 | 0.02 | 0.04 | 0.08 | -19.56 | 0.40 | -0.01 | 6.64 | 0.21 | 0.36 | 0.13 | 0.22 |
| SEQID-03201 | 0.03 | 0.06 | 0.03 | 0.04 | 0.04 | 0.04 | 0.04 | 0.05 | -21.13 | 0.47 | 0.00 | 7.63 | 0.38 | 0.34 | 0.21 | 0.24 |
| SEQID-03202 | 0.03 | 0.06 | 0.06 | 0.04 | 0.06 | 0.04 | 0.04 | 0.06 | -19.73 | 0.37 | 0.04 | 7.59 | 0.20 | 0.34 | 0.00 | 0.21 |
| SEQID-03203 | 0.02 | 0.05 | 0.06 | 0.04 | 0.05 | 0.04 | 0.04 | 0.06 | -18.35 | 0.41 | 0.01 | 6.24 | 0.21 | 0.33 | 0.00 | 0.23 |
| SEQID-03204 | 0.04 | 0.06 | 0.03 | 0.03 | 0.05 | 0.01 | 0.04 | 0.07 | -23.29 | 0.40 | -0.02 | 5.84 | 0.21 | 0.32 | 0.19 | 0.21 |
| SEQID-03205 | 0.04 | 0.05 | 0.04 | 0.05 | 0.06 | 0.01 | 0.05 | 0.07 | -20.04 | 0.39 | -0.02 | 5.26 | 0.22 | 0.32 | 0.00 | 0.21 |
| SEQID-03206 | 0.01 | 0.07 | 0.05 | 0.03 | 0.05 | 0.03 | 0.07 | 0.05 | -19.44 | 0.36 | -0.01 | 6.21 | 0.21 | 0.31 | 0.00 | 0.20 |
| SEQID-03207 | 0.01 | 0.03 | 0.05 | 0.06 | 0.07 | 0.02 | 0.05 | 0.06 | -19.96 | 0.34 | -0.02 | 5.78 | 0.34 | 0.59 | 0.00 | 0.27 |
| SEQID-03208 | 0.02 | 0.04 | 0.04 | 0.09 | 0.03 | 0.06 | 0.06 | 0.07 | -20.97 | 0.33 | -0.02 | 6.23 | 0.21 | 0.32 | 0.00 | 0.22 |
| SEQID-03209 | 0.02 | 0.05 | 0.03 | 0.04 | 0.06 | 0.03 | 0.05 | 0.04 | -23.81 | 0.32 | -0.04 | 5.00 | 0.38 | 0.78 | 0.25 | 0.19 |
| SEQID-03210 | 0.01 | 0.09 | 0.09 | 0.06 | 0.07 | 0.04 | 0.05 | 0.06 | -25.82 | 0.26 | -0.04 | 9.85 | 0.20 | 0.33 | 0.00 | 0.23 |
| SEQID-03211 | 0.02 | 0.06 | 0.06 | 0.05 | 0.05 | 0.04 | 0.05 | 0.06 | -22.01 | 0.29 | 0.04 | 5.93 | 0.23 | 0.36 | 0.00 | 0.24 |
| SEQID-03212 | 0.02 | 0.05 | 0.06 | 0.06 | 0.04 | 0.04 | 0.05 | 0.07 | -17.85 | 0.39 | -0.01 | 9.10 | 0.20 | 0.33 | 0.26 | 0.32 |
| SEQID-03213 | 0.01 | 0.04 | 0.04 | 0.04 | 0.05 | 0.03 | 0.05 | 0.09 | -20.85 | 0.38 | 0.01 | 5.97 | 0.19 | 0.34 | 0.00 | 0.26 |
| SEQID-03214 | 0.01 | 0.05 | 0.04 | 0.04 | 0.05 | 0.01 | 0.05 | 0.06 | -20.43 | 0.43 | -0.03 | 11.91 | 0.25 | 0.32 | 0.19 | 0.22 |
| SEQID-03215 | 0.01 | 0.03 | 0.01 | 0.04 | 0.05 | 0.02 | 0.05 | 0.06 | -19.53 | 0.38 | 0.18 | 11.20 | 0.00 | 0.31 | 0.00 | 0.27 |
| SEQID-03216 | 0.02 | 0.04 | 0.03 | 0.06 | 0.06 | 0.00 | 0.06 | 0.06 | -23.82 | 0.32 | 0.17 | 12.08 | 0.26 | 0.27 | 0.00 | 0.22 |
| SEQID-03217 | 0.02 | 0.05 | 0.04 | 0.05 | 0.03 | 0.02 | 0.03 | 0.04 | -23.53 | 0.31 | 0.18 | 12.05 | 0.27 | 0.29 | 0.25 | 0.19 |
| SEQID-03218 | 0.02 | 0.04 | 0.03 | 0.04 | 0.06 | 0.02 | 0.07 | 0.06 | -20.29 | 0.26 | 0.15 | 11.01 | 0.21 | 0.33 | 0.00 | 0.23 |
| SEQID-03219 | 0.02 | 0.04 | 0.05 | 0.05 | 0.04 | 0.05 | 0.05 | 0.04 | -23.81 | 0.32 | 0.08 | 11.13 | 0.00 | 0.30 | 0.00 | 0.24 |
| SEQID-03220 | 0.09 | 0.06 | 0.20 | 0.01 | 0.03 | 0.00 | 0.09 | 0.05 | -25.82 | 0.26 | 0.13 | 10.92 | 0.29 | 0.39 | 0.26 | 0.32 |
| SEQID-03221 | 0.03 | 0.04 | 0.04 | 0.05 | 0.06 | 0.00 | 0.04 | 0.10 | -22.01 | 0.33 | 0.05 | 10.80 | 0.22 | 0.30 | 0.00 | 0.26 |
| SEQID-03222 | 0.01 | 0.05 | 0.04 | 0.05 | 0.07 | 0.01 | 0.03 | 0.10 | -15.94 | 0.30 | 0.06 | 10.84 | 0.20 | 0.32 | 0.22 | 0.22 |
| SEQID-03223 | 0.03 | 0.03 | 0.07 | 0.06 | 0.05 | 0.03 | 0.04 | 0.07 | -20.37 | 0.49 | 0.07 | 3.42 | 0.25 | 0.34 | 0.00 | 0.22 |
| SEQID-03224 | 0.02 | 0.03 | 0.04 | 0.07 | 0.04 | 0.04 | 0.04 | 0.06 | -24.53 | 0.39 | -0.03 | 4.70 | 0.23 | 0.33 | 0.00 | 0.19 |
| SEQID-03225 | 0.03 | 0.01 | 0.02 | 0.03 | 0.05 | 0.02 | 0.10 | 0.06 | -20.93 | 0.28 | 0.00 | 6.96 | 0.21 | 0.30 | 0.21 | 0.22 |
| SEQID-03226 | 0.01 | 0.03 | 0.03 | 0.05 | 0.04 | 0.02 | 0.02 | 0.06 | -21.73 | 0.39 | 0.20 | 12.12 | 0.22 | 0.32 | 0.22 | 0.19 |
| SEQID-03227 | 0.02 | 0.04 | 0.03 | 0.06 | 0.05 | 0.02 | 0.05 | 0.04 | -28.52 | 0.22 | 0.13 | 11.45 | 0.23 | 0.30 | 0.00 | 0.21 |
| SEQID-03228 | 0.00 | 0.03 | 0.04 | 0.05 | 0.06 | 0.01 | 0.05 | 0.10 | -23.70 | 0.14 | 0.02 | 9.07 | 0.22 | 0.31 | 0.00 | 0.00 |
| SEQID-03229 | 0.03 | 0.04 | 0.03 | 0.04 | 0.06 | 0.01 | 0.09 | 0.06 | -21.72 | 0.46 | -0.02 | 5.72 | 0.22 | 0.32 | 0.22 | 0.20 |
| SEQID-03230 | 0.02 | 0.06 | 0.04 | 0.04 | 0.06 | 0.01 | 0.04 | 0.11 | -21.24 | 0.35 | -0.01 | 6.36 | 0.20 | 0.34 | 0.00 | 0.26 |
| SEQID-03231 | 0.03 | 0.05 | 0.04 | 0.03 | 0.05 | 0.03 | 0.03 | 0.10 | -18.46 | 0.55 | 0.01 | 3.42 | 0.25 | 0.33 | 0.22 | 0.22 |
| SEQID-03232 | 0.01 | 0.03 | 0.07 | 0.04 | 0.05 | 0.04 | 0.00 | 0.05 | -17.47 | 0.56 | 0.00 | 6.73 | 0.00 | 0.31 | 0.00 | 0.20 |
| SEQID-03233 | 0.04 | 0.05 | 0.04 | 0.04 | 0.06 | 0.01 | 0.01 | 0.05 | -19.05 | 0.35 | 0.00 | 6.81 | 0.21 | 0.32 | 0.00 | 0.00 |
| SEQID-03234 | 0.03 | 0.04 | 0.03 | 0.04 | 0.05 | 0.03 | 0.05 | 0.06 | -20.32 | 0.40 | 0.00 | 7.08 | 0.21 | 0.32 | 0.00 | 0.00 |
| SEQID-03235 | 0.01 | 0.05 | 0.04 | 0.04 | 0.05 | 0.01 | 0.06 | 0.09 | -22.57 | 0.41 | -0.03 | 5.55 | 0.20 | 0.31 | 0.00 | 0.19 |
| SEQID-03236 | 0.01 | 0.04 | 0.03 | 0.04 | 0.05 | 0.01 | 0.04 | 0.06 | -20.07 | 0.38 | -0.01 | 6.59 | 0.19 | 0.31 | 0.00 | 0.00 |
| SEQID-03237 | 0.02 | 0.06 | 0.07 | 0.09 | 0.10 | 0.01 | 0.07 | 0.06 | -12.65 | 0.42 | -0.04 | 4.25 | 0.20 | 0.35 | 0.00 | 0.22 |

TABLE 1-continued

| | | | | | | | | | | | | | | | |
|---|---|---|---|---|---|---|---|---|---|---|---|---|---|---|---|
| SEQID-03237 | 0.03 | 0.04 | 0.02 | 0.09 | 0.06 | 0.04 | 0.03 | 0.05 | -18.70 | 0.42 | 0.00 | 6.76 | 0.21 | 0.35 | 0.00 | 0.21 |
| SEQID-03238 | 0.02 | 0.06 | 0.03 | 0.06 | 0.06 | 0.02 | 0.05 | 0.06 | -17.19 | 0.55 | -0.03 | 4.58 | 0.20 | 0.31 | 0.25 | 0.00 |
| SEQID-03239 | 0.03 | 0.07 | 0.02 | 0.03 | 0.05 | 0.03 | 0.05 | 0.04 | -21.62 | 0.41 | -0.06 | 4.29 | 0.21 | 0.35 | 0.00 | 0.00 |
| SEQID-03240 | 0.06 | 0.05 | 0.06 | 0.05 | 0.04 | 0.02 | 0.04 | 0.09 | -18.85 | 0.46 | -0.01 | 6.33 | 0.00 | 0.33 | 0.00 | 0.21 |
| SEQID-03241 | 0.03 | 0.06 | 0.06 | 0.06 | 0.07 | 0.01 | 0.05 | 0.04 | -20.80 | 0.30 | 0.00 | 6.30 | 0.20 | 0.31 | 0.00 | 0.18 |
| SEQID-03242 | 0.02 | 0.04 | 0.05 | 0.07 | 0.05 | 0.03 | 0.05 | 0.09 | -19.28 | 0.45 | 0.00 | 7.65 | 0.22 | 0.32 | 0.00 | 0.22 |
| SEQID-03243 | 0.01 | 0.06 | 0.06 | 0.04 | 0.06 | 0.05 | 0.03 | 0.05 | -18.94 | 0.41 | 0.00 | 7.11 | 0.21 | 0.32 | 0.00 | 0.22 |
| SEQID-03244 | 0.02 | 0.08 | 0.05 | 0.06 | 0.06 | 0.05 | 0.05 | 0.05 | -15.37 | 0.40 | -0.01 | 6.24 | 0.22 | 0.35 | 0.20 | 0.20 |
| SEQID-03245 | 0.02 | 0.04 | 0.05 | 0.04 | 0.06 | 0.04 | 0.05 | 0.04 | -18.05 | 0.44 | -0.02 | 6.25 | 0.23 | 0.33 | 0.00 | 0.22 |
| SEQID-03246 | 0.00 | 0.04 | 0.04 | 0.07 | 0.06 | 0.02 | 0.04 | 0.11 | -17.67 | 0.48 | 0.00 | 7.36 | 0.23 | 0.34 | 0.00 | 0.21 |
| SEQID-03247 | 0.03 | 0.05 | 0.05 | 0.05 | 0.05 | 0.01 | 0.06 | 0.04 | -19.69 | 0.31 | 0.00 | 7.20 | 0.20 | 0.38 | 0.00 | 0.22 |
| SEQID-03248 | 0.02 | 0.05 | 0.05 | 0.04 | 0.03 | 0.03 | 0.04 | 0.07 | -20.12 | 0.41 | -0.01 | 6.60 | 0.22 | 0.56 | 0.00 | 0.23 |
| SEQID-03249 | 0.05 | 0.06 | 0.04 | 0.06 | 0.04 | 0.03 | 0.04 | 0.07 | -13.17 | 0.92 | 0.01 | 8.54 | 0.21 | 0.34 | 0.00 | 0.22 |
| SEQID-03250 | 0.03 | 0.04 | 0.05 | 0.05 | 0.07 | 0.04 | 0.04 | 0.06 | -18.89 | 0.33 | 0.00 | 6.37 | 0.20 | 0.31 | 0.18 | 0.21 |
| SEQID-03251 | 0.02 | 0.06 | 0.06 | 0.06 | 0.04 | 0.01 | 0.04 | 0.07 | -21.06 | 0.40 | -0.01 | 6.27 | 0.21 | 0.34 | 0.19 | 0.22 |
| SEQID-03252 | 0.03 | 0.03 | 0.02 | 0.05 | 0.04 | 0.01 | 0.04 | 0.06 | -24.02 | 0.32 | -0.01 | 8.68 | 0.23 | 0.33 | 0.00 | 0.21 |
| SEQID-03253 | 0.03 | 0.06 | 0.05 | 0.06 | 0.03 | 0.02 | 0.04 | 0.06 | -20.06 | 0.38 | 0.00 | 6.73 | 0.21 | 0.33 | 0.00 | 0.21 |
| SEQID-03254 | 0.04 | 0.05 | 0.03 | 0.04 | 0.05 | 0.02 | 0.03 | 0.06 | -18.37 | 0.41 | -0.01 | 7.04 | 0.21 | 0.32 | 0.00 | 0.22 |
| SEQID-03255 | 0.03 | 0.09 | 0.05 | 0.09 | 0.05 | 0.05 | 0.06 | 0.05 | -14.89 | 0.76 | 0.01 | 7.81 | 0.21 | 0.32 | 0.18 | 0.21 |
| SEQID-03256 | 0.03 | 0.05 | 0.04 | 0.04 | 0.04 | 0.04 | 0.06 | 0.07 | -20.06 | 0.33 | -0.01 | 6.69 | 0.21 | 0.32 | 0.19 | 0.20 |
| SEQID-03257 | 0.03 | 0.05 | 0.06 | 0.05 | 0.04 | 0.02 | 0.05 | 0.05 | -22.75 | 0.32 | 0.00 | 7.14 | 0.21 | 0.31 | 0.19 | 0.19 |
| SEQID-03258 | 0.01 | 0.04 | 0.05 | 0.04 | 0.07 | 0.04 | 0.05 | 0.08 | -18.56 | 0.43 | 0.00 | 7.05 | 0.20 | 0.33 | 0.00 | 0.13 |
| SEQID-03259 | 0.02 | 0.05 | 0.03 | 0.05 | 0.06 | 0.01 | 0.05 | 0.07 | -22.67 | 0.39 | -0.04 | 4.80 | 0.64 | 0.83 | 0.00 | 0.23 |
| SEQID-03260 | 0.03 | 0.03 | 0.04 | 0.03 | 0.06 | 0.04 | 0.03 | 0.06 | -15.35 | 0.63 | 0.00 | 7.32 | 0.20 | 0.32 | 0.00 | 0.29 |
| SEQID-03261 | 0.04 | 0.05 | 0.05 | 0.04 | 0.04 | 0.00 | 0.03 | 0.06 | -22.98 | 0.36 | -0.04 | 4.68 | 0.18 | 0.34 | 0.00 | 0.00 |
| SEQID-03262 | 0.03 | 0.04 | 0.03 | 0.05 | 0.05 | 0.02 | 0.03 | 0.06 | -18.67 | 0.40 | 0.00 | 7.04 | 0.19 | 0.33 | 0.00 | 0.27 |
| SEQID-03263 | 0.01 | 0.05 | 0.05 | 0.09 | 0.05 | 0.03 | 0.04 | 0.06 | -18.10 | 0.66 | 0.00 | 6.69 | 0.18 | 0.32 | 0.00 | 0.27 |
| SEQID-03264 | 0.02 | 0.04 | 0.05 | 0.05 | 0.04 | 0.02 | 0.05 | 0.07 | -18.67 | 0.47 | 0.00 | 7.29 | 0.20 | 0.33 | 0.18 | 0.26 |
| SEQID-03265 | 0.02 | 0.03 | 0.05 | 0.04 | 0.05 | 0.02 | 0.04 | 0.06 | -23.47 | 0.32 | -0.02 | 6.17 | 0.19 | 0.34 | 0.19 | 0.29 |
| SEQID-03266 | 0.03 | 0.09 | 0.04 | 0.05 | 0.04 | 0.03 | 0.07 | 0.05 | -17.08 | 0.61 | 0.02 | 9.11 | 0.18 | 0.33 | 0.19 | 0.21 |
| SEQID-03267 | 0.01 | 0.03 | 0.02 | 0.04 | 0.06 | 0.05 | 0.05 | 0.07 | -26.35 | 0.30 | 0.01 | 7.85 | 0.26 | 0.28 | 0.27 | 0.23 |
| SEQID-03268 | 0.02 | 0.02 | 0.04 | 0.05 | 0.01 | 0.01 | 0.05 | 0.10 | -23.54 | 0.31 | 0.16 | 11.12 | 0.27 | 0.33 | 0.24 | 0.29 |
| SEQID-03269 | 0.01 | 0.01 | 0.03 | 0.07 | 0.00 | 0.00 | 0.03 | 0.07 | -20.95 | 0.42 | 0.03 | 10.68 | 0.25 | 0.31 | 0.26 | 0.00 |
| SEQID-03270 | 0.03 | 0.06 | 0.04 | 0.03 | 0.04 | 0.04 | 0.04 | 0.05 | -23.36 | 0.23 | 0.04 | 9.56 | 0.23 | 0.33 | 0.25 | 0.27 |
| SEQID-03271 | 0.01 | 0.07 | 0.06 | 0.06 | 0.05 | 0.01 | 0.05 | 0.13 | -11.59 | 0.55 | 0.00 | 7.24 | 0.27 | 0.31 | 0.23 | 0.27 |
| SEQID-03272 | 0.02 | 0.03 | 0.05 | 0.12 | 0.06 | 0.00 | 0.04 | 0.04 | -21.64 | 0.22 | 0.13 | 10.94 | 0.27 | 0.32 | 0.00 | 0.26 |
| SEQID-03273 | 0.04 | 0.05 | 0.04 | 0.06 | 0.07 | 0.03 | 0.06 | 0.02 | -17.54 | 0.44 | 0.00 | 7.34 | 0.22 | 0.28 | 0.00 | 0.29 |
| SEQID-03274 | 0.01 | 0.07 | 0.06 | 0.06 | 0.04 | 0.01 | 0.04 | 0.05 | -19.71 | 0.44 | 0.00 | 6.88 | 0.00 | 0.30 | 0.23 | 0.21 |
| SEQID-03275 | 0.01 | 0.04 | 0.05 | 0.09 | 0.02 | 0.02 | 0.01 | 0.09 | -24.57 | 0.37 | 0.14 | 11.24 | 0.00 | 0.31 | 0.25 | 0.23 |
| SEQID-03276 | 0.02 | 0.04 | 0.04 | 0.05 | 0.04 | 0.01 | 0.03 | 0.05 | -25.87 | 0.20 | 0.22 | 12.19 | 0.00 | 0.29 | 0.00 | 0.22 |
| SEQID-03277 | 0.04 | 0.05 | 0.05 | 0.08 | 0.05 | 0.01 | 0.05 | 0.05 | -17.99 | 0.52 | -0.01 | 5.28 | 0.23 | 0.31 | 0.23 | 0.24 |
| SEQID-03278 | 0.02 | 0.04 | 0.06 | 0.03 | 0.03 | 0.03 | 0.09 | 0.05 | -23.44 | 0.24 | 0.05 | 10.04 | 0.21 | 0.33 | 0.25 | 0.24 |
| SEQID-03279 | 0.04 | 0.12 | 0.05 | 0.06 | 0.05 | 0.05 | 0.07 | 0.05 | -16.94 | 0.34 | -0.03 | 4.74 | 0.27 | 0.29 | 0.22 | 0.24 |
| SEQID-03280 | 0.04 | 0.09 | 0.03 | 0.06 | 0.04 | 0.01 | 0.09 | 0.08 | -23.77 | 0.34 | -0.05 | 4.37 | 0.56 | 0.61 | 0.00 | 0.19 |
| SEQID-03281 | 0.02 | 0.07 | 0.06 | 0.06 | 0.05 | 0.02 | 0.06 | 0.02 | -18.20 | 0.32 | 0.03 | 9.82 | 0.24 | 0.31 | 0.00 | 0.00 |
| SEQID-03282 | 0.02 | 0.07 | 0.01 | 0.06 | 0.06 | 0.00 | 0.07 | 0.05 | -20.98 | 0.65 | 0.05 | 9.94 | 0.21 | 0.32 | 0.00 | 0.24 |
| SEQID-03283 | 0.02 | 0.04 | 0.04 | 0.09 | 0.05 | 0.02 | 0.01 | 0.09 | -20.15 | 0.42 | 0.01 | 8.11 | 0.18 | 0.33 | 0.22 | 0.00 |
| SEQID-03284 | 0.01 | 0.04 | 0.01 | 0.08 | 0.05 | 0.00 | 0.06 | 0.07 | -19.83 | 0.40 | 0.00 | 6.79 | 0.00 | 0.31 | 0.00 | 0.24 |
| SEQID-03285 | 0.02 | 0.04 | 0.09 | 0.06 | 0.05 | 0.04 | 0.03 | 0.06 | -16.16 | 0.48 | -0.01 | 6.51 | 0.19 | 0.31 | 0.22 | 0.23 |
| SEQID-03286 | 0.01 | 0.04 | 0.04 | 0.04 | 0.06 | 0.05 | 0.05 | 0.02 | -17.98 | 0.31 | 0.01 | 7.90 | 0.51 | 0.66 | 0.00 | 0.00 |
| SEQID-03287 | 0.04 | 0.04 | 0.03 | 0.04 | 0.04 | 0.03 | 0.06 | 0.09 | -16.83 | 0.43 | -0.02 | 5.59 | 0.20 | 0.32 | 0.23 | 0.00 |
| SEQID-03288 | 0.03 | 0.07 | 0.06 | 0.04 | 0.02 | 0.06 | 0.06 | 0.06 | -22.43 | 0.32 | -0.02 | 6.37 | 0.00 | 0.33 | 0.00 | 0.00 |
| SEQID-03289 | 0.01 | 0.04 | 0.05 | 0.05 | 0.06 | 0.02 | 0.02 | 0.10 | -17.38 | 0.54 | -0.01 | 5.87 | 0.57 | 0.68 | 0.00 | 0.18 |

TABLE 1-continued

| | | | | | | | | | | | | | | | |
|---|---|---|---|---|---|---|---|---|---|---|---|---|---|---|---|
| SEQID-03290 | 0.02 | 0.09 | 0.08 | 0.05 | 0.05 | 0.05 | 0.04 | 0.04 | -15.00 | 0.25 | -0.02 | 4.98 | 0.27 | 0.41 | 0.22 | 0.25 |
| SEQID-03291 | 0.04 | 0.05 | 0.02 | 0.05 | 0.06 | 0.01 | 0.02 | 0.07 | -22.01 | 0.41 | -0.05 | 4.84 | 0.23 | 0.30 | 0.00 | 0.21 |
| SEQID-03292 | 0.05 | 0.06 | 0.03 | 0.05 | 0.09 | 0.01 | 0.02 | 0.07 | -18.19 | 0.51 | -0.01 | 6.36 | 0.20 | 0.31 | 0.21 | 0.00 |
| SEQID-03293 | 0.03 | 0.08 | 0.05 | 0.06 | 0.03 | 0.04 | 0.05 | 0.09 | -17.68 | 0.69 | 0.04 | 10.16 | 0.22 | 0.31 | 0.20 | 0.22 |
| SEQID-03294 | 0.02 | 0.10 | 0.06 | 0.04 | 0.09 | 0.05 | 0.09 | 0.05 | -11.08 | 0.66 | 0.07 | 10.46 | 0.19 | 0.30 | 0.00 | 0.00 |
| SEQID-03295 | 0.03 | 0.05 | 0.03 | 0.06 | 0.07 | 0.02 | 0.09 | 0.05 | -18.78 | 0.34 | -0.01 | 6.16 | 0.20 | 0.33 | 0.00 | 0.00 |
| SEQID-03296 | 0.02 | 0.04 | 0.03 | 0.06 | 0.05 | 0.02 | 0.03 | 0.08 | -19.15 | 0.47 | 0.01 | 8.42 | 0.21 | 0.30 | 0.00 | 0.00 |
| SEQID-03297 | 0.00 | 0.11 | 0.03 | 0.04 | 0.04 | 0.01 | 0.08 | 0.07 | -11.44 | 1.03 | 0.02 | 9.04 | 0.21 | 0.32 | 0.21 | 0.22 |
| SEQID-03298 | 0.02 | 0.05 | 0.03 | 0.05 | 0.04 | 0.01 | 0.03 | 0.07 | -19.38 | 0.42 | 0.03 | 10.12 | 0.21 | 0.30 | 0.00 | 0.00 |
| SEQID-03299 | 0.03 | 0.05 | 0.04 | 0.06 | 0.07 | 0.00 | 0.08 | 0.06 | -16.95 | 0.52 | -0.01 | 5.76 | 0.23 | 0.32 | 0.00 | 0.00 |
| SEQID-03300 | 0.01 | 0.07 | 0.04 | 0.03 | 0.09 | 0.01 | 0.04 | 0.09 | -17.72 | 0.54 | 0.02 | 9.70 | 0.00 | 0.35 | 0.00 | 0.21 |
| SEQID-03301 | 0.03 | 0.04 | 0.04 | 0.04 | 0.07 | 0.02 | 0.02 | 0.06 | -19.05 | 0.048 | -0.01 | 5.81 | 0.45 | 0.36 | 0.00 | 0.20 |
| SEQID-03302 | 0.02 | 0.02 | 0.04 | 0.05 | 0.06 | 0.01 | 0.06 | 0.08 | -17.63 | 0.45 | 0.00 | 6.86 | 0.23 | 0.56 | 0.00 | 0.20 |
| SEQID-03303 | 0.03 | 0.04 | 0.05 | 0.05 | 0.04 | 0.03 | 0.03 | 0.07 | -16.74 | 0.83 | 0.00 | 7.03 | 0.24 | 0.33 | 0.21 | 0.23 |
| SEQID-03304 | 0.01 | 0.05 | 0.06 | 0.04 | 0.04 | 0.02 | 0.03 | 0.08 | -17.49 | 0.49 | 0.00 | 7.20 | 0.21 | 0.37 | 0.00 | 0.22 |
| SEQID-03305 | 0.02 | 0.06 | 0.04 | 0.05 | 0.05 | 0.02 | 0.04 | 0.08 | -20.38 | 0.46 | -0.01 | 6.58 | 0.21 | 0.33 | 0.00 | 0.22 |
| SEQID-03306 | 0.03 | 0.04 | 0.04 | 0.07 | 0.05 | 0.00 | 0.03 | 0.10 | -17.13 | 0.50 | 0.01 | 7.88 | 0.21 | 0.33 | 0.00 | 0.17 |
| SEQID-03307 | 0.02 | 0.01 | 0.05 | 0.05 | 0.09 | 0.04 | 0.05 | 0.04 | -14.77 | 0.44 | -0.01 | 5.62 | 0.23 | 0.35 | 0.00 | 0.22 |
| SEQID-03308 | 0.02 | 0.05 | 0.04 | 0.08 | 0.05 | 0.02 | 0.04 | 0.06 | -18.98 | 0.43 | 0.01 | 7.64 | 0.21 | 0.35 | 0.00 | 0.22 |
| SEQID-03309 | 0.02 | 0.04 | 0.03 | 0.05 | 0.06 | 0.05 | 0.02 | 0.03 | -26.26 | 0.31 | 0.00 | 6.97 | 0.22 | 0.32 | 0.00 | 0.23 |
| SEQID-03310 | 0.02 | 0.06 | 0.05 | 0.07 | 0.07 | 0.02 | 0.02 | 0.05 | -15.17 | 0.43 | 0.01 | 7.62 | 0.24 | 0.31 | 0.20 | 0.22 |
| SEQID-03311 | 0.02 | 0.07 | 0.08 | 0.08 | 0.05 | 0.03 | 0.03 | 0.05 | -16.81 | 0.49 | 0.01 | 7.97 | 0.21 | 0.32 | 0.00 | 0.20 |
| SEQID-03312 | 0.04 | 0.03 | 0.04 | 0.04 | 0.05 | 0.03 | 0.06 | 0.08 | -21.81 | 0.41 | 0.02 | 9.64 | 0.24 | 0.34 | 0.20 | 0.22 |
| SEQID-03313 | 0.03 | 0.05 | 0.02 | 0.04 | 0.03 | 0.00 | 0.08 | 0.08 | -20.78 | 0.47 | -0.02 | 5.19 | 0.21 | 0.32 | 0.00 | 0.20 |
| SEQID-03314 | 0.02 | 0.04 | 0.04 | 0.05 | 0.07 | 0.01 | 0.04 | 0.06 | -19.61 | 0.37 | 0.02 | 9.42 | 0.22 | 0.36 | 0.00 | 0.22 |
| SEQID-03315 | 0.02 | 0.06 | 0.04 | 0.04 | 0.04 | 0.01 | 0.02 | 0.09 | -20.60 | 0.46 | 0.01 | 8.22 | 0.21 | 0.32 | 0.00 | 0.22 |
| SEQID-03316 | 0.03 | 0.07 | 0.06 | 0.06 | 0.06 | 0.04 | 0.04 | 0.05 | -18.95 | 0.34 | 0.00 | 7.31 | 0.21 | 0.34 | 0.00 | 0.23 |
| SEQID-03317 | 0.02 | 0.05 | 0.05 | 0.05 | 0.06 | 0.02 | 0.07 | 0.05 | -17.55 | 0.38 | -0.01 | 9.43 | 0.21 | 0.33 | 0.00 | 0.21 |
| SEQID-03318 | 0.02 | 0.04 | 0.04 | 0.03 | 0.07 | 0.01 | 0.02 | 0.05 | -19.66 | 0.40 | 0.02 | 8.17 | 0.21 | 0.35 | 0.19 | 0.24 |
| SEQID-03319 | 0.02 | 0.07 | 0.07 | 0.06 | 0.05 | 0.02 | 0.07 | 0.06 | -19.89 | 0.37 | 0.00 | 6.07 | 0.21 | 0.35 | 0.00 | 0.22 |
| SEQID-03320 | 0.03 | 0.03 | 0.05 | 0.04 | 0.05 | 0.03 | 0.05 | 0.06 | -18.30 | 0.45 | -0.01 | 6.89 | 0.21 | 0.33 | 0.00 | 0.22 |
| SEQID-03321 | 0.04 | 0.06 | 0.03 | 0.05 | 0.04 | 0.02 | 0.03 | 0.06 | -22.56 | 0.37 | -0.01 | 6.34 | 0.21 | 0.33 | 0.20 | 0.23 |
| SEQID-03322 | 0.02 | 0.06 | 0.04 | 0.06 | 0.06 | 0.02 | 0.03 | 0.08 | -19.07 | 0.49 | 0.00 | 6.74 | 0.20 | 0.34 | 0.00 | 0.21 |
| SEQID-03323 | 0.01 | 0.05 | 0.04 | 0.04 | 0.05 | 0.03 | 0.06 | 0.03 | -17.29 | 0.57 | -0.02 | 5.65 | 0.22 | 0.40 | 0.21 | 0.21 |
| SEQID-03324 | 0.03 | 0.06 | 0.04 | 0.05 | 0.07 | 0.02 | 0.01 | 0.05 | -18.12 | 0.43 | 0.00 | 6.80 | 0.21 | 0.32 | 0.00 | 0.23 |
| SEQID-03325 | 0.01 | 0.03 | 0.05 | 0.03 | 0.05 | 0.01 | 0.05 | 0.06 | -18.57 | 0.39 | -0.01 | 6.46 | 0.20 | 0.34 | 0.00 | 0.23 |
| SEQID-03326 | 0.02 | 0.07 | 0.04 | 0.07 | 0.06 | 0.02 | 0.02 | 0.08 | -17.44 | 0.49 | 0.02 | 8.19 | 0.31 | 0.48 | 0.19 | 0.21 |
| SEQID-03327 | 0.03 | 0.06 | 0.04 | 0.05 | 0.04 | 0.05 | 0.05 | 0.04 | -22.15 | 0.32 | -0.02 | 5.53 | 0.21 | 0.36 | 0.00 | 0.21 |
| SEQID-03328 | 0.02 | 0.05 | 0.04 | 0.06 | 0.06 | 0.02 | 0.02 | 0.07 | -16.03 | 0.48 | 0.01 | 8.92 | 0.28 | 0.43 | 0.19 | 0.22 |
| SEQID-03329 | 0.02 | 0.06 | 0.05 | 0.05 | 0.08 | 0.01 | 0.04 | 0.07 | -13.60 | 0.41 | -0.05 | 3.95 | 0.20 | 0.41 | 0.00 | 0.21 |
| SEQID-03330 | 0.02 | 0.06 | 0.05 | 0.12 | 0.06 | 0.01 | 0.06 | 0.05 | -17.92 | 0.32 | -0.03 | 5.13 | 0.22 | 0.34 | 0.20 | 0.21 |
| SEQID-03331 | 0.02 | 0.07 | 0.06 | 0.05 | 0.05 | 0.05 | 0.04 | 0.05 | -19.69 | 0.36 | -0.04 | 4.95 | 0.20 | 0.35 | 0.00 | 0.21 |
| SEQID-03332 | 0.02 | 0.08 | 0.06 | 0.07 | 0.06 | 0.03 | 0.03 | 0.05 | -16.53 | 0.47 | 0.01 | 7.73 | 0.20 | 0.32 | 0.21 | 0.21 |
| SEQID-03333 | 0.03 | 0.11 | 0.05 | 0.04 | 0.05 | 0.05 | 0.05 | 0.05 | -15.34 | 0.71 | 0.01 | 8.35 | 0.20 | 0.35 | 0.00 | 0.21 |
| SEQID-03334 | 0.03 | 0.04 | 0.03 | 0.05 | 0.06 | 0.00 | 0.02 | 0.07 | -21.94 | 0.41 | -0.01 | 5.83 | 0.45 | 0.73 | 0.00 | 0.22 |
| SEQID-03335 | 0.02 | 0.06 | 0.05 | 0.06 | 0.04 | 0.04 | 0.05 | 0.03 | -15.52 | 0.75 | 0.02 | 9.45 | 0.19 | 0.35 | 0.00 | 0.20 |
| SEQID-03336 | 0.02 | 0.06 | 0.05 | 0.07 | 0.07 | 0.02 | 0.04 | 0.08 | -16.52 | 0.52 | 0.00 | 7.91 | 0.23 | 0.42 | 0.19 | 0.21 |
| SEQID-03337 | 0.02 | 0.05 | 0.06 | 0.06 | 0.06 | 0.03 | 0.03 | 0.04 | -16.79 | 0.41 | -0.03 | 4.92 | 0.18 | 0.41 | 0.00 | 0.22 |
| SEQID-03338 | 0.03 | 0.08 | 0.04 | 0.04 | 0.04 | 0.03 | 0.03 | 0.07 | -18.38 | 0.57 | -0.03 | 5.16 | 0.20 | 0.34 | 0.20 | 0.22 |
| SEQID-03339 | 0.02 | 0.05 | 0.04 | 0.04 | 0.05 | 0.04 | 0.01 | 0.05 | -18.47 | 0.44 | 0.00 | 6.70 | 0.18 | 0.33 | 0.00 | 0.20 |
| SEQID-03340 | 0.03 | 0.08 | 0.04 | 0.06 | 0.06 | 0.03 | 0.03 | 0.07 | -17.65 | 0.54 | 0.01 | 8.36 | 0.19 | 0.35 | 0.00 | 0.21 |
| SEQID-03341 | 0.03 | 0.05 | 0.06 | 0.05 | 0.06 | 0.01 | 0.06 | 0.06 | -19.20 | 0.38 | 0.04 | 9.98 | 0.19 | 0.36 | 0.00 | 0.21 |
| SEQID-03342 | 0.02 | 0.05 | 0.06 | 0.04 | 0.06 | 0.03 | 0.05 | 0.05 | -20.08 | 0.29 | 0.00 | 7.25 | 0.20 | 0.32 | 0.20 | 0.20 |

TABLE 1-continued

| | | | | | | | | | | | | | | | | | | |
|---|---|---|---|---|---|---|---|---|---|---|---|---|---|---|---|---|---|---|
| SEQID-03343 | 0.03 | 0.06 | 0.05 | 0.04 | 0.05 | 0.05 | 0.03 | 0.04 | 0.05 | -21.66 | 0.35 | 0.00 | 6.85 | 0.19 | 0.35 | 0.19 | 0.18 |
| SEQID-03344 | 0.03 | 0.05 | 0.06 | 0.04 | 0.05 | 0.05 | 0.04 | 0.02 | 0.06 | -23.33 | 0.36 | -0.05 | 4.64 | 0.19 | 0.73 | 0.19 | 0.20 |
| SEQID-03345 | 0.02 | 0.04 | 0.04 | 0.06 | 0.07 | 0.07 | 0.04 | 0.02 | 0.08 | -17.42 | 0.52 | -0.01 | 6.42 | 0.18 | 0.33 | 0.19 | 0.20 |
| SEQID-03346 | 0.04 | 0.05 | 0.05 | 0.05 | 0.08 | 0.08 | 0.04 | 0.01 | 0.07 | -11.85 | 0.77 | 0.03 | 9.95 | 0.51 | 0.70 | 0.00 | 0.00 |
| SEQID-03347 | 0.04 | 0.05 | 0.05 | 0.06 | 0.07 | 0.07 | 0.04 | 0.01 | 0.07 | -11.94 | 0.76 | 0.04 | 10.04 | 0.52 | 0.70 | 0.00 | 0.21 |
| SEQID-03348 | 0.03 | 0.09 | 0.07 | 0.07 | 0.06 | 0.08 | 0.04 | 0.02 | 0.08 | -15.96 | 0.61 | -0.01 | 6.14 | 0.21 | 0.33 | 0.00 | 0.23 |
| SEQID-03349 | 0.03 | 0.05 | 0.07 | 0.07 | 0.05 | 0.05 | 0.05 | 0.01 | 0.06 | -18.41 | 0.41 | 0.00 | 7.53 | 0.20 | 0.34 | 0.20 | 0.21 |
| SEQID-03350 | 0.05 | 0.04 | 0.05 | 0.06 | 0.05 | 0.05 | 0.06 | 0.02 | 0.05 | -19.76 | 0.45 | -0.02 | 5.86 | 0.20 | 0.33 | 0.00 | 0.20 |
| SEQID-03351 | 0.02 | 0.04 | 0.04 | 0.02 | 0.05 | 0.05 | 0.10 | 0.07 | 0.05 | -17.47 | 0.27 | 0.02 | 8.46 | 0.57 | 0.59 | 0.00 | 0.24 |
| SEQID-03352 | 0.02 | 0.05 | 0.06 | 0.06 | 0.05 | 0.05 | 0.02 | 0.02 | 0.10 | -20.36 | 0.52 | 0.02 | 8.82 | 0.85 | 0.94 | 0.00 | 0.25 |
| SEQID-03353 | 0.04 | 0.08 | 0.05 | 0.07 | 0.03 | 0.03 | 0.03 | 0.00 | 0.07 | -26.77 | 0.30 | -0.02 | 5.42 | 0.69 | 0.81 | 0.19 | 0.21 |
| SEQID-03354 | 0.03 | 0.05 | 0.01 | 0.05 | 0.04 | 0.04 | 0.03 | 0.03 | 0.04 | -17.00 | 0.34 | 0.01 | 7.63 | 0.35 | 0.39 | 0.25 | 0.29 |
| SEQID-03355 | 0.02 | 0.04 | 0.04 | 0.04 | 0.03 | 0.03 | 0.03 | 0.03 | 0.05 | -18.73 | 0.33 | 0.01 | 7.63 | 0.38 | 0.43 | 0.25 | 0.34 |
| SEQID-03356 | 0.02 | 0.06 | 0.04 | 0.03 | 0.06 | 0.06 | 0.06 | 0.00 | 0.06 | -19.94 | 0.35 | -0.01 | 6.51 | 0.20 | 0.33 | 0.00 | 0.22 |
| SEQID-03357 | 0.03 | 0.02 | 0.02 | 0.05 | 0.05 | 0.05 | 0.05 | 0.03 | 0.13 | -20.80 | 0.43 | 0.05 | 9.60 | 0.30 | 0.26 | 0.00 | 1.00 |
| SEQID-03358 | 0.02 | 0.01 | 0.02 | 0.02 | 0.06 | 0.06 | 0.05 | 0.00 | 0.08 | -24.50 | 0.28 | 0.19 | 12.27 | 0.20 | 0.29 | 0.00 | 0.26 |
| SEQID-03359 | 0.02 | 0.06 | 0.03 | 0.04 | 0.05 | 0.05 | 0.01 | 0.04 | 0.07 | -20.90 | 0.43 | -0.02 | 5.34 | 0.21 | 0.33 | 0.00 | 0.22 |
| SEQID-03360 | 0.02 | 0.04 | 0.05 | 0.05 | 0.04 | 0.04 | 0.04 | 0.00 | 0.04 | -27.42 | 0.25 | 0.13 | 10.79 | 0.26 | 0.33 | 0.25 | 0.25 |
| SEQID-03361 | 0.02 | 0.04 | 0.04 | 0.07 | 0.10 | 0.10 | 0.01 | 0.01 | 0.08 | -9.68 | 0.87 | 0.02 | 9.72 | 0.66 | 0.34 | 0.26 | 0.25 |
| SEQID-03362 | 0.03 | 0.06 | 0.05 | 0.05 | 0.02 | 0.02 | 0.06 | 0.03 | 0.06 | -21.73 | 0.28 | 0.14 | 11.17 | 0.21 | 0.29 | 0.19 | 0.23 |
| SEQID-03363 | 0.02 | 0.05 | 0.04 | 0.04 | 0.06 | 0.06 | 0.02 | 0.05 | 0.06 | -22.51 | 0.37 | -0.03 | 5.01 | 0.19 | 0.32 | 0.00 | 0.20 |
| SEQID-03364 | 0.03 | 0.05 | 0.04 | 0.04 | 0.05 | 0.05 | 0.01 | 0.03 | 0.06 | -22.74 | 0.37 | 0.11 | 10.93 | 0.19 | 0.32 | 0.00 | 0.20 |
| SEQID-03365 | 0.04 | 0.04 | 0.03 | 0.04 | 0.03 | 0.03 | 0.05 | 0.02 | 0.08 | -10.26 | 0.95 | 0.04 | 10.29 | 0.74 | 0.36 | 0.00 | 0.25 |
| SEQID-03366 | 0.03 | 0.09 | 0.05 | 0.06 | 0.10 | 0.10 | 0.05 | 0.04 | 0.06 | -12.29 | 0.53 | 0.04 | 9.54 | 0.31 | 0.42 | 0.00 | 0.25 |
| SEQID-03367 | 0.03 | 0.04 | 0.05 | 0.09 | 0.08 | 0.08 | 0.02 | 0.05 | 0.06 | -14.63 | 0.57 | 0.00 | 7.65 | 0.24 | 0.32 | 0.00 | 0.22 |
| SEQID-03368 | 0.02 | 0.05 | 0.05 | 0.05 | 0.04 | 0.04 | 0.05 | 0.00 | 0.10 | -16.64 | 0.55 | 0.03 | 9.87 | 0.54 | 0.73 | 0.19 | 0.24 |
| SEQID-03369 | 0.04 | 0.05 | 0.08 | 0.03 | 0.04 | 0.04 | 0.03 | 0.04 | 0.04 | -17.25 | 0.45 | -0.03 | 6.78 | 0.21 | 0.36 | 0.20 | 0.00 |
| SEQID-03370 | 0.06 | 0.05 | 0.05 | 0.00 | 0.04 | 0.04 | 0.04 | 0.04 | 0.05 | -26.32 | 0.37 | 0.04 | 4.77 | 0.25 | 0.25 | 0.00 | 0.00 |
| SEQID-03371 | 0.02 | 0.03 | 0.03 | 0.08 | 0.01 | 0.01 | 0.00 | 0.00 | 0.07 | -20.23 | 0.45 | 0.10 | 8.90 | 0.26 | 0.32 | 0.25 | 0.00 |
| SEQID-03372 | 0.02 | 0.04 | 0.04 | 0.07 | 0.09 | 0.09 | 0.01 | 0.05 | 0.09 | -9.77 | 0.87 | 0.03 | 10.98 | 0.67 | 0.85 | 0.20 | 0.24 |
| SEQID-03373 | 0.04 | 0.03 | 0.02 | 0.06 | 0.03 | 0.03 | 0.02 | 0.02 | 0.08 | -17.25 | 0.59 | -0.02 | 9.83 | 0.26 | 0.31 | 0.24 | 0.25 |
| SEQID-03374 | 0.03 | 0.07 | 0.03 | 0.06 | 0.06 | 0.06 | 0.02 | 0.02 | 0.07 | -19.34 | 0.47 | 0.04 | 4.93 | 0.57 | 0.84 | 0.24 | 0.00 |
| SEQID-03375 | 0.02 | 0.03 | 0.02 | 0.03 | 0.08 | 0.08 | 0.00 | 0.00 | 0.04 | -23.63 | 0.33 | 0.00 | 9.86 | 0.22 | 0.31 | 0.00 | 0.24 |
| SEQID-03376 | 0.04 | 0.04 | 0.05 | 0.08 | 0.04 | 0.04 | 0.01 | 0.01 | 0.10 | -16.89 | 0.58 | 0.03 | 7.82 | 0.27 | 0.37 | 0.19 | 0.00 |
| SEQID-03377 | 0.03 | 0.04 | 0.02 | 0.06 | 0.02 | 0.02 | 0.03 | 0.03 | 0.10 | -17.05 | 0.55 | 0.00 | 9.87 | 0.26 | 0.33 | 0.20 | 0.22 |
| SEQID-03378 | 0.02 | 0.05 | 0.04 | 0.05 | 0.06 | 0.06 | 0.00 | 0.05 | 0.07 | -19.37 | 0.46 | -0.03 | 6.78 | 0.23 | 0.33 | 0.00 | 0.21 |
| SEQID-03379 | 0.04 | 0.10 | 0.04 | 0.03 | 0.04 | 0.04 | 0.00 | 0.00 | 0.07 | -23.44 | 0.42 | -0.03 | 4.82 | 0.21 | 0.33 | 0.00 | 0.21 |
| SEQID-03380 | 0.01 | 0.07 | 0.06 | 0.07 | 0.06 | 0.06 | 0.01 | 0.01 | 0.05 | -14.46 | 0.61 | 0.01 | 5.37 | 0.29 | 0.31 | 0.19 | 0.00 |
| SEQID-03381 | 0.03 | 0.06 | 0.04 | 0.04 | 0.08 | 0.08 | 0.02 | 0.02 | 0.08 | -17.52 | 0.43 | -0.03 | 6.09 | 0.19 | 0.38 | 0.20 | 0.23 |
| SEQID-03382 | 0.05 | 0.04 | 0.05 | 0.05 | 0.06 | 0.06 | 0.05 | 0.01 | 0.06 | -21.01 | 0.44 | -0.01 | 6.34 | 0.23 | 0.31 | 0.00 | 0.20 |
| SEQID-03383 | 0.02 | 0.05 | 0.04 | 0.03 | 0.07 | 0.07 | 0.00 | 0.00 | 0.05 | -23.57 | 0.30 | 0.15 | 11.86 | 0.26 | 0.31 | 0.26 | 0.00 |
| SEQID-03384 | 0.03 | 0.07 | 0.04 | 0.04 | 0.05 | 0.05 | 0.04 | 0.01 | 0.09 | -17.64 | 0.57 | 0.02 | 8.47 | 0.91 | 0.98 | 0.22 | 0.94 |
| SEQID-03385 | 0.02 | 0.07 | 0.05 | 0.05 | 0.05 | 0.05 | 0.05 | 0.01 | 0.09 | -17.85 | 0.54 | 0.00 | 7.45 | 0.94 | 0.96 | 0.00 | 0.94 |
| SEQID-03386 | 0.02 | 0.04 | 0.02 | 0.02 | 0.08 | 0.08 | 0.02 | 0.00 | 0.05 | -23.64 | 0.33 | 0.00 | 7.90 | 0.22 | 0.31 | 0.00 | 0.21 |
| SEQID-03387 | 0.04 | 0.03 | 0.04 | 0.04 | 0.06 | 0.06 | 0.05 | 0.00 | 0.09 | -19.69 | 0.44 | 0.05 | 9.49 | 0.85 | 0.98 | 0.23 | 0.85 |
| SEQID-03388 | 0.01 | 0.07 | 0.06 | 0.07 | 0.06 | 0.06 | 0.01 | 0.01 | 0.07 | -14.46 | 0.61 | 0.01 | 7.89 | 0.78 | 0.98 | 0.00 | 0.92 |
| SEQID-03389 | 0.03 | 0.06 | 0.04 | 0.04 | 0.08 | 0.08 | 0.02 | 0.02 | 0.05 | -17.52 | 0.43 | -0.03 | 4.85 | 0.87 | 0.31 | 0.19 | 0.20 |
| SEQID-03390 | 0.05 | 0.04 | 0.05 | 0.05 | 0.06 | 0.06 | 0.05 | 0.01 | 0.06 | -21.01 | 0.44 | -0.03 | 5.29 | 0.21 | 0.35 | 0.20 | 0.21 |
| SEQID-03391 | 0.01 | 0.06 | 0.06 | 0.05 | 0.06 | 0.06 | 0.03 | 0.03 | 0.05 | -20.16 | 0.30 | -0.02 | 5.65 | 0.19 | 0.32 | 0.00 | 0.20 |
| SEQID-03392 | 0.03 | 0.04 | 0.04 | 0.05 | 0.04 | 0.04 | 0.05 | 0.00 | 0.04 | -26.28 | 0.23 | 0.13 | 10.87 | 0.28 | 0.28 | 0.25 | 0.26 |
| SEQID-03393 | 0.02 | 0.03 | 0.04 | 0.02 | 0.06 | 0.06 | 0.02 | 0.06 | 0.07 | -23.82 | 0.31 | 0.18 | 12.01 | 0.00 | 0.32 | 0.00 | 0.29 |
| SEQID-03394 | 0.04 | 0.04 | 0.05 | 0.06 | 0.04 | 0.04 | 0.05 | 0.00 | 0.05 | -16.95 | 0.53 | 0.00 | 7.08 | 0.25 | 1.00 | 0.26 | 0.98 |
| SEQID-03395 | 0.01 | 0.02 | 0.02 | 0.04 | 0.09 | 0.09 | 0.02 | 0.07 | 0.06 | -17.36 | 0.37 | -0.03 | 4.65 | 0.95 | 0.00 | 0.00 | 0.00 |

TABLE 1-continued

| | | | | | | | | | | | | | | |
|---|---|---|---|---|---|---|---|---|---|---|---|---|---|---|
| SEQID-03396 | 0.03 | 0.06 | 0.03 | 0.05 | 0.05 | 0.03 | 0.04 | 0.09 | 0.47 | −20.88 | 0.00 | 6.80 | 0.86 | 0.93 | 0.23 | 0.21 |
| SEQID-03397 | 0.02 | 0.05 | 0.04 | 0.03 | 0.06 | 0.03 | 0.03 | 0.08 | 0.39 | −24.40 | −0.02 | 5.55 | 0.21 | 0.34 | 0.00 | 0.20 |
| SEQID-03398 | 0.03 | 0.04 | 0.04 | 0.04 | 0.06 | 0.01 | 0.03 | 0.06 | 0.36 | −22.95 | 0.02 | 4.83 | 0.72 | 0.91 | 0.19 | 0.20 |
| SEQID-03399 | 0.04 | 0.02 | 0.03 | 0.07 | 0.03 | 0.00 | 0.05 | 0.05 | 0.21 | −29.35 | 0.00 | 9.01 | 0.98 | 0.69 | 0.00 | 0.34 |
| SEQID-03400 | 0.03 | 0.06 | 0.01 | 0.03 | 0.06 | 0.04 | 0.04 | 0.06 | 0.45 | −20.96 | 0.03 | 6.96 | 0.22 | 0.31 | 0.00 | 0.25 |
| SEQID-03401 | 0.03 | 0.05 | 0.05 | 0.04 | 0.06 | 0.00 | 0.03 | 0.08 | 0.41 | −22.02 | 0.03 | 9.66 | 0.21 | 0.35 | 0.21 | 0.22 |
| SEQID-03402 | 0.09 | 0.13 | 0.03 | 0.06 | 0.06 | 0.00 | 0.04 | 0.02 | 0.56 | −18.17 | 0.07 | 8.61 | 0.29 | 0.29 | 0.30 | 0.28 |
| SEQID-03403 | 0.04 | 0.04 | 0.04 | 0.05 | 0.09 | 0.00 | 0.00 | 0.05 | 0.34 | −23.24 | 0.08 | 11.26 | 0.29 | 0.30 | 0.22 | 0.23 |
| SEQID-03404 | 0.01 | 0.05 | 0.03 | 0.05 | 0.04 | 0.04 | 0.01 | 0.04 | 0.29 | −18.45 | −0.02 | 5.06 | 0.24 | 0.33 | 0.00 | 0.24 |
| SEQID-03405 | 0.01 | 0.03 | 0.04 | 0.08 | 0.01 | 0.00 | 0.09 | 0.07 | 0.35 | −18.26 | 0.09 | 11.09 | 0.25 | 0.31 | 0.27 | 0.22 |
| SEQID-03406 | 0.02 | 0.03 | 0.05 | 0.06 | 0.06 | 0.00 | 0.10 | 0.04 | 0.46 | −15.35 | 0.00 | 6.76 | 0.24 | 0.32 | 0.25 | 0.81 |
| SEQID-03407 | 0.03 | 0.06 | 0.04 | 0.04 | 0.04 | 0.02 | 0.06 | 0.08 | 0.53 | −19.27 | −0.02 | 5.37 | 0.21 | 0.33 | 0.20 | 0.22 |
| SEQID-03408 | 0.02 | 0.08 | 0.06 | 0.04 | 0.05 | 0.02 | 0.06 | 0.06 | 0.28 | −21.28 | 0.00 | 7.03 | 0.39 | 0.56 | 0.00 | 0.21 |
| SEQID-03409 | 0.02 | 0.05 | 0.04 | 0.06 | 0.06 | 0.03 | 0.05 | 0.07 | 0.41 | −19.93 | 0.00 | 6.59 | 0.88 | 1.00 | 0.25 | 0.20 |
| SEQID-03410 | 0.06 | 0.03 | 0.05 | 0.04 | 0.03 | 0.02 | 0.02 | 0.09 | 0.55 | −19.41 | 0.12 | 11.19 | 0.25 | 0.30 | 0.21 | 0.24 |
| SEQID-03411 | 0.02 | 0.07 | 0.05 | 0.05 | 0.05 | 0.01 | 0.05 | 0.06 | 0.52 | −18.21 | −0.04 | 4.58 | 0.82 | 0.91 | 0.23 | 0.82 |
| SEQID-03412 | 0.03 | 0.03 | 0.05 | 0.03 | 0.04 | 0.02 | 0.05 | 0.08 | 0.38 | −19.98 | 0.00 | 7.14 | 0.72 | 0.32 | 0.21 | 0.22 |
| SEQID-03413 | 0.02 | 0.04 | 0.05 | 0.04 | 0.06 | 0.02 | 0.05 | 0.02 | 0.40 | −20.30 | −0.01 | 5.55 | 0.89 | 0.96 | 0.00 | 0.22 |
| SEQID-03414 | 0.03 | 0.05 | 0.04 | 0.04 | 0.05 | 0.01 | 0.07 | 0.06 | 0.51 | −18.95 | −0.01 | 5.86 | 0.20 | 0.33 | 0.00 | 0.20 |
| SEQID-03415 | 0.04 | 0.09 | 0.03 | 0.08 | 0.05 | 0.04 | 0.05 | 0.07 | 0.89 | −13.29 | −0.02 | 4.72 | 0.20 | 0.34 | 0.21 | 0.20 |
| SEQID-03416 | 0.04 | 0.04 | 0.04 | 0.03 | 0.07 | 0.02 | 0.02 | 0.02 | 0.35 | −21.96 | 0.12 | 11.31 | 0.24 | 0.31 | 0.00 | 0.28 |
| SEQID-03417 | 0.04 | 0.08 | 0.04 | 0.03 | 0.08 | 0.02 | 0.00 | 0.08 | 0.20 | −26.04 | 0.12 | 10.98 | 0.28 | 0.29 | 0.30 | 0.18 |
| SEQID-03418 | 0.06 | 0.02 | 0.03 | 0.02 | 0.02 | 0.00 | 0.08 | 0.09 | 0.42 | −23.37 | 0.04 | 9.88 | 0.30 | 0.27 | 0.13 | 0.19 |
| SEQID-03419 | 0.02 | 0.02 | 0.00 | 0.08 | 0.00 | 0.00 | 0.03 | 0.08 | 0.27 | −24.14 | −0.03 | 4.99 | 0.31 | 0.24 | 0.00 | 0.31 |
| SEQID-03420 | 0.02 | 0.04 | 0.03 | 0.07 | 0.02 | 0.01 | 0.04 | 0.06 | 0.29 | −23.80 | 0.00 | 7.24 | 0.23 | 0.33 | 0.22 | 0.21 |
| SEQID-03421 | 0.03 | 0.04 | 0.01 | 0.05 | 0.05 | 0.01 | 0.05 | 0.04 | 0.45 | −22.10 | 0.22 | 12.43 | 0.23 | 0.29 | 0.00 | 0.25 |
| SEQID-03422 | 0.04 | 0.04 | 0.03 | 0.03 | 0.08 | 0.02 | 0.02 | 0.03 | 0.33 | −20.50 | 0.15 | 11.74 | 0.26 | 0.29 | 0.00 | 0.25 |
| SEQID-03423 | 0.01 | 0.05 | 0.04 | 0.05 | 0.04 | 0.04 | 0.03 | 0.05 | 0.42 | −20.61 | −0.02 | 5.73 | 0.21 | 0.33 | 0.20 | 0.22 |
| SEQID-03424 | 0.01 | 0.04 | 0.01 | 0.04 | 0.04 | 0.03 | 0.04 | 0.01 | 0.39 | −23.48 | 0.17 | 12.30 | 0.27 | 0.30 | 0.00 | 0.25 |
| SEQID-03425 | 0.02 | 0.05 | 0.01 | 0.03 | 0.03 | 0.02 | 0.04 | 0.04 | 0.22 | −37.76 | −0.30 | 3.51 | 0.21 | 0.30 | 0.13 | 0.23 |
| SEQID-03426 | 0.01 | 0.04 | 0.03 | 0.04 | 0.05 | 0.03 | 0.04 | 0.06 | 0.28 | −23.41 | −0.02 | 6.39 | 0.00 | 0.33 | 0.00 | 0.23 |
| SEQID-03427 | 0.02 | 0.02 | 0.04 | 0.06 | 0.07 | 0.03 | 0.03 | 0.04 | 0.33 | −21.76 | −0.01 | 5.87 | 0.21 | 0.24 | 0.22 | 0.25 |
| SEQID-03428 | 0.02 | 0.02 | 0.05 | 0.08 | 0.05 | 0.00 | 0.04 | 0.03 | 0.35 | −20.38 | 0.01 | 8.68 | 0.22 | 0.33 | 0.00 | 0.23 |
| SEQID-03429 | 0.06 | 0.05 | 0.06 | 0.06 | 0.02 | 0.01 | 0.02 | 0.06 | 0.28 | −21.84 | 0.08 | 10.52 | 0.25 | 0.33 | 0.00 | 0.27 |
| SEQID-03430 | 0.02 | 0.00 | 0.10 | 0.08 | 0.10 | 0.02 | 0.00 | 0.01 | 0.17 | −24.63 | 0.00 | 6.95 | 0.29 | 0.25 | 0.32 | 0.32 |
| SEQID-03431 | 0.02 | 0.03 | 0.05 | 0.10 | 0.05 | 0.03 | 0.03 | 0.02 | 0.18 | −34.55 | 0.11 | 10.64 | 0.22 | 0.32 | 0.00 | 0.22 |
| SEQID-03432 | 0.04 | 0.05 | 0.02 | 0.05 | 0.04 | 0.03 | 0.03 | 0.07 | 0.27 | −23.50 | 0.15 | 11.53 | 0.25 | 0.28 | 0.00 | 0.22 |
| SEQID-03433 | 0.01 | 0.01 | 0.04 | 0.07 | 0.03 | 0.04 | 0.00 | 0.08 | 0.34 | −21.17 | −0.03 | 5.07 | 0.27 | 0.35 | 0.27 | 0.00 |
| SEQID-03434 | 0.01 | 0.04 | 0.00 | 0.00 | 0.05 | 0.00 | 0.06 | 0.13 | 0.30 | −24.25 | 0.24 | 12.58 | 0.25 | 0.28 | 0.00 | 0.26 |
| SEQID-03435 | 0.03 | 0.00 | 0.02 | 0.04 | 0.08 | 0.01 | 0.00 | 0.08 | 0.45 | −28.57 | 0.33 | 12.42 | 0.34 | 0.16 | 0.32 | 0.23 |
| SEQID-03436 | 0.07 | 0.05 | 0.05 | 0.05 | 0.05 | 0.01 | 0.02 | 0.07 | 0.43 | −20.41 | −0.01 | 6.26 | 0.22 | 0.30 | 0.26 | 0.30 |
| SEQID-03437 | 0.07 | 0.13 | 0.03 | 0.05 | 0.05 | 0.02 | 0.07 | 0.01 | 0.15 | −21.35 | −0.12 | 3.96 | 0.22 | 0.20 | 0.21 | 0.23 |
| SEQID-03438 | 0.02 | 0.07 | 0.03 | 0.06 | 0.04 | 0.02 | 0.05 | 0.05 | 0.31 | −27.53 | −0.26 | 3.23 | 0.24 | 0.28 | 0.00 | 0.27 |
| SEQID-03439 | 0.00 | 0.03 | 0.03 | 0.05 | 0.06 | 0.03 | 0.03 | 0.07 | 0.39 | −20.71 | −0.06 | 4.55 | 0.18 | 0.32 | 0.00 | 0.24 |
| SEQID-03440 | 0.00 | 0.03 | 0.03 | 0.06 | 0.05 | 0.09 | 0.03 | 0.08 | 0.33 | −21.25 | −0.05 | 4.65 | 0.21 | 0.23 | 0.22 | 0.23 |
| SEQID-03441 | 0.02 | 0.00 | 0.03 | 0.00 | 0.11 | 0.00 | 0.03 | 0.13 | 0.26 | −20.61 | 0.09 | 11.27 | 0.30 | 0.27 | 0.00 | 0.22 |
| SEQID-03442 | 0.04 | 0.08 | 0.04 | 0.02 | 0.08 | 0.00 | 0.00 | 0.08 | 0.23 | −26.48 | 0.12 | 11.03 | 0.26 | 0.27 | 0.00 | 0.29 |
| SEQID-03443 | 0.04 | 0.08 | 0.04 | 0.04 | 0.08 | 0.02 | 0.06 | 0.08 | 0.20 | −25.24 | 0.00 | 11.21 | 0.20 | 0.36 | 0.32 | 0.00 |
| SEQID-03444 | 0.01 | 0.02 | 0.16 | 0.09 | 0.09 | 0.00 | 0.00 | 0.05 | 0.16 | −15.46 | 0.13 | 8.07 | 0.23 | 0.38 | 0.00 | 0.00 |
| SEQID-03445 | 0.02 | 0.02 | 0.02 | 0.05 | 0.04 | 0.06 | 0.06 | 0.03 | 0.11 | −28.10 | 0.03 | 4.66 | 0.22 | 0.33 | 0.00 | 0.24 |
| SEQID-03446 | 0.03 | 0.06 | 0.04 | 0.04 | 0.04 | 0.02 | 0.02 | 0.06 | 0.42 | −22.29 | −0.05 | 5.11 | 0.30 | 0.52 | 0.20 | 0.21 |
| SEQID-03447 | 0.00 | 0.02 | 0.10 | 0.27 | 0.03 | 0.00 | 0.04 | 0.06 | 0.28 | −8.13 | −0.03 | 8.77 | 0.26 | 0.33 | 0.00 | 0.23 |
| SEQID-03448 | 0.02 | 0.01 | 0.02 | 0.07 | 0.05 | 0.01 | 0.03 | 0.05 | 0.25 | −23.80 | −0.02 | 5.21 | 0.25 | 0.36 | 0.20 | 0.22 |

TABLE 1-continued

| | | | | | | | | | | | | | | | | | |
|---|---|---|---|---|---|---|---|---|---|---|---|---|---|---|---|---|---|
| SEQID-03449 | 0.04 | 0.04 | 0.01 | 0.09 | 0.03 | 0.01 | 0.05 | 0.05 | -18.68 | 0.26 | 0.01 | 8.78 | 0.69 | 0.89 | 0.21 | 0.21 |
| SEQID-03450 | 0.02 | 0.08 | 0.01 | 0.10 | 0.04 | 0.05 | 0.03 | 0.05 | -16.79 | 0.24 | -0.01 | 5.68 | 0.62 | 0.91 | 0.21 | 0.22 |
| SEQID-03451 | 0.02 | 0.03 | 0.11 | 0.03 | 0.05 | 0.05 | 0.03 | 0.05 | -19.27 | 0.23 | -0.01 | 6.42 | 0.22 | 0.32 | 0.23 | 0.25 |
| SEQID-03452 | 0.05 | 0.02 | 0.03 | 0.09 | 0.04 | 0.01 | 0.04 | 0.05 | -27.05 | 0.26 | 0.15 | 10.77 | 0.23 | 0.30 | 0.26 | 0.26 |
| SEQID-03453 | 0.03 | 0.03 | 0.02 | 0.05 | 0.04 | 0.01 | 0.05 | 0.02 | -24.50 | 0.11 | 0.03 | 7.86 | 0.24 | 0.31 | 0.26 | 0.25 |
| SEQID-03454 | 0.03 | 0.02 | 0.04 | 0.06 | 0.05 | 0.04 | 0.02 | 0.05 | -22.24 | 0.31 | -0.02 | 5.35 | 0.23 | 0.34 | 0.22 | 0.25 |
| SEQID-03455 | 0.02 | 0.03 | 0.02 | 0.00 | 0.03 | 0.00 | 0.04 | 0.05 | -39.36 | 0.23 | -0.30 | 3.73 | 0.27 | 0.35 | 0.22 | 0.29 |
| SEQID-03456 | 0.01 | 0.00 | 0.11 | 0.02 | 0.01 | 0.01 | 0.00 | 0.02 | -33.42 | 0.00 | 0.11 | 10.67 | 0.32 | 0.31 | 0.30 | 0.31 |
| SEQID-03457 | 0.01 | 0.00 | 0.11 | 0.03 | 0.02 | 0.00 | 0.00 | 0.02 | -33.41 | 0.00 | 0.13 | 10.79 | 0.30 | 0.31 | 0.30 | 0.30 |
| SEQID-03458 | 0.01 | 0.06 | 0.06 | 0.09 | 0.04 | 0.01 | 0.00 | 0.02 | -20.51 | 0.13 | 0.13 | 11.83 | 0.26 | 0.31 | 0.34 | 0.27 |
| SEQID-03459 | 0.03 | 0.00 | 0.03 | 0.04 | 0.02 | 0.00 | 0.05 | 0.03 | -36.62 | 0.10 | 0.50 | 12.47 | 0.29 | 0.18 | 0.33 | 0.31 |
| SEQID-03460 | 0.04 | 0.04 | 0.03 | 0.05 | 0.07 | 0.01 | 0.04 | 0.05 | -20.18 | 0.49 | 0.00 | 6.51 | 0.22 | 0.32 | 0.00 | 0.24 |
| SEQID-03461 | 0.01 | 0.05 | 0.05 | 0.03 | 0.06 | 0.01 | 0.04 | 0.09 | -24.13 | 0.37 | 0.10 | 10.78 | 0.23 | 0.33 | 0.00 | 0.26 |
| SEQID-03462 | 0.05 | 0.04 | 0.03 | 0.03 | 0.04 | 0.04 | 0.06 | 0.03 | -30.24 | 0.13 | -0.01 | 6.54 | 0.27 | 0.31 | 0.25 | 0.00 |
| SEQID-03463 | 0.04 | 0.00 | 0.03 | 0.05 | 0.04 | 0.01 | 0.05 | 0.02 | -24.71 | 0.14 | 0.10 | 11.18 | 0.00 | 0.31 | 0.21 | 0.00 |
| SEQID-03464 | 0.07 | 0.05 | 0.02 | 0.04 | 0.02 | 0.03 | 0.00 | 0.02 | -20.78 | 0.43 | 0.15 | 13.24 | 0.25 | 0.28 | 0.00 | 0.22 |
| SEQID-03465 | 0.03 | 0.00 | 0.01 | 0.07 | 0.05 | 0.02 | 0.09 | 0.02 | -25.38 | 0.12 | 0.08 | 10.34 | 0.24 | 0.27 | 0.00 | 0.00 |
| SEQID-03466 | 0.02 | 0.00 | 0.03 | 0.09 | 0.02 | 0.02 | 0.05 | 0.05 | -24.70 | 0.38 | 0.15 | 11.02 | 0.22 | 0.26 | 0.24 | 0.00 |
| SEQID-03467 | 0.04 | 0.06 | 0.04 | 0.13 | 0.04 | 0.03 | 0.05 | 0.04 | -24.12 | 0.22 | 0.27 | 12.15 | 0.28 | 0.21 | 0.18 | 0.26 |
| SEQID-03468 | 0.04 | 0.04 | 0.00 | 0.03 | 0.02 | 0.09 | 0.00 | 0.03 | -21.62 | 0.41 | 0.20 | 12.60 | 0.30 | 0.20 | 0.34 | 0.30 |
| SEQID-03469 | 0.10 | 0.03 | 0.03 | 0.03 | 0.03 | 0.04 | 0.03 | 0.03 | -26.22 | 0.36 | 0.01 | 9.11 | 0.26 | 0.26 | 0.00 | 0.00 |
| SEQID-03470 | 0.02 | 0.02 | 0.04 | 0.06 | 0.05 | 0.03 | 0.04 | 0.04 | -23.20 | 0.32 | -0.02 | 5.35 | 0.23 | 0.33 | 0.22 | 0.25 |
| SEQID-03471 | 0.01 | 0.00 | 0.09 | 0.04 | 0.04 | 0.00 | 0.00 | 0.00 | -38.40 | 0.01 | 0.07 | 10.23 | 0.32 | 0.32 | 0.27 | 0.29 |
| SEQID-03472 | 0.02 | 0.03 | 0.03 | 0.05 | 0.01 | 0.02 | 0.01 | 0.04 | -20.01 | 0.23 | 0.02 | 8.25 | 0.31 | 0.30 | 0.34 | 0.30 |
| SEQID-03473 | 0.02 | 0.00 | 0.00 | 0.09 | 0.03 | 0.00 | 0.10 | 0.01 | -45.36 | 0.00 | 0.63 | 13.20 | 0.30 | 0.21 | 0.34 | 0.27 |
| SEQID-03474 | 0.02 | 0.07 | 0.06 | 0.11 | 0.03 | 0.01 | 0.03 | 0.03 | -20.32 | 0.14 | 0.14 | 12.12 | 0.25 | 0.31 | 0.00 | 0.25 |
| SEQID-03475 | 0.04 | 0.04 | 0.02 | 0.05 | 0.07 | 0.02 | 0.05 | 0.03 | -20.61 | 0.43 | 0.00 | 7.29 | 0.23 | 0.31 | 0.24 | 0.24 |
| SEQID-03476 | 0.02 | 0.04 | 0.01 | 0.05 | 0.05 | 0.01 | 0.07 | 0.04 | -21.37 | 0.41 | 0.21 | 12.16 | 0.21 | 0.29 | 0.18 | 0.00 |
| SEQID-03477 | 0.03 | 0.06 | 0.04 | 0.03 | 0.00 | 0.04 | 0.00 | 0.02 | -20.63 | 0.09 | 0.16 | 9.35 | 0.35 | 0.20 | 0.34 | 0.32 |
| SEQID-03478 | 0.00 | 0.06 | 0.04 | 0.03 | 0.00 | 0.04 | 0.00 | 0.06 | -20.63 | 0.16 | 0.12 | 8.80 | 0.36 | 0.21 | 0.33 | 0.32 |
| SEQID-03479 | 0.03 | 0.00 | 0.06 | 0.02 | 0.05 | 0.06 | 0.04 | 0.05 | -23.08 | 0.39 | 0.01 | 8.46 | 0.30 | 0.35 | 0.23 | 0.00 |
| SEQID-03480 | 0.03 | 0.02 | 0.03 | 0.04 | 0.02 | 0.05 | 0.04 | 0.03 | -25.60 | 0.37 | 0.12 | 10.07 | 0.25 | 0.30 | 0.25 | 0.28 |
| SEQID-03481 | 0.01 | 0.09 | 0.03 | 0.06 | 0.06 | 0.05 | 0.05 | 0.04 | -23.17 | 0.35 | -0.04 | 5.01 | 0.20 | 0.32 | 0.21 | 0.00 |
| SEQID-03482 | 0.04 | 0.03 | 0.06 | 0.05 | 0.05 | 0.02 | 0.03 | 0.06 | -24.86 | 0.31 | 0.01 | 8.90 | 0.25 | 0.33 | 0.00 | 0.00 |
| SEQID-03483 | 0.02 | 0.07 | 0.02 | 0.03 | 0.03 | 0.01 | 0.05 | 0.03 | -24.64 | 0.35 | 0.04 | 9.60 | 0.25 | 0.32 | 0.00 | 0.19 |
| SEQID-03484 | 0.04 | 0.06 | 0.04 | 0.04 | 0.07 | 0.02 | 0.02 | 0.03 | -22.32 | 0.36 | 0.18 | 11.65 | 0.24 | 0.26 | 0.18 | 0.27 |
| SEQID-03485 | 0.04 | 0.05 | 0.06 | 0.07 | 0.06 | 0.01 | 0.03 | 0.04 | -20.22 | 0.43 | 0.09 | 6.06 | 0.19 | 0.35 | 0.29 | 0.00 |
| SEQID-03486 | 0.05 | 0.01 | 0.00 | 0.05 | 0.03 | 0.06 | 0.06 | 0.07 | -21.49 | 0.30 | 0.31 | 11.05 | 0.19 | 0.21 | 0.00 | 0.24 |
| SEQID-03487 | 0.11 | 0.03 | 0.06 | 0.08 | 0.09 | 0.04 | 0.01 | 0.04 | -22.55 | 0.26 | 0.00 | 12.41 | 0.23 | 0.28 | 0.28 | 0.00 |
| SEQID-03488 | 0.05 | 0.03 | 0.01 | 0.04 | 0.01 | 0.01 | 0.01 | 0.06 | -22.64 | 0.42 | -0.05 | 4.32 | 0.22 | 0.37 | 0.22 | 0.00 |
| SEQID-03489 | 0.01 | 0.02 | 0.04 | 0.02 | 0.05 | 0.00 | 0.00 | 0.02 | -27.29 | 0.11 | -0.06 | 10.34 | 0.22 | 0.29 | 0.26 | 0.22 |
| SEQID-03490 | 0.03 | 0.06 | 0.03 | 0.05 | 0.05 | 0.01 | 0.07 | 0.05 | -25.31 | 0.43 | 0.14 | 5.41 | 0.22 | 0.30 | 0.00 | 0.25 |
| SEQID-03491 | 0.01 | 0.03 | 0.02 | 0.07 | 0.05 | 0.00 | 0.03 | 0.03 | -24.17 | 0.20 | -0.02 | 5.20 | 0.23 | 0.34 | 0.00 | 0.00 |
| SEQID-03492 | 0.07 | 0.09 | 0.03 | 0.02 | 0.05 | 0.01 | 0.05 | 0.03 | -20.36 | 0.49 | -0.03 | 10.76 | 0.23 | 0.32 | 0.00 | 0.25 |
| SEQID-03493 | 0.02 | 0.07 | 0.02 | 0.10 | 0.06 | 0.06 | 0.03 | 0.03 | -23.62 | 0.33 | 0.09 | 11.65 | 0.35 | 0.30 | 0.18 | 0.26 |
| SEQID-03494 | 0.04 | 0.04 | 0.02 | 0.05 | 0.03 | 0.01 | 0.05 | 0.04 | -30.69 | 0.48 | 0.31 | 12.73 | 0.21 | 0.34 | 0.29 | 0.24 |
| SEQID-03495 | 0.02 | 0.00 | 0.02 | 0.08 | 0.09 | 0.01 | 0.05 | 0.01 | -23.02 | 0.18 | 0.00 | 7.29 | 0.28 | 0.31 | 0.22 | 0.24 |
| SEQID-03496 | 0.03 | 0.04 | 0.06 | 0.07 | 0.06 | 0.00 | 0.00 | 0.03 | -34.51 | 0.02 | -0.05 | 4.51 | 0.27 | 0.24 | 0.33 | 0.30 |
| SEQID-03497 | 0.01 | 0.06 | 0.01 | 0.03 | 0.03 | 0.02 | 0.01 | 0.03 | -23.27 | 0.32 | 0.15 | 10.95 | 0.21 | 0.31 | 0.00 | 0.28 |
| SEQID-03498 | 0.02 | 0.02 | 0.05 | 0.06 | 0.05 | 0.03 | 0.02 | 0.03 | -28.10 | 0.22 | 0.04 | 10.07 | 0.21 | 0.33 | 0.00 | 0.00 |
| SEQID-03499 | 0.03 | 0.10 | 0.05 | 0.05 | 0.09 | 0.00 | 0.06 | 0.05 | -20.87 | 0.44 | -0.10 | 4.15 | 0.27 | 0.32 | 0.27 | 0.23 |
| SEQID-03500 | 0.01 | 0.05 | 0.01 | 0.04 | 0.07 | 0.01 | 0.08 | 0.03 | -20.42 | 0.41 | -0.08 | 11.02 | 0.25 | 0.31 | 0.00 | 0.00 |
| SEQID-03501 | 0.02 | 0.05 | 0.04 | 0.05 | 0.03 | 0.01 | 0.03 | 0.04 | -34.30 | 0.20 | 0.02 | 9.53 | 0.25 | 0.32 | 0.21 | 0.26 |

TABLE 1-continued

| | | | | | | | | | | | | | | | | |
|---|---|---|---|---|---|---|---|---|---|---|---|---|---|---|---|---|
| SEQID-03502 | 0.02 | 0.04 | 0.05 | 0.05 | 0.02 | 0.01 | 0.04 | 0.04 | -37.06 | 0.18 | -0.03 | 4.96 | 0.24 | 0.31 | 0.21 | 0.26 |
| SEQID-03503 | 0.01 | 0.01 | 0.01 | 0.08 | 0.03 | 0.00 | 0.06 | 0.04 | -21.65 | 0.32 | 0.13 | 11.37 | 0.28 | 0.30 | 0.00 | 0.26 |
| SEQID-03504 | 0.04 | 0.00 | 0.03 | 0.09 | 0.05 | 0.00 | 0.03 | 0.09 | -21.49 | 0.33 | -0.07 | 4.18 | 0.28 | 0.22 | 0.33 | 0.28 |
| SEQID-03505 | 0.02 | 0.05 | 0.03 | 0.06 | 0.09 | 0.02 | 0.06 | 0.03 | -23.32 | 0.27 | -0.02 | 6.29 | 0.22 | 0.32 | 0.00 | 0.00 |
| SEQID-03506 | 0.04 | 0.01 | 0.01 | 0.05 | 0.07 | 0.01 | 0.05 | 0.05 | -25.65 | 0.19 | 0.04 | 9.69 | 0.27 | 0.30 | 0.00 | 0.26 |
| SEQID-03507 | 0.03 | 0.06 | 0.04 | 0.06 | 0.04 | 0.00 | 0.04 | 0.03 | -20.67 | 0.37 | 0.00 | 6.69 | 0.18 | 0.33 | 0.00 | 0.20 |
| SEQID-03508 | 0.03 | 0.02 | 0.02 | 0.01 | 0.02 | 0.01 | 0.02 | 0.06 | -31.80 | 0.29 | -0.04 | 4.84 | 0.21 | 0.30 | 0.20 | 0.00 |
| SEQID-03509 | 0.02 | 0.02 | 0.04 | 0.06 | 0.05 | 0.03 | 0.01 | 0.04 | -21.76 | 0.32 | -0.01 | 5.87 | 0.30 | 0.33 | 0.22 | 0.25 |
| SEQID-03510 | 0.01 | 0.06 | 0.03 | 0.06 | 0.03 | 0.01 | 0.04 | 0.04 | -20.40 | 0.31 | -0.03 | 4.96 | 0.23 | 0.31 | 0.00 | 0.20 |
| SEQID-03511 | 0.02 | 0.04 | 0.02 | 0.03 | 0.04 | 0.03 | 0.01 | 0.04 | -34.54 | 0.18 | 0.11 | 10.66 | 0.22 | 0.32 | 0.00 | 0.22 |
| SEQID-03512 | 0.06 | 0.03 | 0.03 | 0.03 | 0.07 | 0.00 | 0.03 | 0.08 | -21.60 | 0.44 | 0.14 | 11.38 | 0.22 | 0.30 | 0.00 | 0.21 |
| SEQID-03513 | 0.01 | 0.07 | 0.03 | 0.03 | 0.04 | 0.02 | 0.04 | 0.06 | -22.41 | 0.48 | -0.01 | 6.17 | 0.24 | 0.34 | 0.24 | 0.00 |
| SEQID-03514 | 0.02 | 0.00 | 0.06 | 0.08 | 0.06 | 0.00 | 0.00 | 0.01 | -23.02 | 0.22 | -0.05 | 4.51 | 0.39 | 0.25 | 0.33 | 0.31 |
| SEQID-03515 | 0.05 | 0.04 | 0.05 | 0.04 | 0.09 | 0.02 | 0.03 | 0.06 | -22.65 | 0.33 | 0.11 | 10.98 | 0.33 | 0.28 | 0.00 | 0.00 |
| SEQID-03516 | 0.03 | 0.04 | 0.01 | 0.07 | 0.03 | 0.01 | 0.06 | 0.06 | -22.44 | 0.28 | 0.06 | 10.10 | 0.00 | 0.33 | 0.00 | 0.00 |
| SEQID-03517 | 0.02 | 0.07 | 0.02 | 0.11 | 0.05 | 0.06 | 0.03 | 0.03 | -23.64 | 0.23 | 0.31 | 12.59 | 0.31 | 0.20 | 0.26 | 0.29 |
| SEQID-03518 | 0.02 | 0.06 | 0.03 | 0.03 | 0.03 | 0.02 | 0.02 | 0.03 | -25.15 | 0.34 | 0.03 | 9.43 | 0.25 | 0.31 | 0.23 | 0.21 |
| SEQID-03519 | 0.03 | 0.03 | 0.02 | 0.02 | 0.04 | 0.00 | 0.02 | 0.09 | -22.86 | 0.50 | -0.02 | 5.88 | 0.19 | 0.31 | 0.00 | 0.22 |
| SEQID-03520 | 0.01 | 0.00 | 0.11 | 0.03 | 0.01 | 0.00 | 0.00 | 0.03 | -33.31 | 0.00 | 0.13 | 10.79 | 0.31 | 0.32 | 0.29 | 0.31 |
| SEQID-03521 | 0.01 | 0.09 | 0.05 | 0.01 | 0.02 | 0.02 | 0.00 | 0.14 | -24.48 | 0.31 | -0.02 | 5.75 | 0.27 | 0.30 | 0.00 | 0.26 |
| SEQID-03522 | 0.01 | 0.06 | 0.07 | 0.03 | 0.04 | 0.01 | 0.04 | 0.02 | -20.66 | 0.12 | 0.13 | 11.83 | 0.25 | 0.33 | 0.00 | 0.28 |
| SEQID-03523 | 0.03 | 0.09 | 0.06 | 0.05 | 0.04 | 0.04 | 0.03 | 0.02 | -20.10 | 0.31 | 0.06 | 8.20 | 0.33 | 0.19 | 0.33 | 0.31 |
| SEQID-03524 | 0.07 | 0.03 | 0.02 | 0.01 | 0.04 | 0.02 | 0.08 | 0.03 | -28.01 | 0.20 | 0.13 | 10.72 | 0.25 | 0.27 | 0.00 | 0.25 |
| SEQID-03525 | 0.01 | 0.06 | 0.06 | 0.09 | 0.04 | 0.01 | 0.06 | 0.04 | -21.42 | 0.14 | 0.13 | 11.89 | 0.38 | 0.33 | 0.00 | 0.29 |
| SEQID-03526 | 0.03 | 0.06 | 0.02 | 0.03 | 0.04 | 0.01 | 0.05 | 0.05 | -23.48 | 0.35 | 0.01 | 7.23 | 0.25 | 0.31 | 0.22 | 0.27 |
| SEQID-03527 | 0.03 | 0.05 | 0.05 | 0.01 | 0.01 | 0.01 | 0.06 | 0.06 | -29.27 | 0.21 | 0.02 | 8.32 | 0.22 | 0.30 | 0.24 | 0.22 |
| SEQID-03528 | 0.02 | 0.03 | 0.03 | 0.03 | 0.05 | 0.02 | 0.04 | 0.07 | -21.60 | 0.44 | -0.02 | 6.04 | 0.20 | 0.32 | 0.24 | 0.24 |
| SEQID-03529 | 0.03 | 0.02 | 0.02 | 0.05 | 0.01 | 0.01 | 0.06 | 0.09 | -23.91 | 0.47 | 0.05 | 10.14 | 0.24 | 0.31 | 0.00 | 0.00 |
| SEQID-03530 | 0.01 | 0.03 | 0.03 | 0.10 | 0.03 | 0.03 | 0.02 | 0.03 | -34.65 | 0.13 | 0.16 | 10.91 | 0.23 | 0.33 | 0.24 | 0.25 |
| SEQID-03531 | 0.02 | 0.02 | 0.01 | 0.06 | 0.06 | 0.05 | 0.00 | 0.07 | -23.63 | 0.20 | 0.24 | 12.74 | 0.30 | 0.23 | 0.00 | 0.30 |
| SEQID-03532 | 0.03 | 0.02 | 0.02 | 0.03 | 0.06 | 0.00 | 0.02 | 0.09 | -23.72 | 0.40 | -0.02 | 6.25 | 0.23 | 0.29 | 0.00 | 0.29 |
| SEQID-03533 | 0.03 | 0.07 | 0.03 | 0.01 | 0.03 | 0.01 | 0.06 | 0.04 | -26.72 | 0.24 | 0.11 | 10.79 | 0.25 | 0.29 | 0.24 | 0.25 |
| SEQID-03534 | 0.02 | 0.07 | 0.03 | 0.06 | 0.04 | 0.02 | 0.05 | 0.05 | -27.54 | 0.31 | -0.26 | 3.23 | 0.25 | 0.30 | 0.20 | 0.24 |
| SEQID-03535 | 0.03 | 0.05 | 0.01 | 0.04 | 0.04 | 0.01 | 0.07 | 0.06 | -21.01 | 0.48 | 0.04 | 9.70 | 0.00 | 0.30 | 0.00 | 0.00 |
| SEQID-03536 | 0.01 | 0.04 | 0.01 | 0.07 | 0.09 | 0.00 | 0.03 | 0.09 | -20.34 | 0.46 | 0.00 | 6.82 | 0.22 | 0.32 | 0.24 | 0.26 |
| SEQID-03537 | 0.02 | 0.06 | 0.01 | 0.02 | 0.03 | 0.02 | 0.06 | 0.07 | -27.33 | 0.33 | -0.24 | 3.35 | 0.27 | 0.31 | 0.00 | 0.26 |
| SEQID-03538 | 0.05 | 0.04 | 0.04 | 0.04 | 0.04 | 0.01 | 0.06 | 0.10 | -23.10 | 0.36 | 0.02 | 8.98 | 0.27 | 0.24 | 0.00 | 0.27 |
| SEQID-03539 | 0.00 | 0.09 | 0.04 | 0.04 | 0.04 | 0.01 | 0.04 | 0.09 | -20.60 | 0.47 | -0.01 | 6.61 | 0.21 | 0.31 | 0.20 | 0.22 |
| SEQID-03540 | 0.02 | 0.07 | 0.01 | 0.03 | 0.04 | 0.02 | 0.04 | 0.06 | -30.13 | 0.36 | -0.29 | 3.26 | 0.29 | 0.32 | 0.24 | 0.24 |
| SEQID-03541 | 0.03 | 0.06 | 0.04 | 0.09 | 0.03 | 0.01 | 0.02 | 0.02 | -20.94 | 0.29 | 0.04 | 10.11 | 0.22 | 0.33 | 0.00 | 0.22 |
| SEQID-03542 | 0.03 | 0.01 | 0.05 | 0.04 | 0.02 | 0.03 | 0.02 | 0.10 | -22.09 | 0.50 | -0.02 | 5.44 | 0.23 | 0.31 | 0.20 | 0.22 |
| SEQID-03543 | 0.04 | 0.05 | 0.01 | 0.04 | 0.03 | 0.02 | 0.03 | 0.04 | -37.89 | 0.20 | -0.30 | 3.53 | 0.24 | 0.30 | 0.00 | 0.22 |
| SEQID-03544 | 0.02 | 0.09 | 0.03 | 0.03 | 0.06 | 0.01 | 0.04 | 0.09 | -26.74 | 0.38 | 0.17 | 11.00 | 0.31 | 0.23 | 0.23 | 0.29 |
| SEQID-03545 | 0.04 | 0.06 | 0.04 | 0.04 | 0.03 | 0.03 | 0.05 | 0.03 | -24.11 | 0.18 | 0.27 | 12.15 | 0.18 | 0.29 | 0.00 | 0.27 |
| SEQID-03546 | 0.05 | 0.03 | 0.03 | 0.11 | 0.04 | 0.03 | 0.03 | 0.03 | -24.14 | 0.36 | 0.01 | 8.21 | 0.24 | 0.33 | 0.25 | 0.25 |
| SEQID-03547 | 0.01 | 0.05 | 0.01 | 0.05 | 0.04 | 0.01 | 0.05 | 0.02 | -20.44 | 0.34 | -0.07 | 4.32 | 0.20 | 0.30 | 0.25 | 0.21 |
| SEQID-03548 | 0.02 | 0.05 | 0.03 | 0.03 | 0.01 | 0.02 | 0.03 | 0.06 | -24.19 | 0.35 | 0.09 | 3.87 | 0.23 | 0.34 | 0.28 | 0.29 |
| SEQID-03549 | 0.01 | 0.06 | 0.05 | 0.05 | 0.05 | 0.01 | 0.05 | 0.04 | -21.47 | 0.39 | -0.01 | 5.98 | 0.23 | 0.30 | 0.00 | 0.25 |
| SEQID-03550 | 0.04 | 0.03 | 0.04 | 0.04 | 0.04 | 0.08 | 0.00 | 0.05 | -22.98 | 0.25 | -0.03 | 5.60 | 0.24 | 0.26 | 0.23 | 0.22 |
| SEQID-03551 | 0.01 | 0.04 | 0.03 | 0.02 | 0.00 | 0.00 | 0.06 | 0.02 | -30.43 | 0.46 | 0.38 | 12.96 | 0.25 | 0.28 | 0.24 | 0.21 |
| SEQID-03552 | 0.05 | 0.05 | 0.04 | 0.03 | 0.06 | 0.03 | 0.01 | 0.00 | -21.47 | 0.39 | -0.01 | 6.51 | 0.22 | 0.12 | 0.26 | 0.31 |
| SEQID-03553 | 0.03 | 0.03 | 0.02 | 0.03 | 0.05 | 0.01 | 0.04 | 0.04 | -23.53 | 0.48 | 0.13 | 11.75 | 0.22 | 0.30 | 0.00 | 0.24 |
| SEQID-03554 | 0.03 | 0.03 | 0.00 | 0.06 | 0.04 | 0.01 | 0.07 | 0.04 | -22.98 | 0.39 | 0.23 | 12.48 | 0.21 | 0.29 | 0.00 | 0.23 |

TABLE 1-continued

| | | | | | | | | | | | | | | | | | |
|---|---|---|---|---|---|---|---|---|---|---|---|---|---|---|---|---|---|
| SEQID-03555 | 0.01 | 0.09 | 0.01 | 0.03 | 0.01 | 0.01 | 0.01 | 0.04 | -33.41 | 0.19 | -0.02 | 5.58 | 0.21 | 0.34 | 0.19 | 0.00 |
| SEQID-03556 | 0.05 | 0.06 | 0.02 | 0.02 | 0.03 | 0.05 | 0.05 | 0.04 | -21.03 | 0.45 | 0.02 | 7.83 | 0.19 | 0.29 | 0.25 | 0.26 |
| SEQID-03557 | 0.09 | 0.06 | 0.05 | 0.04 | 0.05 | 0.01 | 0.03 | 0.07 | -20.34 | 0.44 | -0.01 | 6.51 | 0.21 | 0.33 | 0.00 | 0.23 |
| SEQID-03558 | 0.02 | 0.13 | 0.01 | 0.06 | 0.05 | 0.01 | 0.04 | 0.04 | -20.27 | 0.31 | 0.01 | 3.43 | 0.19 | 0.31 | 0.26 | 0.25 |
| SEQID-03559 | 0.01 | 0.05 | 0.02 | 0.07 | 0.05 | 0.01 | 0.04 | 0.04 | -21.00 | 0.47 | -0.02 | 5.09 | 0.25 | 0.35 | 0.00 | 0.20 |
| SEQID-03560 | 0.02 | 0.04 | 0.00 | 0.05 | 0.05 | 0.01 | 0.07 | 0.01 | -21.98 | 0.35 | 0.21 | 12.36 | 0.24 | 0.27 | 0.25 | 0.23 |
| SEQID-03561 | 0.09 | 0.03 | 0.07 | 0.06 | 0.03 | 0.07 | 0.05 | 0.04 | -23.21 | 0.17 | 0.05 | 8.98 | 0.24 | 0.25 | 0.26 | 0.23 |
| SEQID-03562 | 0.03 | 0.05 | 0.04 | 0.04 | 0.04 | 0.02 | 0.05 | 0.07 | -20.11 | 0.48 | -0.01 | 5.42 | 0.28 | 0.32 | 0.00 | 0.27 |
| SEQID-03563 | 0.02 | 0.04 | 0.03 | 0.09 | 0.10 | 0.00 | 0.09 | 0.10 | -21.01 | 0.16 | 0.23 | 12.72 | 0.22 | 0.21 | 0.00 | 0.24 |
| SEQID-03564 | 0.04 | 0.05 | 0.01 | 0.04 | 0.03 | 0.05 | 0.00 | 0.04 | -37.86 | 0.21 | -0.30 | 3.53 | 0.24 | 0.31 | 0.00 | 0.31 |
| SEQID-03565 | 0.01 | 0.07 | 0.03 | 0.05 | 0.04 | 0.02 | 0.06 | 0.02 | -23.04 | 0.33 | 0.01 | 7.44 | 0.24 | 0.30 | 0.23 | 0.22 |
| SEQID-03566 | 0.04 | 0.05 | 0.02 | 0.02 | 0.04 | 0.02 | 0.06 | 0.04 | -21.55 | 0.44 | 0.04 | 8.27 | 0.25 | 0.30 | 0.24 | 0.21 |
| SEQID-03567 | 0.01 | 0.04 | 0.06 | 0.04 | 0.06 | 0.01 | 0.07 | 0.04 | -22.19 | 0.29 | -0.09 | 4.12 | 0.21 | 0.31 | 0.26 | 0.25 |
| SEQID-03568 | 0.02 | 0.03 | 0.00 | 0.06 | 0.04 | 0.01 | 0.03 | 0.03 | -24.22 | 0.33 | 0.24 | 12.55 | 0.23 | 0.29 | 0.26 | 0.24 |
| SEQID-03569 | 0.03 | 0.05 | 0.05 | 0.01 | 0.06 | 0.03 | 0.07 | 0.05 | -21.51 | 0.27 | 0.02 | 7.62 | 0.26 | 0.28 | 0.26 | 0.22 |
| SEQID-03570 | 0.04 | 0.04 | 0.04 | 0.05 | 0.08 | 0.00 | 0.02 | 0.03 | -21.28 | 0.35 | 0.11 | 11.14 | 0.24 | 0.28 | 0.00 | 0.27 |
| SEQID-03571 | 0.02 | 0.00 | 0.07 | 0.09 | 0.06 | 0.00 | 0.00 | 0.01 | -23.06 | 0.21 | -0.05 | 4.50 | 0.30 | 0.25 | 0.33 | 0.33 |
| SEQID-03572 | 0.02 | 0.02 | 0.06 | 0.04 | 0.03 | 0.01 | 0.02 | 0.06 | -24.00 | 0.34 | 0.00 | 6.80 | 0.22 | 0.30 | 0.00 | 0.21 |
| SEQID-03573 | 0.06 | 0.00 | 0.02 | 0.02 | 0.04 | 0.04 | 0.01 | 0.05 | -33.26 | 0.16 | 0.18 | 11.10 | 0.30 | 0.32 | 0.25 | 0.23 |
| SEQID-03574 | 0.02 | 0.09 | 0.03 | 0.06 | 0.09 | 0.04 | 0.05 | 0.03 | -22.16 | 0.27 | 0.02 | 12.39 | 0.21 | 0.33 | 0.23 | 0.24 |
| SEQID-03575 | 0.09 | 0.04 | 0.01 | 0.02 | 0.02 | 0.03 | 0.04 | 0.03 | -23.30 | 0.22 | 0.06 | 10.14 | 0.22 | 0.29 | 0.28 | 0.24 |
| SEQID-03576 | 0.00 | 0.03 | 0.03 | 0.09 | 0.05 | 0.08 | 0.03 | 0.07 | -20.50 | 0.40 | -0.06 | 4.47 | 0.21 | 0.32 | 0.00 | 0.22 |
| SEQID-03577 | 0.04 | 0.04 | 0.04 | 0.04 | 0.04 | 0.03 | 0.02 | 0.03 | -21.01 | 0.39 | 0.13 | 11.51 | 0.28 | 0.31 | 0.00 | 0.28 |
| SEQID-03578 | 0.03 | 0.00 | 0.02 | 0.04 | 0.07 | 0.00 | 0.00 | 0.04 | -30.44 | 0.26 | 0.35 | 12.51 | 0.34 | 0.28 | 0.29 | 0.30 |
| SEQID-03579 | 0.07 | 0.01 | 0.06 | 0.05 | 0.04 | 0.02 | 0.06 | 0.01 | -22.91 | 0.12 | -0.03 | 5.10 | 0.25 | 0.16 | 0.23 | 0.25 |
| SEQID-03580 | 0.06 | 0.07 | 0.04 | 0.06 | 0.04 | 0.00 | 0.11 | 0.07 | -20.66 | 0.47 | 0.16 | 10.79 | 0.31 | 0.29 | 0.29 | 0.32 |
| SEQID-03581 | 0.01 | 0.00 | 0.04 | 0.06 | 0.06 | 0.00 | 0.00 | 0.00 | -31.33 | 0.10 | 0.28 | 11.81 | 0.24 | 0.15 | 0.00 | 0.25 |
| SEQID-03582 | 0.02 | 0.05 | 0.02 | 0.13 | 0.09 | 0.04 | 0.00 | 0.03 | -21.40 | 0.48 | 0.15 | 12.39 | 0.26 | 0.29 | 0.25 | 0.28 |
| SEQID-03583 | 0.04 | 0.05 | 0.05 | 0.04 | 0.02 | 0.00 | 0.00 | 0.00 | -21.55 | 0.34 | 0.10 | 11.60 | 0.28 | 0.17 | 0.00 | 0.31 |
| SEQID-03584 | 0.12 | 0.00 | 0.00 | 0.10 | 0.09 | 0.15 | 0.09 | 0.02 | -21.49 | 0.40 | -0.06 | 4.43 | 0.30 | 0.17 | 0.31 | 0.00 |
| SEQID-03585 | 0.01 | 0.01 | 0.08 | 0.03 | 0.03 | 0.04 | 0.04 | 0.03 | -24.54 | 0.11 | 0.00 | 6.92 | 0.28 | 0.17 | 0.29 | 0.30 |
| SEQID-03586 | 0.01 | 0.03 | 0.02 | 0.06 | 0.03 | 0.06 | 0.05 | 0.02 | -24.37 | 0.12 | 0.02 | 7.74 | 0.24 | 0.30 | 0.25 | 0.26 |
| SEQID-03587 | 0.01 | 0.00 | 0.03 | 0.03 | 0.06 | 0.02 | 0.01 | 0.05 | -26.49 | 0.18 | 0.08 | 10.72 | 0.23 | 0.32 | 0.27 | 0.00 |
| SEQID-03588 | 0.03 | 0.02 | 0.00 | 0.01 | 0.06 | 0.04 | 0.09 | 0.07 | -24.87 | 0.30 | 0.03 | 8.70 | 0.24 | 0.22 | 0.00 | 0.00 |
| SEQID-03589 | 0.08 | 0.03 | 0.08 | 0.03 | 0.02 | 0.00 | 0.00 | 0.07 | -21.33 | 0.38 | -0.07 | 4.34 | 0.25 | 0.28 | 0.00 | 0.26 |
| SEQID-03590 | 0.05 | 0.04 | 0.05 | 0.03 | 0.09 | 0.02 | 0.02 | 0.03 | -22.89 | 0.36 | 0.09 | 10.89 | 0.24 | 0.28 | 0.00 | 0.28 |
| SEQID-03591 | 0.05 | 0.02 | 0.04 | 0.03 | 0.04 | 0.04 | 0.03 | 0.05 | -21.51 | 0.26 | 0.09 | 10.64 | 0.26 | 0.33 | 0.20 | 0.19 |
| SEQID-03592 | 0.03 | 0.06 | 0.02 | 0.02 | 0.05 | 0.00 | 0.09 | 0.06 | -25.97 | 0.21 | 0.03 | 10.63 | 0.22 | 0.32 | 0.00 | 0.29 |
| SEQID-03593 | 0.02 | 0.02 | 0.04 | 0.05 | 0.00 | 0.03 | 0.02 | 0.02 | -30.48 | 0.37 | 0.14 | 12.51 | 0.29 | 0.14 | 0.00 | 0.00 |
| SEQID-03594 | 0.06 | 0.00 | 0.04 | 0.04 | 0.05 | 0.01 | 0.01 | 0.06 | -28.02 | 0.34 | 0.35 | 4.85 | 0.23 | 0.32 | 0.00 | 0.00 |
| SEQID-03595 | 0.09 | 0.02 | 0.03 | 0.05 | 0.03 | 0.01 | 0.04 | 0.02 | -24.47 | 0.12 | -0.03 | 12.35 | 0.23 | 0.14 | 0.00 | 0.26 |
| SEQID-03596 | 0.04 | 0.02 | 0.07 | 0.04 | 0.03 | 0.04 | 0.04 | 0.04 | -22.88 | 0.26 | 0.26 | 10.76 | 0.27 | 0.34 | 0.23 | 0.24 |
| SEQID-03597 | 0.09 | 0.03 | 0.04 | 0.03 | 0.04 | 0.00 | 0.00 | 0.07 | -25.66 | 0.39 | 0.09 | 4.87 | 0.26 | 0.27 | 0.27 | 0.25 |
| SEQID-03598 | 0.02 | 0.03 | 0.03 | 0.05 | 0.05 | 0.03 | 0.03 | 0.05 | -20.75 | 0.41 | -0.04 | 5.31 | 0.21 | 0.30 | 0.24 | 0.21 |
| SEQID-03599 | 0.01 | 0.04 | 0.04 | 0.05 | 0.05 | 0.04 | 0.02 | 0.04 | -20.97 | 0.39 | -0.03 | 9.10 | 0.21 | 0.33 | 0.20 | 0.21 |
| SEQID-03600 | 0.02 | 0.04 | 0.04 | 0.04 | 0.00 | 0.00 | 0.05 | 0.05 | -22.46 | 0.32 | 0.02 | 5.03 | 0.20 | 0.30 | 0.00 | 0.00 |
| SEQID-03601 | 0.03 | 0.06 | 0.04 | 0.03 | 0.06 | 0.01 | 0.02 | 0.10 | -24.18 | 0.14 | -0.03 | 12.31 | 0.27 | 0.31 | 0.24 | 0.30 |
| SEQID-03602 | 0.02 | 0.02 | 0.01 | 0.05 | 0.09 | 0.05 | 0.05 | 0.06 | -23.47 | 0.28 | -0.03 | 5.59 | 0.22 | 0.31 | 0.30 | 0.20 |
| SEQID-03603 | 0.02 | 0.04 | 0.02 | 0.04 | 0.08 | 0.03 | 0.02 | 0.08 | -22.08 | 0.46 | 0.00 | 5.71 | 0.20 | 0.31 | 0.22 | 0.00 |
| SEQID-03604 | 0.02 | 0.05 | 0.04 | 0.05 | 0.04 | 0.00 | 0.07 | 0.07 | -27.64 | 0.33 | -0.24 | 3.42 | 0.00 | 0.29 | 0.24 | 0.00 |
| SEQID-03605 | 0.05 | 0.04 | 0.04 | 0.02 | 0.04 | 0.02 | 0.06 | 0.10 | -23.12 | 0.36 | 0.02 | 8.98 | 0.25 | 0.23 | 0.30 | 0.30 |
| SEQID-03606 | 0.02 | 0.02 | 0.01 | 0.06 | 0.04 | 0.00 | 0.00 | 0.17 | -25.73 | 0.39 | 0.15 | 10.95 | 0.29 | 0.28 | 0.22 | 0.28 |
| SEQID-03607 | 0.03 | 0.04 | 0.02 | 0.05 | 0.02 | 0.02 | 0.05 | 0.04 | -36.23 | 0.21 | -0.26 | 3.59 | 0.22 | 0.31 | 0.23 | 0.22 |

TABLE 1-continued

| | | | | | | | | | | | | | | | |
|---|---|---|---|---|---|---|---|---|---|---|---|---|---|---|---|
| SEQID-03608 | 0.01 | 0.04 | 0.03 | 0.05 | 0.07 | 0.03 | 0.04 | 0.06 | -23.92 | 0.27 | -0.02 | 6.15 | 0.00 | 0.32 | 0.00 | 0.24 |
| SEQID-03609 | 0.05 | 0.00 | 0.03 | 0.03 | 0.02 | 0.04 | 0.01 | 0.04 | -32.73 | 0.13 | 0.19 | 11.18 | 0.25 | 0.32 | 0.23 | 0.00 |
| SEQID-03610 | 0.02 | 0.05 | 0.03 | 0.06 | 0.04 | 0.01 | 0.11 | 0.03 | -22.40 | 0.17 | 0.00 | 7.41 | 0.21 | 0.34 | 0.21 | 0.23 |
| SEQID-03611 | 0.01 | 0.00 | 0.10 | 0.04 | 0.03 | 0.00 | 0.00 | 0.03 | -33.57 | 0.01 | 0.09 | 10.58 | 0.29 | 0.33 | 0.26 | 0.32 |
| SEQID-03612 | 0.01 | 0.02 | 0.05 | 0.01 | 0.02 | 0.01 | 0.09 | 0.07 | -22.57 | 0.29 | 0.03 | 8.10 | 0.28 | 0.30 | 0.00 | 0.00 |
| SEQID-03613 | 0.09 | 0.03 | 0.04 | 0.07 | 0.03 | 0.01 | 0.00 | 0.06 | -23.00 | 0.27 | 0.09 | 10.90 | 0.28 | 0.28 | 0.23 | 0.24 |
| SEQID-03614 | 0.04 | 0.04 | 0.01 | 0.09 | 0.03 | 0.01 | 0.05 | 0.05 | -18.44 | 0.28 | 0.01 | 8.63 | 0.68 | 0.39 | 0.21 | 0.21 |
| SEQID-03615 | 0.01 | 0.01 | 0.04 | 0.04 | 0.03 | 0.00 | 0.04 | 0.06 | -28.73 | 0.25 | 0.15 | 10.85 | 0.23 | 0.34 | 0.34 | 0.00 |
| SEQID-03616 | 0.02 | 0.03 | 0.01 | 0.04 | 0.02 | 0.01 | 0.06 | 0.12 | -23.86 | 0.38 | -0.01 | 6.51 | 0.00 | 0.00 | 0.26 | 0.27 |
| SEQID-03617 | 0.02 | 0.04 | 0.10 | 0.02 | 0.03 | 0.00 | 0.05 | 0.03 | -21.83 | 0.41 | -0.15 | 12.23 | 0.28 | 0.31 | 0.28 | 0.28 |
| SEQID-03618 | 0.03 | 0.02 | 0.05 | 0.03 | 0.06 | 0.01 | 0.02 | 0.08 | -20.99 | 0.50 | 0.00 | 6.97 | 0.21 | 0.34 | 0.00 | 0.24 |
| SEQID-03619 | 0.01 | 0.04 | 0.02 | 0.04 | 0.04 | 0.01 | 0.03 | 0.08 | -20.09 | 0.47 | 0.00 | 7.10 | 0.00 | 0.35 | 0.23 | 0.00 |
| SEQID-03620 | 0.02 | 0.05 | 0.01 | 0.04 | 0.01 | 0.01 | 0.07 | 0.06 | -21.54 | 0.48 | 0.04 | 9.69 | 0.00 | 0.31 | 0.00 | 0.22 |
| SEQID-03621 | 0.03 | 0.05 | 0.02 | 0.04 | 0.01 | 0.02 | 0.03 | 0.04 | -35.16 | 0.19 | -0.27 | 3.58 | 0.25 | 0.31 | 0.00 | 0.24 |
| SEQID-03622 | 0.04 | 0.04 | 0.03 | 0.10 | 0.03 | 0.02 | 0.05 | 0.06 | -20.52 | 0.33 | 0.02 | 8.89 | 0.00 | 0.33 | 0.24 | 0.24 |
| SEQID-03623 | 0.01 | 0.03 | 0.01 | 0.09 | 0.03 | 0.02 | 0.02 | 0.04 | -22.33 | 0.41 | 0.14 | 11.77 | 0.32 | 0.32 | 0.00 | 0.24 |
| SEQID-03624 | 0.04 | 0.08 | 0.02 | 0.03 | 0.04 | 0.02 | 0.04 | 0.04 | -25.73 | 0.39 | -0.25 | 3.16 | 0.24 | 0.29 | 0.00 | 0.25 |
| SEQID-03625 | 0.02 | 0.12 | 0.02 | 0.01 | 0.04 | 0.03 | 0.03 | 0.04 | -22.01 | 0.50 | -0.04 | 1.68 | 0.25 | 0.32 | 0.24 | 0.25 |
| SEQID-03626 | 0.02 | 0.04 | 0.01 | 0.04 | 0.02 | 0.00 | 0.13 | 0.04 | -24.81 | 0.22 | -0.07 | 4.54 | 0.22 | 0.30 | 0.00 | 0.24 |
| SEQID-03627 | 0.03 | 0.02 | 0.01 | 0.01 | 0.07 | 0.05 | 0.02 | 0.10 | -23.81 | 0.15 | 0.24 | 12.43 | 0.31 | 0.24 | 0.00 | 0.26 |
| SEQID-03628 | 0.02 | 0.03 | 0.01 | 0.01 | 0.09 | 0.02 | 0.06 | 0.06 | -20.14 | 0.29 | 0.09 | 10.41 | 0.24 | 0.33 | 0.00 | 0.00 |
| SEQID-03629 | 0.02 | 0.02 | 0.03 | 0.04 | 0.02 | 0.00 | 0.00 | 0.09 | -21.66 | 0.47 | 0.11 | 11.35 | 0.31 | 0.23 | 0.26 | 0.00 |
| SEQID-03630 | 0.02 | 0.04 | 0.02 | 0.05 | 0.03 | 0.02 | 0.05 | 0.04 | -35.69 | 0.23 | -0.29 | 3.45 | 0.20 | 0.30 | 0.24 | 0.21 |
| SEQID-03631 | 0.05 | 0.07 | 0.03 | 0.05 | 0.05 | 0.02 | 0.00 | 0.06 | -19.72 | 0.34 | -0.06 | 4.46 | 0.40 | 0.54 | 0.00 | 0.22 |
| SEQID-03632 | 0.02 | 0.02 | 0.02 | 0.04 | 0.05 | 0.01 | 0.05 | 0.02 | -20.44 | 0.47 | 0.02 | 7.98 | 0.22 | 0.33 | 0.23 | 0.28 |
| SEQID-03633 | 0.01 | 0.02 | 0.06 | 0.09 | 0.05 | 0.01 | 0.02 | 0.06 | -17.34 | 0.22 | -0.06 | 4.54 | 0.22 | 0.33 | 0.24 | 0.25 |
| SEQID-03634 | 0.04 | 0.01 | 0.05 | 0.05 | 0.06 | 0.01 | 0.04 | 0.06 | -17.51 | 0.47 | -0.01 | 6.05 | 0.20 | 0.16 | 0.00 | 0.20 |
| SEQID-03635 | 0.02 | 0.00 | 0.03 | 0.08 | 0.05 | 0.13 | 0.00 | 0.04 | -23.52 | 0.09 | 0.13 | 9.75 | 0.37 | 0.16 | 0.33 | 0.33 |
| SEQID-03636 | 0.03 | 0.07 | 0.00 | 0.10 | 0.04 | 0.04 | 0.04 | 0.09 | -20.21 | 0.35 | 0.15 | 11.00 | 0.33 | 0.33 | 0.30 | 0.31 |
| SEQID-03637 | 0.03 | 0.04 | 0.05 | 0.09 | 0.05 | 0.01 | 0.03 | 0.04 | -21.12 | 0.13 | 0.02 | 7.73 | 0.20 | 0.33 | 0.00 | 0.00 |
| SEQID-03638 | 0.03 | 0.04 | 0.05 | 0.05 | 0.09 | 0.01 | 0.03 | 0.04 | -21.08 | 0.13 | 0.02 | 7.72 | 0.21 | 0.33 | 0.00 | 0.20 |
| SEQID-03639 | 0.09 | 0.04 | 0.04 | 0.04 | 0.04 | 0.06 | 0.07 | 0.06 | -20.76 | 0.41 | 0.02 | 9.59 | 0.23 | 0.31 | 0.21 | 0.00 |
| SEQID-03640 | 0.02 | 0.04 | 0.05 | 0.09 | 0.05 | 0.01 | 0.02 | 0.04 | -29.86 | 0.19 | -0.08 | 4.39 | 0.22 | 0.34 | 0.00 | 0.23 |
| SEQID-03641 | 0.01 | 0.02 | 0.20 | 0.04 | 0.03 | 0.01 | 0.01 | 0.03 | -14.62 | 0.15 | 0.00 | 7.76 | 0.59 | 0.30 | 0.20 | 0.39 |
| SEQID-03642 | 0.02 | 0.03 | 0.08 | 0.12 | 0.06 | 0.06 | 0.01 | 0.04 | -20.93 | 0.21 | 0.00 | 7.12 | 0.18 | 0.38 | 0.19 | 0.19 |
| SEQID-03643 | 0.02 | 0.00 | 0.02 | 0.02 | 0.02 | 0.00 | 0.05 | 0.05 | -27.81 | 0.37 | 0.11 | 11.10 | 0.00 | 0.32 | 0.00 | 0.20 |
| SEQID-03644 | 0.06 | 0.00 | 0.04 | 0.00 | 0.06 | 0.00 | 0.14 | 0.15 | -23.87 | 0.48 | 0.25 | 12.14 | 0.29 | 0.13 | 0.32 | 0.33 |
| SEQID-03645 | 0.01 | 0.01 | 0.03 | 0.00 | 0.00 | 0.00 | 0.05 | 0.14 | -27.88 | 0.26 | 0.12 | 11.11 | 0.23 | 0.30 | 0.26 | 0.23 |
| SEQID-03646 | 0.01 | 0.02 | 0.00 | 0.04 | 0.09 | 0.00 | 0.02 | 0.03 | -21.23 | 0.40 | 0.16 | 11.45 | 0.29 | 0.30 | 0.00 | 0.30 |
| SEQID-03647 | 0.09 | 0.04 | 0.03 | 0.02 | 0.04 | 0.03 | 0.05 | 0.09 | -24.81 | 0.15 | 0.23 | 12.43 | 0.30 | 0.24 | 0.00 | 0.26 |
| SEQID-03648 | 0.04 | 0.02 | 0.04 | 0.09 | 0.04 | 0.00 | 0.00 | 0.04 | -36.23 | 0.05 | 0.17 | 10.80 | 0.31 | 0.25 | 0.29 | 0.31 |
| SEQID-03649 | 0.00 | 0.04 | 0.02 | 0.02 | 0.01 | 0.03 | 0.03 | 0.00 | -17.45 | 0.28 | 0.00 | 6.65 | 0.27 | 0.41 | 0.23 | 0.21 |
| SEQID-03650 | 0.02 | 0.03 | 0.05 | 0.09 | 0.11 | 0.06 | 0.04 | 0.06 | -18.43 | 0.31 | -0.03 | 4.61 | 0.22 | 0.33 | 0.21 | 0.21 |
| SEQID-03651 | 0.01 | 0.01 | 0.05 | 0.05 | 0.07 | 0.07 | 0.07 | 0.06 | -28.98 | 0.34 | -0.15 | 3.87 | 0.44 | 0.51 | 0.23 | 0.21 |
| SEQID-03652 | 0.04 | 0.02 | 0.01 | 0.00 | 0.00 | 0.05 | 0.14 | 0.05 | -24.65 | 0.29 | -0.04 | 5.01 | 0.27 | 0.22 | 0.00 | 0.31 |
| SEQID-03653 | 0.03 | 0.01 | 0.05 | 0.06 | 0.11 | 0.00 | 0.05 | 0.07 | -25.79 | 0.15 | 0.00 | 6.98 | 0.23 | 0.34 | 0.32 | 0.25 |
| SEQID-03654 | 0.04 | 0.02 | 0.00 | 0.06 | 0.04 | 0.04 | 0.02 | 0.03 | -24.44 | 0.39 | -0.05 | 4.69 | 0.29 | 0.23 | 0.27 | 0.29 |
| SEQID-03655 | 0.02 | 0.04 | 0.03 | 0.02 | 0.04 | 0.03 | 0.05 | 0.07 | -21.52 | 0.40 | 0.09 | 10.57 | 0.21 | 0.32 | 0.32 | 0.23 |
| SEQID-03656 | 0.02 | 0.12 | 0.02 | 0.08 | 0.04 | 0.00 | 0.05 | 0.04 | -20.58 | 0.35 | 0.26 | 11.66 | 0.27 | 0.18 | 0.00 | 0.30 |
| SEQID-03657 | 0.01 | 0.09 | 0.03 | 0.07 | 0.07 | 0.03 | 0.05 | 0.02 | -22.79 | 0.22 | 0.15 | 12.43 | 0.27 | 0.30 | 0.30 | 0.26 |
| SEQID-03658 | 0.03 | 0.03 | 0.13 | 0.08 | 0.03 | 0.00 | 0.02 | 0.03 | -24.84 | 0.20 | -0.01 | 5.98 | 0.23 | 0.33 | 0.27 | 0.31 |
| SEQID-03659 | 0.01 | 0.09 | 0.01 | 0.04 | 0.04 | 0.02 | 0.14 | 0.03 | -25.61 | 0.25 | 0.11 | 10.02 | 0.22 | 0.28 | 0.22 | 0.25 |
| SEQID-03660 | 0.07 | 0.10 | 0.03 | 0.06 | 0.05 | 0.00 | 0.02 | 0.01 | -26.25 | 0.07 | 0.31 | 12.76 | 0.26 | 0.21 | 0.00 | 0.28 |

TABLE 1-continued

| | | | | | | | | | | | | | | | | | |
|---|---|---|---|---|---|---|---|---|---|---|---|---|---|---|---|---|---|
| SEQID-03661 | 0.09 | 0.00 | 0.04 | 0.04 | 0.00 | 0.00 | 0.00 | 0.11 | −36.34 | 0.39 | 0.29 | 11.49 | 0.32 | 0.15 | 0.33 | 0.32 |
| SEQID-03662 | 0.03 | 0.09 | 0.04 | 0.06 | 0.07 | 0.02 | 0.05 | 0.08 | −24.61 | 0.25 | 0.10 | 10.56 | 0.26 | 0.32 | 0.30 | 0.00 |
| SEQID-03663 | 0.01 | 0.05 | 0.06 | 0.02 | 0.06 | 0.00 | 0.01 | 0.04 | −20.55 | 0.45 | −0.04 | 4.54 | 0.30 | 0.32 | 0.26 | 0.26 |
| SEQID-03664 | 0.05 | 0.03 | 0.04 | 0.07 | 0.03 | 0.00 | 0.02 | 0.01 | −35.30 | 0.23 | −0.28 | 3.63 | 0.28 | 0.31 | 0.25 | 0.24 |
| SEQID-03665 | 0.01 | 0.05 | 0.00 | 0.05 | 0.05 | 0.00 | 0.05 | 0.04 | −27.65 | 0.27 | 0.15 | 10.99 | 0.27 | 0.30 | 0.00 | 0.00 |
| SEQID-03666 | 0.01 | 0.07 | 0.03 | 0.04 | 0.02 | 0.00 | 0.02 | 0.04 | −23.16 | 0.37 | 0.01 | 8.05 | 0.44 | 0.59 | 0.00 | 0.21 |
| SEQID-03667 | 0.01 | 0.08 | 0.00 | 0.09 | 0.02 | 0.00 | 0.04 | 0.03 | −26.95 | 0.21 | 0.17 | 11.40 | 0.28 | 0.23 | 0.00 | 0.26 |
| SEQID-03668 | 0.01 | 0.04 | 0.02 | 0.05 | 0.04 | 0.00 | 0.00 | 0.09 | −25.82 | 0.49 | −0.08 | 4.18 | 0.27 | 0.33 | 0.26 | 0.27 |
| SEQID-03669 | 0.03 | 0.07 | 0.02 | 0.02 | 0.07 | 0.00 | 0.10 | 0.05 | −35.38 | 0.28 | −0.07 | 4.41 | 0.27 | 0.23 | 0.00 | 0.13 |
| SEQID-03670 | 0.04 | 0.03 | 0.03 | 0.05 | 0.00 | 0.02 | 0.06 | 0.03 | −28.28 | 0.10 | −0.22 | 11.46 | 0.26 | 0.23 | 0.00 | 0.23 |
| SEQID-03671 | 0.06 | 0.04 | 0.03 | 0.03 | 0.06 | 0.00 | 0.03 | 0.05 | −23.14 | 0.15 | −0.04 | 4.59 | 0.30 | 0.30 | 0.19 | 0.00 |
| SEQID-03672 | 0.02 | 0.11 | 0.06 | 0.06 | 0.06 | 0.00 | 0.02 | 0.05 | −24.34 | 0.38 | 0.22 | 11.00 | 0.25 | 0.25 | 0.29 | 0.28 |
| SEQID-03673 | 0.03 | 0.03 | 0.00 | 0.07 | 0.07 | 0.00 | 0.06 | 0.03 | −22.85 | 0.16 | 0.20 | 11.53 | 0.00 | 0.23 | 0.28 | 0.20 |
| SEQID-03674 | 0.02 | 0.00 | 0.03 | 0.04 | 0.06 | 0.00 | 0.00 | 0.14 | −25.40 | 0.34 | 0.11 | 11.18 | 0.25 | 0.31 | 0.00 | 0.00 |
| SEQID-03675 | 0.06 | 0.00 | 0.01 | 0.06 | 0.04 | 0.00 | 0.00 | 0.04 | −26.36 | 0.07 | 0.23 | 12.05 | 0.33 | 0.20 | 0.00 | 0.30 |
| SEQID-03676 | 0.02 | 0.04 | 0.06 | 0.04 | 0.08 | 0.00 | 0.02 | 0.04 | −22.75 | 0.14 | −0.22 | 3.08 | 0.28 | 0.28 | 0.00 | 0.00 |
| SEQID-03677 | 0.07 | 0.04 | 0.01 | 0.04 | 0.07 | 0.02 | 0.05 | 0.04 | −25.14 | 0.25 | −0.08 | 4.58 | 0.28 | 0.30 | 0.00 | 0.23 |
| SEQID-03678 | 0.01 | 0.00 | 0.00 | 0.03 | 0.03 | 0.00 | 0.02 | 0.07 | −20.36 | 0.41 | 0.14 | 11.42 | 0.25 | 0.30 | 0.00 | 0.26 |
| SEQID-03679 | 0.02 | 0.02 | 0.02 | 0.06 | 0.05 | 0.09 | 0.08 | 0.09 | −21.80 | 0.30 | 0.01 | 8.83 | 0.22 | 0.28 | 0.20 | 0.24 |
| SEQID-03680 | 0.15 | 0.03 | 0.03 | 0.02 | 0.05 | 0.00 | 0.03 | 0.03 | −24.71 | 0.20 | −0.04 | 4.53 | 0.23 | 0.29 | 0.22 | 0.23 |
| SEQID-03681 | 0.08 | 0.06 | 0.01 | 0.03 | 0.04 | 0.00 | 0.05 | 0.03 | −22.61 | 0.19 | −0.05 | 4.29 | 0.23 | 0.31 | 0.00 | 0.00 |
| SEQID-03682 | 0.01 | 0.00 | 0.00 | 0.03 | 0.03 | 0.00 | 0.02 | 0.07 | −20.36 | 0.41 | 0.14 | 11.57 | 0.28 | 0.30 | 0.00 | 0.24 |
| SEQID-03683 | 0.02 | 0.04 | 0.03 | 0.04 | 0.11 | 0.00 | 0.02 | 0.05 | −22.90 | 0.13 | −0.22 | 3.08 | 0.32 | 0.27 | 0.00 | 0.00 |
| SEQID-03684 | 0.04 | 0.03 | 0.08 | 0.02 | 0.08 | 0.03 | 0.00 | 0.09 | −20.40 | 0.40 | −0.14 | 3.73 | 0.28 | 0.31 | 0.00 | 0.22 |
| SEQID-03685 | 0.09 | 0.00 | 0.01 | 0.02 | 0.07 | 0.00 | 0.03 | 0.04 | −25.89 | 0.17 | 0.25 | 12.44 | 0.30 | 0.24 | 0.19 | 0.00 |
| SEQID-03686 | 0.03 | 0.02 | 0.00 | 0.05 | 0.03 | 0.00 | 0.02 | 0.05 | −22.07 | 0.36 | 0.17 | 11.95 | 0.26 | 0.29 | 0.00 | 0.21 |
| SEQID-03687 | 0.07 | 0.06 | 0.02 | 0.05 | 0.04 | 0.00 | 0.00 | 0.02 | −28.97 | 0.12 | 0.39 | 13.58 | 0.27 | 0.15 | 0.00 | 0.23 |
| SEQID-03688 | 0.02 | 0.00 | 0.02 | 0.02 | 0.04 | 0.00 | 0.00 | 0.16 | −27.06 | 0.42 | 0.12 | 11.21 | 0.24 | 0.31 | 0.30 | 0.29 |
| SEQID-03689 | 0.01 | 0.03 | 0.03 | 0.07 | 0.09 | 0.01 | 0.11 | 0.07 | −17.78 | 0.25 | 0.00 | 6.87 | 0.22 | 0.32 | 0.00 | 0.00 |
| SEQID-03690 | 0.02 | 0.03 | 0.04 | 0.09 | 0.05 | 0.08 | 0.10 | 0.03 | −15.75 | 0.26 | 0.00 | 6.53 | 0.00 | 0.33 | 0.21 | 0.22 |
| SEQID-03691 | 0.02 | 0.03 | 0.00 | 0.05 | 0.06 | 0.01 | 0.07 | 0.06 | −30.38 | 0.14 | 0.03 | 9.69 | 0.23 | 0.35 | 0.00 | 0.20 |
| SEQID-03692 | 0.00 | 0.01 | 0.04 | 0.05 | 0.07 | 0.03 | 0.03 | 0.03 | −19.20 | 0.26 | 0.00 | 8.72 | 0.00 | 0.36 | 0.00 | 0.20 |
| SEQID-03693 | 0.05 | 0.05 | 0.05 | 0.07 | 0.05 | 0.01 | 0.05 | 0.02 | −22.32 | 0.13 | 0.00 | 6.55 | 0.19 | 0.33 | 0.19 | 0.20 |
| SEQID-03694 | 0.03 | 0.03 | 0.05 | 0.09 | 0.05 | 0.02 | 0.04 | 0.05 | −26.41 | 0.21 | 0.05 | 10.06 | 0.20 | 0.33 | 0.00 | 0.21 |
| SEQID-03695 | 0.02 | 0.04 | 0.05 | 0.04 | 0.06 | 0.03 | 0.01 | 0.05 | −22.65 | 0.19 | 0.02 | 9.92 | 0.21 | 0.33 | 0.17 | 0.00 |
| SEQID-03696 | 0.05 | 0.05 | 0.04 | 0.04 | 0.03 | 0.02 | 0.05 | 0.02 | −31.03 | 0.20 | 0.03 | 9.50 | 0.21 | 0.31 | 0.18 | 0.23 |
| SEQID-03697 | 0.05 | 0.02 | 0.00 | 0.00 | 0.04 | 0.00 | 0.04 | 0.07 | −39.00 | 0.31 | −0.28 | 3.65 | 0.26 | 0.34 | 0.23 | 0.23 |
| SEQID-03698 | 0.13 | 0.00 | 0.00 | 0.00 | 0.03 | 0.00 | 0.00 | 0.03 | −39.85 | 0.11 | 0.56 | 13.35 | 0.32 | 0.10 | 0.32 | 0.32 |
| SEQID-03699 | 0.02 | 0.03 | 0.02 | 0.05 | 0.05 | 0.00 | 0.00 | 0.05 | −34.84 | 0.17 | −0.16 | 4.16 | 0.30 | 0.33 | 0.24 | 0.26 |
| SEQID-03700 | 0.00 | 0.06 | 0.03 | 0.07 | 0.06 | 0.00 | 0.06 | 0.10 | −28.31 | 0.40 | −0.19 | 3.59 | 0.25 | 0.28 | 0.00 | 0.00 |
| SEQID-03701 | 0.00 | 0.03 | 0.03 | 0.03 | 0.05 | 0.00 | 0.06 | 0.09 | −23.52 | 0.27 | 0.00 | 7.53 | 0.33 | 0.22 | 0.00 | 0.00 |
| SEQID-03702 | 0.00 | 0.03 | 0.05 | 0.05 | 0.05 | 0.00 | 0.06 | 0.09 | −24.58 | 0.31 | −0.02 | 4.92 | 0.33 | 0.20 | 0.00 | 0.31 |
| SEQID-03703 | 0.00 | 0.03 | 0.05 | 0.03 | 0.05 | 0.00 | 0.06 | 0.09 | −24.92 | 0.27 | −0.02 | 5.78 | 0.36 | 0.22 | 0.00 | 0.27 |
| SEQID-03704 | 0.02 | 0.02 | 0.00 | 0.03 | 0.04 | 0.05 | 0.05 | 0.03 | −37.34 | 0.12 | 0.51 | 12.70 | 0.33 | 0.21 | 0.33 | 0.30 |
| SEQID-03705 | 0.01 | 0.06 | 0.02 | 0.03 | 0.01 | 0.00 | 0.04 | 0.06 | −26.05 | 0.18 | 0.26 | 11.32 | 0.22 | 0.31 | 0.25 | 0.21 |
| SEQID-03706 | 0.01 | 0.03 | 0.04 | 0.01 | 0.09 | 0.00 | 0.02 | 0.03 | −28.24 | 0.23 | −0.08 | 4.34 | 0.34 | 0.34 | 0.27 | 0.28 |
| SEQID-03707 | 0.00 | 0.03 | 0.07 | 0.07 | 0.02 | 0.00 | 0.02 | 0.03 | −21.71 | 0.33 | −0.01 | 6.49 | 0.43 | 0.10 | 0.26 | 0.28 |
| SEQID-03708 | 0.01 | 0.01 | 0.05 | 0.07 | 0.06 | 0.05 | 0.15 | 0.05 | −29.44 | 0.24 | −0.16 | 3.86 | 0.27 | 0.33 | 0.22 | 0.22 |
| SEQID-03709 | 0.04 | 0.01 | 0.01 | 0.03 | 0.01 | 0.00 | 0.00 | 0.02 | −28.31 | 0.07 | −0.01 | 3.59 | 0.28 | 0.49 | 0.00 | 0.30 |
| SEQID-03710 | 0.06 | 0.02 | 0.03 | 0.01 | 0.05 | 0.06 | 0.02 | 0.00 | −25.89 | 0.07 | 0.13 | 5.26 | 0.31 | 0.31 | 0.25 | 0.00 |
| SEQID-03711 | 0.02 | 0.02 | 0.04 | 0.03 | 0.06 | 0.00 | 0.03 | 0.01 | −25.32 | 0.12 | 0.30 | 13.06 | 0.30 | 0.20 | 0.20 | 0.28 |
| SEQID-03712 | 0.01 | 0.01 | 0.01 | 0.00 | 0.03 | 0.05 | 0.15 | 0.04 | −30.09 | 0.32 | −0.16 | 11.95 | 0.35 | 0.42 | 0.25 | 0.22 |
| SEQID-03713 | 0.01 | 0.03 | 0.07 | 0.09 | 0.12 | 0.03 | 0.03 | 0.05 | −24.01 | 0.27 | −0.03 | 4.92 | 0.20 | 0.31 | 0.00 | 0.25 |

TABLE 1-continued

| SEQID | | | | | | | | | | | | | | | | |
|---|---|---|---|---|---|---|---|---|---|---|---|---|---|---|---|---|
| SEQID-03714 | 0.02 | 0.06 | 0.04 | 0.09 | 0.06 | 0.01 | 0.02 | 0.02 | 0.23 | -0.04 | -21.00 | 4.70 | 0.20 | 0.33 | 0.20 | 0.20 |
| SEQID-03715 | 0.05 | 0.02 | 0.02 | 0.04 | 0.00 | 0.00 | 0.08 | 0.01 | 0.06 | -0.01 | -23.13 | 6.12 | 0.25 | 0.34 | 0.24 | 0.27 |
| SEQID-03716 | 0.00 | 0.05 | 0.12 | 0.00 | 0.00 | 0.00 | 0.12 | 0.02 | 0.20 | -0.12 | -23.49 | 4.05 | 0.33 | 0.20 | 0.29 | 0.30 |
| SEQID-03717 | 0.03 | 0.01 | 0.00 | 0.07 | 0.11 | 0.00 | 0.02 | 0.03 | 0.15 | -0.01 | -25.89 | 6.15 | 0.24 | 0.34 | 0.27 | 0.26 |
| SEQID-03718 | 0.03 | 0.04 | 0.00 | 0.02 | 0.16 | 0.00 | 0.13 | 0.00 | 0.17 | 0.12 | -20.29 | 10.45 | 0.30 | 0.12 | 0.29 | 0.00 |
| SEQID-03719 | 0.02 | 0.08 | 0.00 | 0.03 | 0.05 | 0.03 | 0.09 | 0.07 | 0.48 | 0.07 | -20.63 | 9.72 | 0.30 | 0.17 | 0.00 | 0.27 |
| SEQID-03720 | 0.02 | 0.04 | 0.03 | 0.04 | 0.09 | 0.00 | 0.02 | 0.04 | 0.15 | -0.22 | -22.75 | 3.08 | 0.28 | 0.23 | 0.00 | 0.28 |
| SEQID-03721 | 0.02 | 0.05 | 0.05 | 0.09 | 0.07 | 0.01 | 0.03 | 0.03 | 0.13 | -0.03 | -20.94 | 5.06 | 0.19 | 0.34 | 0.17 | 0.19 |
| SEQID-03722 | 0.03 | 0.00 | 0.04 | 0.04 | 0.00 | 0.00 | 0.00 | 0.05 | 0.47 | 0.30 | -26.69 | 12.31 | 0.32 | 0.15 | 0.32 | 0.32 |
| SEQID-03723 | 0.02 | 0.03 | 0.03 | 0.08 | 0.04 | 0.00 | 0.04 | 0.05 | 0.19 | -0.07 | -24.41 | 4.67 | 0.18 | 0.33 | 0.18 | 0.21 |
| SEQID-03724 | 0.02 | 0.03 | 0.01 | 0.07 | 0.07 | 0.00 | 0.03 | 0.02 | 0.11 | -0.10 | -25.20 | 4.27 | 0.24 | 0.28 | 0.24 | 0.20 |
| SEQID-03725 | 0.00 | 0.05 | 0.04 | 0.05 | 0.03 | 0.00 | 0.09 | 0.07 | 0.36 | -0.12 | -23.75 | 4.11 | 0.20 | 0.30 | 0.23 | 0.26 |
| SEQID-03726 | 0.00 | 0.09 | 0.03 | 0.05 | 0.04 | 0.00 | 0.05 | 0.08 | 0.43 | -0.14 | -22.85 | 3.96 | 0.23 | 0.34 | 0.26 | 0.27 |
| SEQID-03727 | 0.02 | 0.00 | 0.00 | 0.05 | 0.02 | 0.00 | 0.05 | 0.04 | 0.04 | 0.54 | -39.39 | 12.73 | 0.38 | 0.24 | 0.32 | 0.28 |
| SEQID-03728 | 0.04 | 0.01 | 0.01 | 0.05 | 0.04 | 0.00 | 0.02 | 0.02 | 0.06 | 0.01 | -26.12 | 7.70 | 0.27 | 0.31 | 0.00 | 0.29 |
| SEQID-03729 | 0.03 | 0.12 | 0.03 | 0.05 | 0.04 | 0.01 | 0.04 | 0.03 | 0.38 | 0.05 | -20.53 | 10.07 | 0.22 | 0.28 | 0.00 | 0.22 |
| SEQID-03730 | 0.00 | 0.05 | 0.04 | 0.07 | 0.09 | 0.03 | 0.05 | 0.07 | 0.44 | -0.04 | -15.74 | 4.58 | 0.22 | 0.33 | 0.00 | 0.00 |
| SEQID-03731 | 0.01 | 0.00 | 0.03 | 0.04 | 0.02 | 0.00 | 0.04 | 0.03 | 0.04 | 0.32 | -37.31 | 12.55 | 0.31 | 0.32 | 0.30 | 0.26 |
| SEQID-03732 | 0.02 | 0.00 | 0.09 | 0.04 | 0.04 | 0.00 | 0.05 | 0.02 | 0.06 | 0.25 | -28.34 | 12.48 | 0.27 | 0.31 | 0.31 | 0.27 |
| SEQID-03733 | 0.01 | 0.10 | 0.04 | 0.07 | 0.06 | 0.00 | 0.05 | 0.10 | 0.34 | -0.09 | -20.09 | 4.15 | 0.27 | 0.32 | 0.25 | 0.26 |
| SEQID-03734 | 0.00 | 0.02 | 0.02 | 0.01 | 0.05 | 0.00 | 0.03 | 0.02 | 0.00 | 0.36 | -32.91 | 12.46 | 0.26 | 0.18 | 0.31 | 0.27 |
| SEQID-03735 | 0.04 | 0.01 | 0.01 | 0.09 | 0.05 | 0.00 | 0.03 | 0.02 | 0.09 | -0.02 | -28.66 | 4.97 | 0.28 | 0.32 | 0.26 | 0.29 |
| SEQID-03736 | 0.03 | 0.03 | 0.06 | 0.05 | 0.10 | 0.00 | 0.00 | 0.02 | 0.06 | -0.02 | -32.42 | 4.98 | 0.35 | 0.18 | 0.35 | 0.25 |
| SEQID-03737 | 0.02 | 0.00 | 0.07 | 0.15 | 0.04 | 0.00 | 0.00 | 0.03 | 0.01 | 0.25 | -23.09 | 12.40 | 0.26 | 0.34 | 0.28 | 0.25 |
| SEQID-03738 | 0.13 | 0.06 | 0.03 | 0.07 | 0.03 | 0.00 | 0.09 | 0.02 | 0.22 | 0.02 | -20.71 | 8.20 | 0.24 | 0.28 | 0.00 | 0.00 |
| SEQID-03739 | 0.02 | 0.04 | 0.01 | 0.03 | 0.01 | 0.00 | 0.02 | 0.05 | 0.40 | 0.00 | -23.42 | 6.97 | 0.27 | 0.32 | 0.25 | 0.24 |
| SEQID-03740 | 0.02 | 0.07 | 0.02 | 0.01 | 0.00 | 0.06 | 0.05 | 0.03 | 0.30 | 0.26 | -22.98 | 11.93 | 0.32 | 0.23 | 0.33 | 0.00 |
| SEQID-03741 | 0.03 | 0.03 | 0.03 | 0.03 | 0.04 | 0.00 | 0.00 | 0.02 | 0.12 | -0.01 | -35.11 | 6.55 | 0.27 | 0.34 | 0.24 | 0.25 |
| SEQID-03742 | 0.01 | 0.05 | 0.04 | 0.04 | 0.06 | 0.00 | 0.02 | 0.03 | 0.23 | -0.03 | -21.70 | 5.63 | 0.20 | 0.33 | 0.00 | 0.19 |
| SEQID-03743 | 0.03 | 0.03 | 0.02 | 0.02 | 0.02 | 0.00 | 0.09 | 0.03 | 0.22 | 0.18 | -23.45 | 11.09 | 0.23 | 0.26 | 0.21 | 0.22 |
| SEQID-03744 | 0.02 | 0.03 | 0.01 | 0.08 | 0.00 | 0.03 | 0.03 | 0.05 | 0.34 | 0.02 | -30.92 | 7.34 | 0.23 | 0.30 | 0.22 | 0.25 |
| SEQID-03745 | 0.01 | 0.04 | 0.02 | 0.01 | 0.01 | 0.00 | 0.01 | 0.04 | 0.31 | 0.12 | -30.77 | 10.52 | 0.20 | 0.27 | 0.00 | 0.26 |
| SEQID-03746 | 0.06 | 0.03 | 0.03 | 0.09 | 0.05 | 0.00 | 0.05 | 0.02 | 0.16 | -0.02 | -20.04 | 5.80 | 0.21 | 0.34 | 0.00 | 0.00 |
| SEQID-03747 | 0.04 | 0.05 | 0.02 | 0.16 | 0.09 | 0.00 | 0.02 | 0.00 | 0.21 | 0.01 | -23.42 | 8.43 | 0.24 | 0.31 | 0.00 | 0.25 |
| SEQID-03748 | 0.01 | 0.09 | 0.04 | 0.14 | 0.05 | 0.00 | 0.05 | 0.01 | 0.13 | 0.04 | -22.65 | 9.95 | 0.23 | 0.33 | 0.00 | 0.22 |
| SEQID-03749 | 0.01 | 0.11 | 0.04 | 0.04 | 0.06 | 0.02 | 0.07 | 0.00 | 0.16 | -0.09 | -23.48 | 4.43 | 0.26 | 0.24 | 0.31 | 0.28 |
| SEQID-03750 | 0.02 | 0.09 | 0.07 | 0.03 | 0.10 | 0.04 | 0.05 | 0.01 | 0.24 | -0.10 | -20.25 | 10.30 | 0.28 | 0.29 | 0.22 | 0.28 |
| SEQID-03751 | 0.03 | 0.04 | 0.03 | 0.14 | 0.04 | 0.00 | 0.04 | 0.03 | 0.34 | 0.16 | -25.76 | 10.96 | 0.32 | 0.28 | 0.00 | 0.25 |
| SEQID-03752 | 0.05 | 0.01 | 0.01 | 0.07 | 0.05 | 0.03 | 0.02 | 0.04 | 0.08 | -0.04 | -30.53 | 4.83 | 0.29 | 0.31 | 0.25 | 0.30 |
| SEQID-03753 | 0.01 | 0.03 | 0.04 | 0.08 | 0.05 | 0.00 | 0.02 | 0.05 | 0.34 | 0.14 | -23.34 | 11.07 | 0.00 | 0.30 | 0.27 | 0.20 |
| SEQID-03754 | 0.03 | 0.02 | 0.01 | 0.07 | 0.07 | 0.00 | 0.03 | 0.04 | 0.09 | 0.00 | -28.01 | 7.55 | 0.29 | 0.31 | 0.24 | 0.32 |
| SEQID-03755 | 0.05 | 0.00 | 0.01 | 0.07 | 0.05 | 0.03 | 0.03 | 0.02 | 0.07 | -0.01 | -27.72 | 5.27 | 0.29 | 0.34 | 0.24 | 0.30 |
| SEQID-03756 | 0.02 | 0.02 | 0.14 | 0.06 | 0.02 | 0.01 | 0.01 | 0.05 | 0.29 | 0.08 | -21.30 | 11.45 | 0.25 | 0.17 | 0.24 | 0.24 |
| SEQID-03757 | 0.06 | 0.05 | 0.04 | 0.01 | 0.06 | 0.06 | 0.05 | 0.00 | 0.08 | 0.34 | -28.84 | 12.70 | 0.27 | 0.49 | 0.00 | 0.29 |
| SEQID-03758 | 0.01 | 0.06 | 0.05 | 0.03 | 0.06 | 0.04 | 0.05 | 0.04 | 0.26 | -0.13 | -30.63 | 4.06 | 0.32 | 0.30 | 0.00 | 0.22 |
| SEQID-03759 | 0.03 | 0.02 | 0.02 | 0.15 | 0.09 | 0.00 | 0.01 | 0.03 | 0.32 | 0.08 | -22.70 | 11.04 | 0.25 | 0.41 | 0.00 | 0.22 |
| SEQID-03760 | 0.01 | 0.03 | 0.03 | 0.12 | 0.08 | 0.03 | 0.06 | 0.09 | 0.43 | -0.03 | -14.72 | 4.43 | 0.22 | 0.27 | 0.28 | 0.23 |
| SEQID-03761 | 0.02 | 0.14 | 0.05 | 0.04 | 0.04 | 0.03 | 0.08 | 0.03 | 0.13 | 0.13 | -26.38 | 10.96 | 0.25 | 0.26 | 0.32 | 0.25 |
| SEQID-03762 | 0.02 | 0.02 | 0.01 | 0.04 | 0.05 | 0.00 | 0.00 | 0.05 | 0.39 | 0.13 | -26.13 | 10.85 | 0.27 | 0.30 | 0.21 | 0.29 |
| SEQID-03761 | 0.01 | 0.00 | 0.07 | 0.00 | 0.02 | 0.05 | 0.00 | 0.14 | 0.19 | -0.16 | -28.55 | 3.84 | 0.47 | 0.53 | 0.30 | 0.20 |
| SEQID-03764 | 0.05 | 0.03 | 0.06 | 0.07 | 0.06 | 0.00 | 0.00 | 0.04 | 0.01 | -0.05 | -35.85 | 4.72 | 0.33 | 0.18 | 0.24 | 0.24 |
| SEQID-03765 | 0.05 | 0.06 | 0.05 | 0.04 | 0.03 | 0.00 | 0.02 | 0.00 | 0.44 | 0.02 | -21.74 | 8.22 | 0.33 | 0.29 | 0.00 | 0.00 |
| SEQID-03766 | 0.05 | 0.03 | 0.04 | 0.05 | 0.10 | 0.00 | 0.00 | 0.00 | 0.07 | -0.02 | -33.95 | 5.02 | 0.27 | 0.15 | 0.33 | 0.33 |

TABLE 1-continued

| | | | | | | | | | | | | | | | | | | |
|---|---|---|---|---|---|---|---|---|---|---|---|---|---|---|---|---|---|---|
| SEQID-03767 | 0.02 | 0.02 | 0.00 | 0.03 | 0.04 | 0.00 | 0.05 | 0.04 | -38.70 | 0.11 | 0.53 | 12.73 | 0.33 | 0.21 | 0.33 | 0.29 |
| SEQID-03768 | 0.00 | 0.05 | 0.03 | 0.11 | 0.11 | 0.05 | 0.07 | 0.06 | -15.13 | 0.40 | -0.06 | 3.96 | 0.21 | 0.38 | 0.00 | 0.21 |
| SEQID-03769 | 0.01 | 0.07 | 0.02 | 0.02 | 0.07 | 0.00 | 0.02 | 0.06 | -26.47 | 0.34 | -0.02 | 6.35 | 0.31 | 0.32 | 0.25 | 0.32 |
| SEQID-03770 | 0.03 | 0.06 | 0.06 | 0.02 | 0.04 | 0.00 | 0.04 | 0.04 | -21.97 | 0.50 | 0.04 | 9.61 | 0.27 | 0.23 | 0.32 | 0.00 |
| SEQID-03771 | 0.00 | 0.05 | 0.12 | 0.00 | 0.00 | 0.03 | 0.11 | 0.03 | -24.09 | 0.12 | -0.11 | 4.21 | 0.33 | 0.20 | 0.29 | 0.33 |
| SEQID-03772 | 0.00 | 0.00 | 0.12 | 0.03 | 0.00 | 0.00 | 0.12 | 0.03 | -23.97 | 0.13 | -0.11 | 4.21 | 0.33 | 0.26 | 0.35 | 0.35 |
| SEQID-03773 | 0.00 | 0.07 | 0.03 | 0.01 | 0.07 | 0.00 | 0.06 | 0.04 | -20.39 | 0.22 | -0.02 | 5.00 | 0.28 | 0.33 | 0.00 | 0.24 |
| SEQID-03774 | 0.05 | 0.02 | 0.04 | 0.00 | 0.02 | 0.00 | 0.02 | 0.03 | -36.47 | 0.14 | -0.05 | 4.75 | 0.26 | 0.20 | 0.25 | 0.00 |
| SEQID-03775 | 0.02 | 0.05 | 0.09 | 0.00 | 0.04 | 0.00 | 0.12 | 0.02 | -23.92 | 0.09 | -0.12 | 4.05 | 0.33 | 0.33 | 0.29 | 0.33 |
| SEQID-03776 | 0.02 | 0.03 | 0.04 | 0.10 | 0.06 | 0.08 | 0.10 | 0.04 | -15.43 | 0.25 | 0.00 | 6.53 | 0.19 | 0.20 | 0.00 | 0.21 |
| SEQID-03777 | 0.07 | 0.02 | 0.01 | 0.01 | 0.14 | 0.00 | 0.02 | 0.02 | -25.61 | 0.08 | 0.05 | 10.21 | 0.31 | 0.34 | 0.00 | 0.29 |
| SEQID-03778 | 0.03 | 0.02 | 0.04 | 0.09 | 0.05 | 0.00 | 0.03 | 0.06 | -22.47 | 0.20 | -0.06 | 4.44 | 0.00 | 0.31 | 0.00 | 0.22 |
| SEQID-03779 | 0.07 | 0.05 | 0.02 | 0.03 | 0.07 | 0.00 | 0.00 | 0.05 | -31.12 | 0.15 | 0.38 | 13.11 | 0.30 | 0.17 | 0.30 | 0.33 |
| SEQID-03780 | 0.04 | 0.03 | 0.04 | 0.05 | 0.00 | 0.02 | 0.05 | 0.05 | -25.62 | 0.07 | 0.20 | 11.73 | 0.25 | 0.28 | 0.00 | 0.24 |
| SEQID-03781 | 0.02 | 0.05 | 0.03 | 0.02 | 0.09 | 0.00 | 0.03 | 0.09 | -23.27 | 0.32 | 0.17 | 10.49 | 0.30 | 0.18 | 0.29 | 0.30 |
| SEQID-03782 | 0.08 | 0.06 | 0.01 | 0.03 | 0.04 | 0.00 | 0.00 | 0.03 | -21.91 | 0.20 | -0.04 | 4.37 | 0.23 | 0.31 | 0.00 | 0.00 |
| SEQID-03783 | 0.07 | 0.06 | 0.01 | 0.08 | 0.05 | 0.00 | 0.02 | 0.01 | -26.74 | 0.11 | 0.32 | 12.83 | 0.24 | 0.20 | 0.00 | 0.27 |
| SEQID-03784 | 0.02 | 0.04 | 0.01 | 0.041 | 0.05 | 0.00 | 0.14 | 0.04 | -23.57 | 0.27 | -0.06 | 4.60 | 0.28 | 0.33 | 0.00 | 0.25 |
| SEQID-03785 | 0.01 | 0.08 | 0.01 | 0.02 | 0.06 | 0.04 | 0.09 | 0.06 | -22.59 | 0.26 | 0.05 | 9.40 | 0.17 | 0.31 | 0.23 | 0.22 |
| SEQID-03786 | 0.04 | 0.08 | 0.03 | 0.06 | 0.04 | 0.02 | 0.14 | 0.01 | -23.30 | 0.15 | -0.08 | 4.43 | 0.28 | 0.25 | 0.00 | 0.26 |
| SEQID-03787 | 0.11 | 0.04 | 0.02 | 0.03 | 0.03 | 0.00 | 0.01 | 0.05 | -23.23 | 0.25 | -0.03 | 4.64 | 0.22 | 0.29 | 0.00 | 0.24 |
| SEQID-03788 | 0.02 | 0.02 | 0.01 | 0.04 | 0.04 | 0.06 | 0.00 | 0.14 | -26.07 | 0.39 | 0.13 | 10.85 | 0.27 | 0.26 | 0.31 | 0.29 |
| SEQID-03789 | 0.02 | 0.08 | 0.04 | 0.06 | 0.09 | 0.00 | 0.03 | 0.08 | -22.78 | 0.32 | 0.10 | 10.83 | 0.28 | 0.32 | 0.00 | 0.27 |
| SEQID-03790 | 0.03 | 0.02 | 0.00 | 0.07 | 0.05 | 0.00 | 0.00 | 0.17 | -22.17 | 0.45 | 0.10 | 10.80 | 0.25 | 0.24 | 0.00 | 0.19 |
| SEQID-03791 | 0.03 | 0.13 | 0.03 | 0.06 | 0.05 | 0.00 | 0.07 | 0.04 | -22.87 | 0.25 | 0.04 | 9.47 | 0.27 | 0.30 | 0.24 | 0.26 |
| SEQID-03792 | 0.02 | 0.06 | 0.05 | 0.14 | 0.05 | 0.00 | 0.03 | 0.02 | -20.96 | 0.15 | 0.04 | 10.05 | 0.23 | 0.33 | 0.00 | 0.20 |
| SEQID-03793 | 0.01 | 0.04 | 0.01 | 0.01 | 0.01 | 0.00 | 0.02 | 0.02 | -32.65 | 0.32 | 0.02 | 7.39 | 0.18 | 0.31 | 0.23 | 0.27 |
| SEQID-03794 | 0.02 | 0.03 | 0.04 | 0.02 | 0.02 | 0.02 | 0.14 | 0.05 | -22.93 | 0.22 | 0.03 | 9.12 | 0.23 | 0.30 | 0.21 | 0.00 |
| SEQID-03795 | 0.02 | 0.08 | 0.02 | 0.07 | 0.06 | 0.06 | 0.03 | 0.02 | -20.65 | 0.38 | 0.27 | 11.98 | 0.33 | 0.21 | 0.27 | 0.28 |
| SEQID-03796 | 0.02 | 0.05 | 0.02 | 0.13 | 0.03 | 0.06 | 0.00 | 0.03 | -23.50 | 0.29 | 0.31 | 13.02 | 0.26 | 0.18 | 0.28 | 0.32 |
| SEQID-03797 | 0.01 | 0.01 | 0.07 | 0.08 | 0.07 | 0.00 | 0.02 | 0.06 | -27.59 | 0.13 | 0.28 | 11.65 | 0.23 | 0.32 | 0.00 | 0.26 |
| SEQID-03798 | 0.01 | 0.01 | 0.05 | 0.00 | 0.01 | 0.05 | 0.15 | 0.05 | -28.87 | 0.24 | -0.15 | 3.88 | 0.43 | 0.49 | 0.22 | 0.21 |
| SEQID-03799 | 0.03 | 0.02 | 0.02 | 0.05 | 0.03 | 0.00 | 0.02 | 0.05 | -21.47 | 0.18 | 0.03 | 9.78 | 0.26 | 0.30 | 0.27 | 0.29 |
| SEQID-03800 | 0.02 | 0.03 | 0.12 | 0.09 | 0.05 | 0.01 | 0.01 | 0.04 | -20.32 | 0.21 | 0.05 | 11.22 | 0.23 | 0.34 | 0.21 | 0.24 |
| SEQID-03801 | 0.03 | 0.05 | 0.16 | 0.09 | 0.04 | 0.01 | 0.07 | 0.01 | -20.88 | 0.15 | 0.03 | 9.74 | 0.21 | 0.33 | 0.00 | 0.21 |
| SEQID-03802 | 0.04 | 0.02 | 0.04 | 0.04 | 0.06 | 0.00 | 0.05 | 0.10 | -24.31 | 0.18 | 0.26 | 12.22 | 0.31 | 0.24 | 0.22 | 0.00 |
| SEQID-03803 | 0.02 | 0.05 | 0.07 | 0.04 | 0.05 | 0.00 | 0.01 | 0.04 | -21.78 | 0.20 | 0.04 | 10.22 | 0.21 | 0.31 | 0.22 | 0.20 |
| SEQID-03804 | 0.04 | 0.06 | 0.04 | 0.08 | 0.04 | 0.00 | 0.00 | 0.03 | -28.60 | 0.12 | 0.00 | 6.83 | 0.27 | 0.21 | 0.25 | 0.31 |
| SEQID-03805 | 0.03 | 0.00 | 0.03 | 0.06 | 0.06 | 0.00 | 0.00 | 0.00 | -28.57 | 0.42 | 0.33 | 12.42 | 0.34 | 0.16 | 0.23 | 0.30 |
| SEQID-03806 | 0.01 | 0.04 | 0.02 | 0.04 | 0.04 | 0.02 | 0.07 | 0.16 | -24.25 | 0.46 | 0.06 | 9.93 | 0.00 | 0.26 | 0.34 | 0.00 |
| SEQID-03807 | 0.03 | 0.02 | 0.01 | 0.05 | 0.05 | 0.06 | 0.00 | 0.04 | -23.55 | 0.21 | 0.16 | 11.44 | 0.27 | 0.21 | 0.00 | 0.31 |
| SEQID-03808 | 0.03 | 0.02 | 0.00 | 0.07 | 0.05 | 0.00 | 0.00 | 0.17 | -22.29 | 0.45 | 0.08 | 10.60 | 0.26 | 0.18 | 0.00 | 0.00 |
| SEQID-03809 | 0.03 | 0.09 | 0.04 | 0.05 | 0.06 | 0.02 | 0.02 | 0.09 | -24.75 | 0.35 | 0.10 | 10.81 | 0.23 | 0.32 | 0.22 | 0.28 |
| SEQID-03810 | 0.02 | 0.05 | 0.13 | 0.05 | 0.02 | 0.01 | 0.03 | 0.05 | -20.20 | 0.30 | -0.02 | 5.86 | 0.20 | 0.34 | 0.25 | 0.23 |
| SEQID-03811 | 0.05 | 0.00 | 0.03 | 0.08 | 0.03 | 0.00 | 0.00 | 0.03 | -30.72 | 0.19 | -0.15 | 4.15 | 0.31 | 0.33 | 0.23 | 0.28 |
| SEQID-03812 | 0.06 | 0.04 | 0.10 | 0.07 | 0.00 | 0.01 | 0.01 | 0.07 | -31.97 | 0.09 | -0.06 | 4.71 | 0.26 | 0.32 | 0.25 | 0.23 |
| SEQID-03813 | 0.04 | 0.02 | 0.04 | 0.01 | 0.03 | 0.01 | 0.01 | 0.05 | -21.63 | 0.35 | 0.00 | 6.96 | 0.34 | 0.31 | 0.23 | 0.30 |
| SEQID-03814 | 0.02 | 0.0 | 0.02 | 0.10 | 0.05 | 0.06 | 0.03 | 0.05 | -22.85 | 0.32 | 0.26 | 12.23 | 0.35 | 0.24 | 0.26 | 0.00 |
| SEQID-03815 | 0.01 | 0.06 | 0.00 | 0.04 | 0.04 | 0.00 | 0.05 | 0.06 | -26.78 | 0.29 | 0.16 | 11.14 | 0.26 | 0.28 | 0.25 | 0.27 |
| SEQID-03816 | 0.02 | 0.12 | 0.02 | 0.08 | 0.08 | 0.03 | 0.05 | 0.02 | -21.98 | 0.31 | 0.28 | 11.91 | 0.25 | 0.17 | 0.30 | 0.22 |
| SEQID-03817 | 0.01 | 0.07 | 0.02 | 0.06 | 0.02 | 0.00 | 0.07 | 0.03 | -28.81 | 0.21 | 0.17 | 11.50 | 0.27 | 0.23 | 0.25 | 0.23 |
| SEQID-03818 | 0.02 | 0.04 | 0.02 | 0.03 | 0.04 | 0.02 | 0.05 | 0.05 | -20.79 | 0.41 | 0.09 | 10.56 | 0.20 | 0.31 | 0.00 | 0.22 |
| SEQID-03819 | 0.03 | 0.05 | 0.05 | 0.07 | 0.12 | 0.00 | 0.02 | 0.05 | -25.03 | 0.29 | -0.14 | 3.85 | 0.21 | 0.33 | 0.00 | 0.22 |

TABLE 1-continued

| | | | | | | | | | | | | | | | | | | |
|---|---|---|---|---|---|---|---|---|---|---|---|---|---|---|---|---|---|---|
| SEQID-03820 | 0.04 | 0.04 | 0.00 | 0.07 | 0.11 | 0.00 | 0.00 | 0.01 | -25.34 | 0.08 | -0.06 | 4.48 | 0.32 | 0.25 | 0.26 | 0.27 |
| SEQID-03821 | 0.02 | 0.06 | 0.04 | 0.02 | 0.02 | 0.08 | 0.07 | 0.04 | -25.02 | 0.16 | 0.01 | 7.95 | 0.21 | 0.33 | 0.00 | 0.23 |
| SEQID-03822 | 0.03 | 0.05 | 0.05 | 0.14 | 0.05 | 0.03 | 0.02 | 0.03 | -21.29 | 0.32 | 0.00 | 6.89 | 0.23 | 0.31 | 0.18 | 0.22 |
| SEQID-03823 | 0.02 | 0.03 | 0.02 | 0.04 | 0.02 | 0.03 | 0.14 | 0.06 | -30.29 | 0.05 | 0.06 | 9.65 | 0.24 | 0.26 | 0.00 | 0.21 |
| SEQID-03824 | 0.05 | 0.04 | 0.07 | 0.02 | 0.01 | 0.00 | 0.02 | 0.04 | -30.01 | 0.08 | 0.04 | 9.78 | 0.28 | 0.23 | 0.22 | 0.29 |
| SEQID-03825 | 0.04 | 0.01 | 0.03 | 0.09 | 0.02 | 0.03 | 0.00 | 0.07 | -31.12 | 0.21 | -0.20 | 3.87 | 0.25 | 0.31 | 0.28 | 0.33 |
| SEQID-03826 | 0.02 | 0.01 | 0.03 | 0.05 | 0.02 | 0.03 | 0.14 | 0.04 | -22.84 | 0.23 | -0.02 | 5.60 | 0.27 | 0.32 | 0.00 | 0.26 |
| SEQID-03827 | 0.06 | 0.12 | 0.05 | 0.01 | 0.02 | 0.02 | 0.03 | 0.07 | -26.24 | 0.22 | -0.24 | 3.42 | 0.22 | 0.23 | 0.00 | 0.28 |
| SEQID-03828 | 0.03 | 0.04 | 0.03 | 0.02 | 0.04 | 0.04 | 0.05 | 0.05 | -21.39 | 0.39 | 0.06 | 10.34 | 0.31 | 0.30 | 0.30 | 0.00 |
| SEQID-03829 | 0.02 | 0.02 | 0.02 | 0.02 | 0.01 | 0.05 | 0.06 | 0.04 | -31.10 | 0.27 | 0.26 | 10.97 | 0.27 | 0.26 | 0.00 | 0.26 |
| SEQID-03830 | 0.08 | 0.04 | 0.04 | 0.05 | 0.00 | 0.00 | 0.00 | 0.01 | -28.50 | 0.16 | 0.19 | 11.06 | 0.28 | 0.22 | 0.28 | 0.31 |
| SEQID-03831 | 0.02 | 0.14 | 0.01 | 0.04 | 0.04 | 0.04 | 0.00 | 0.03 | -20.48 | 0.33 | 0.10 | 9.76 | 0.24 | 0.20 | 0.26 | 0.26 |
| SEQID-03832 | 0.04 | 0.02 | 0.03 | 0.02 | 0.08 | 0.00 | 0.15 | 0.12 | -23.18 | 0.40 | -0.07 | 4.32 | 0.26 | 0.34 | 0.25 | 0.26 |
| SEQID-03833 | 0.05 | 0.01 | 0.00 | 0.05 | 0.09 | 0.04 | 0.04 | 0.07 | -21.49 | 0.30 | 0.21 | 11.11 | 0.18 | 0.25 | 0.28 | 0.24 |
| SEQID-03834 | 0.02 | 0.04 | 0.13 | 0.06 | 0.04 | 0.02 | 0.03 | 0.04 | -20.06 | 0.25 | 0.14 | 9.69 | 0.23 | 0.35 | 0.21 | 0.25 |
| SEQID-03835 | 0.04 | 0.05 | 0.03 | 0.04 | 0.05 | 0.06 | 0.03 | 0.00 | -27.60 | 0.10 | 0.36 | 13.06 | 0.24 | 0.15 | 0.00 | 0.00 |
| SEQID-03836 | 0.06 | 0.13 | 0.03 | 0.05 | 0.02 | 0.02 | 0.05 | 0.06 | -20.29 | 0.42 | -0.01 | 6.51 | 0.24 | 0.29 | 0.23 | 0.00 |
| SEQID-03837 | 0.02 | 0.11 | 0.01 | 0.12 | 0.05 | 0.03 | 0.03 | 0.06 | -22.98 | 0.34 | 0.26 | 12.24 | 0.31 | 0.22 | 0.00 | 0.27 |
| SEQID-03838 | 0.03 | 0.00 | 0.02 | 0.02 | 0.02 | 0.00 | 0.04 | 0.04 | -28.59 | 0.44 | 0.33 | 12.09 | 0.34 | 0.16 | 0.32 | 0.00 |
| SEQID-03839 | 0.03 | 0.02 | 0.14 | 0.05 | 0.00 | 0.00 | 0.04 | 0.03 | -21.42 | 0.13 | 0.03 | 9.78 | 0.26 | 0.30 | 0.32 | 0.31 |
| SEQID-03840 | 0.05 | 0.07 | 0.03 | 0.05 | 0.05 | 0.02 | 0.05 | 0.06 | -19.97 | 0.34 | -0.06 | 4.45 | 0.40 | 0.54 | 0.00 | 0.21 |
| SEQID-03841 | 0.04 | 0.02 | 0.03 | 0.03 | 0.05 | 0.02 | 0.04 | 0.03 | -21.54 | 0.49 | 0.12 | 11.67 | 0.21 | 0.31 | 0.00 | 0.21 |
| SEQID-03842 | 0.02 | 0.04 | 0.00 | 0.09 | 0.09 | 0.00 | 0.05 | 0.05 | -26.92 | 0.20 | 0.14 | 11.01 | 0.26 | 0.27 | 0.26 | 0.29 |
| SEQID-03843 | 0.02 | 0.05 | 0.03 | 0.03 | 0.02 | 0.00 | 0.05 | 0.04 | -21.07 | 0.42 | 0.36 | 10.30 | 0.20 | 0.31 | 0.00 | 0.00 |
| SEQID-03844 | 0.03 | 0.02 | 0.05 | 0.14 | 0.04 | 0.01 | 0.04 | 0.05 | -21.65 | 0.19 | 0.06 | 8.01 | 0.23 | 0.33 | 0.00 | 0.27 |
| SEQID-03845 | 0.02 | 0.03 | 0.13 | 0.06 | 0.04 | 0.02 | 0.02 | 0.04 | -24.03 | 0.22 | 0.01 | 10.20 | 0.26 | 0.30 | 0.27 | 0.25 |
| SEQID-03846 | 0.01 | 0.12 | 0.04 | 0.07 | 0.04 | 0.05 | 0.09 | 0.04 | -24.67 | 0.15 | 0.05 | 9.29 | 0.21 | 0.34 | 0.00 | 0.22 |
| SEQID-03847 | 0.10 | 0.06 | 0.02 | 0.03 | 0.05 | 0.00 | 0.00 | 0.03 | -27.07 | 0.07 | 0.02 | 13.12 | 0.25 | 0.20 | 0.00 | 0.30 |
| SEQID-03848 | 0.09 | 0.06 | 0.02 | 0.07 | 0.02 | 0.02 | 0.16 | 0.02 | -24.96 | 0.12 | 0.33 | 4.09 | 0.30 | 0.28 | 0.00 | 0.00 |
| SEQID-03849 | 0.09 | 0.00 | 0.09 | 0.02 | 0.00 | 0.02 | 0.00 | 0.11 | -23.49 | 0.40 | -0.10 | 11.37 | 0.33 | 0.16 | 0.33 | 0.33 |
| SEQID-03850 | 0.03 | 0.07 | 0.04 | 0.07 | 0.08 | 0.03 | 0.03 | 0.08 | -22.85 | 0.33 | 0.25 | 10.48 | 0.25 | 0.29 | 0.00 | 0.26 |
| SEQID-03851 | 0.06 | 0.05 | 0.04 | 0.01 | 0.06 | 0.05 | 0.06 | 0.00 | -27.66 | 0.08 | 0.07 | 12.62 | 0.29 | 0.18 | 0.00 | 0.29 |
| SEQID-03852 | 0.03 | 0.03 | 0.07 | 0.02 | 0.06 | 0.02 | 0.05 | 0.02 | -23.24 | 0.21 | 0.32 | 10.63 | 0.28 | 0.26 | 0.26 | 0.27 |
| SEQID-03853 | 0.02 | 0.02 | 0.03 | 0.03 | 0.02 | 0.02 | 0.02 | 0.03 | -38.14 | 0.22 | 0.13 | 3.59 | 0.23 | 0.41 | 0.23 | 0.25 |
| SEQID-03854 | 0.02 | 0.05 | 0.03 | 0.04 | 0.05 | 0.09 | 0.02 | 0.06 | -20.82 | 0.21 | -0.28 | 6.58 | 0.23 | 0.35 | 0.00 | 0.22 |
| SEQID-03855 | 0.05 | 0.02 | 0.02 | 0.15 | 0.04 | 0.02 | 0.00 | 0.04 | -40.55 | 0.04 | -0.01 | 12.69 | 0.38 | 0.24 | 0.32 | 0.30 |
| SEQID-03856 | 0.06 | 0.00 | 0.00 | 0.05 | 0.01 | 0.00 | 0.05 | 0.05 | -21.58 | 0.29 | 0.55 | 7.37 | 0.21 | 0.31 | 0.21 | 0.00 |
| SEQID-03857 | 0.01 | 0.06 | 0.12 | 0.05 | 0.06 | 0.04 | 0.00 | 0.04 | -26.17 | 0.37 | 0.01 | 10.22 | 0.31 | 0.31 | 0.00 | 0.00 |
| SEQID-03858 | 0.01 | 0.04 | 0.03 | 0.02 | 0.04 | 0.00 | 0.07 | 0.14 | -23.03 | 0.26 | 0.08 | 5.15 | 0.26 | 0.30 | 0.23 | 0.25 |
| SEQID-03859 | 0.11 | 0.04 | 0.02 | 0.00 | 0.03 | 0.00 | 0.01 | 0.05 | -37.46 | 0.02 | -0.01 | 9.75 | 0.31 | 0.21 | 0.28 | 0.32 |
| SEQID-03860 | 0.02 | 0.00 | 0.00 | 0.02 | 0.03 | 0.00 | 0.00 | 0.09 | -29.01 | 0.23 | 0.04 | 3.88 | 0.43 | 0.51 | 0.23 | 0.21 |
| SEQID-03861 | 0.01 | 0.01 | 0.05 | 0.00 | 0.01 | 0.05 | 0.15 | 0.05 | -30.00 | 0.10 | -0.15 | 12.54 | 0.24 | 0.23 | 0.00 | 0.23 |
| SEQID-03862 | 0.00 | 0.02 | 0.06 | 0.07 | 0.09 | 0.04 | 0.04 | 0.05 | -24.40 | 0.41 | 0.34 | 4.40 | 0.24 | 0.35 | 0.21 | 0.24 |
| SEQID-03863 | 0.03 | 0.12 | 0.03 | 0.05 | 0.05 | 0.01 | 0.02 | 0.05 | -24.15 | 0.17 | -0.06 | 3.83 | 0.28 | 0.27 | 0.00 | 0.28 |
| SEQID-03864 | 0.05 | 0.02 | 0.02 | 0.15 | 0.04 | 0.00 | 0.02 | 0.06 | -24.03 | 0.22 | -0.13 | 11.24 | 0.30 | 0.31 | 0.00 | 0.24 |
| SEQID-03865 | 0.06 | 0.02 | 0.00 | 0.01 | 0.06 | 0.05 | 0.04 | 0.05 | -36.76 | 0.07 | 0.14 | 9.93 | 0.30 | 0.27 | 0.23 | 0.26 |
| SEQID-03866 | 0.05 | 0.05 | 0.03 | 0.00 | 0.04 | 0.06 | 0.00 | 0.07 | -21.90 | 0.14 | 0.04 | 3.67 | 0.28 | 0.27 | 0.31 | 0.00 |
| SEQID-03867 | 0.01 | 0.01 | 0.04 | 0.02 | 0.12 | 0.06 | 0.07 | 0.05 | -22.28 | 0.38 | -0.14 | 10.13 | 0.25 | 0.33 | 0.25 | 0.25 |
| SEQID-03868 | 0.04 | 0.06 | 0.02 | 0.00 | 0.08 | 0.12 | 0.01 | 0.13 | -37.46 | 0.09 | 0.06 | 12.57 | 0.30 | 0.24 | 0.00 | 0.00 |
| SEQID-03869 | 0.03 | 0.07 | 0.03 | 0.02 | 0.07 | 0.02 | 0.02 | 0.03 | -25.74 | 0.26 | 0.31 | 10.48 | 0.21 | 0.33 | 0.28 | 0.32 |
| SEQID-03870 | 0.15 | 0.03 | 0.04 | 0.06 | 0.09 | 0.00 | 0.05 | 0.06 | -24.42 | 0.24 | 0.09 | 4.40 | 0.24 | 0.27 | 0.00 | 0.21 |
| SEQID-03871 | 0.04 | 0.02 | 0.02 | 0.01 | 0.12 | 0.00 | 0.01 | 0.07 | -27.74 | 0.20 | -0.04 | 10.57 | 0.32 | 0.23 | 0.30 | 0.33 |
| SEQID-03872 | 0.02 | 0.05 | 0.03 | 0.08 | 0.06 | 0.04 | 0.07 | 0.06 | -17.59 | 0.23 | 0.02 | 9.22 | 0.37 | 0.49 | 0.24 | 0.21 |

TABLE 1-continued

| SEQID-03873 | 0.00 | 0.05 | 0.10 | 0.00 | 0.00 | 0.00 | 0.12 | 0.02 | -23.97 | 0.19 | -0.11 | 4.21 | 0.34 | 0.21 | 0.29 | 0.32 |
|---|---|---|---|---|---|---|---|---|---|---|---|---|---|---|---|---|
| SEQID-03874 | 0.03 | 0.11 | 0.05 | 0.02 | 0.05 | 0.05 | 0.04 | 0.05 | -26.20 | 0.42 | 0.15 | 10.69 | 0.31 | 0.13 | 0.29 | 0.31 |
| SEQID-03875 | 0.02 | 0.06 | 0.02 | 0.07 | 0.04 | 0.00 | 0.00 | 0.02 | -28.87 | 0.20 | 0.01 | 7.42 | 0.33 | 0.19 | 0.28 | 0.35 |
| SEQID-03876 | 0.04 | 0.04 | 0.06 | 0.10 | 0.00 | 0.00 | 0.15 | 0.00 | -21.57 | 0.23 | 0.27 | 11.87 | 0.35 | 0.11 | 0.27 | 0.35 |
| SEQID-03877 | 0.03 | 0.04 | 0.05 | 0.10 | 0.11 | 0.01 | 0.04 | 0.07 | -20.80 | 0.29 | -0.08 | 4.25 | 0.00 | 0.33 | 0.16 | 0.18 |
| SEQID-03878 | 0.06 | 0.00 | 0.03 | 0.08 | 0.10 | 0.00 | 0.02 | 0.00 | -20.20 | 0.24 | -0.05 | 4.54 | 0.28 | 0.23 | 0.29 | 0.30 |
| SEQID-03879 | 0.04 | 0.05 | 0.03 | 0.04 | 0.05 | 0.06 | 0.03 | 0.04 | -27.60 | 0.10 | 0.36 | 13.00 | 0.26 | 0.17 | 0.27 | 0.00 |
| SEQID-03880 | 0.03 | 0.03 | 0.04 | 0.07 | 0.08 | 0.00 | 0.00 | 0.00 | -38.18 | 0.01 | 0.00 | 6.58 | 0.33 | 0.18 | 0.30 | 0.24 |
| SEQID-03881 | 0.02 | 0.02 | 0.01 | 0.06 | 0.08 | 0.00 | 0.01 | 0.04 | -24.25 | 0.36 | -0.05 | 4.62 | 0.26 | 0.31 | 0.26 | 0.25 |
| SEQID-03882 | 0.04 | 0.02 | 0.07 | 0.15 | 0.02 | 0.00 | 0.05 | 0.17 | -22.20 | 0.08 | 0.06 | 10.38 | 0.24 | 0.29 | 0.26 | 0.26 |
| SEQID-03883 | 0.01 | 0.04 | 0.05 | 0.04 | 0.04 | 0.05 | 0.06 | 0.04 | -31.29 | 0.25 | -0.10 | 4.28 | 0.34 | 0.55 | 0.00 | 0.22 |
| SEQID-03884 | 0.07 | 0.02 | 0.02 | 0.07 | 0.04 | 0.00 | 0.02 | 0.03 | -23.97 | 0.24 | 0.03 | 9.28 | 0.27 | 0.26 | 0.00 | 0.27 |
| SEQID-03885 | 0.01 | 0.04 | 0.07 | 0.05 | 0.03 | 0.01 | 0.03 | 0.03 | -31.94 | 0.12 | -0.09 | 4.39 | 0.23 | 0.34 | 0.21 | 0.24 |
| SEQID-03886 | 0.06 | 0.08 | 0.05 | 0.02 | 0.00 | 0.02 | 0.05 | 0.06 | -21.81 | 0.31 | -0.02 | 6.00 | 0.23 | 0.32 | 0.22 | 0.00 |
| SEQID-03887 | 0.06 | 0.06 | 0.05 | 0.03 | 0.02 | 0.02 | 0.05 | 0.05 | -21.79 | 0.27 | -0.01 | 6.63 | 0.25 | 0.31 | 0.00 | 0.00 |
| SEQID-03888 | 0.13 | 0.02 | 0.13 | 0.03 | 0.03 | 0.00 | 0.08 | 0.03 | -22.77 | 0.03 | 0.18 | 11.37 | 0.29 | 0.18 | 0.25 | 0.30 |
| SEQID-03889 | 0.02 | 0.02 | 0.01 | 0.07 | 0.05 | 0.01 | 0.01 | 0.04 | -28.27 | 0.15 | -0.06 | 4.67 | 0.00 | 0.36 | 0.16 | 0.19 |
| SEQID-03890 | 0.03 | 0.00 | 0.01 | 0.00 | 0.04 | 0.05 | 0.14 | 0.00 | -30.54 | 0.16 | -0.02 | 5.10 | 0.28 | 0.21 | 0.00 | 0.00 |
| SEQID-03891 | 0.05 | 0.00 | 0.06 | 0.03 | 0.03 | 0.00 | 0.04 | 0.02 | -31.55 | 0.14 | 0.05 | 9.84 | 0.28 | 0.18 | 0.29 | 0.28 |
| SEQID-03892 | 0.03 | 0.00 | 0.00 | 0.03 | 0.05 | 0.06 | 0.10 | 0.02 | -33.88 | 0.05 | 0.12 | 10.44 | 0.31 | 0.20 | 0.29 | 0.31 |
| SEQID-03893 | 0.03 | 0.01 | 0.01 | 0.03 | 0.05 | 0.05 | 0.13 | 0.01 | -34.98 | 0.09 | 0.09 | 10.08 | 0.31 | 0.21 | 0.27 | 0.32 |
| SEQID-03894 | 0.03 | 0.01 | 0.01 | 0.02 | 0.04 | 0.05 | 0.12 | 0.01 | -35.89 | 0.09 | 0.09 | 9.84 | 0.30 | 0.23 | 0.28 | 0.30 |
| SEQID-03895 | 0.04 | 0.01 | 0.01 | 0.05 | 0.04 | 0.05 | 0.11 | 0.02 | -34.48 | 0.10 | 0.05 | 9.55 | 0.30 | 0.25 | 0.28 | 0.29 |
| SEQID-03896 | 0.02 | 0.00 | 0.03 | 0.06 | 0.05 | 0.00 | 0.10 | 0.08 | -31.95 | 0.24 | 0.06 | 10.01 | 0.33 | 0.21 | 0.00 | 0.32 |
| SEQID-03897 | 0.02 | 0.00 | 0.05 | 0.06 | 0.05 | 0.00 | 0.08 | 0.08 | -33.43 | 0.21 | 0.08 | 10.22 | 0.27 | 0.17 | 0.00 | 0.34 |
| SEQID-03898 | 0.01 | 0.02 | 0.04 | 0.05 | 0.05 | 0.00 | 0.08 | 0.07 | -31.96 | 0.29 | 0.06 | 9.66 | 0.29 | 0.20 | 0.15 | 0.32 |
| SEQID-03899 | 0.01 | 0.00 | 0.06 | 0.06 | 0.02 | 0.00 | 0.08 | 0.07 | -31.03 | 0.21 | 0.08 | 10.25 | 0.27 | 0.19 | 0.27 | 0.27 |
| SEQID-03900 | 0.00 | 0.00 | 0.02 | 0.03 | 0.00 | 0.10 | 0.08 | 0.06 | -32.21 | 0.17 | 0.18 | 11.19 | 0.30 | 0.19 | 0.00 | 0.00 |
| SEQID-03901 | 0.00 | 0.00 | 0.07 | 0.00 | 0.03 | 0.00 | 0.13 | 0.02 | -31.13 | 0.24 | -0.08 | 4.33 | 0.41 | 0.26 | 0.00 | 0.32 |
| SEQID-03902 | 0.03 | 0.02 | 0.05 | 0.03 | 0.03 | 0.04 | 0.04 | 0.02 | -30.04 | 0.23 | 0.20 | 11.63 | 0.29 | 0.19 | 0.33 | 0.23 |
| SEQID-03903 | 0.02 | 0.02 | 0.02 | 0.00 | 0.03 | 0.02 | 0.13 | 0.02 | -30.82 | 0.25 | 0.17 | 11.01 | 0.33 | 0.21 | 0.35 | 0.33 |
| SEQID-03904 | 0.01 | 0.01 | 0.00 | 0.00 | 0.02 | 0.00 | 0.20 | 0.01 | -31.14 | 0.38 | -0.08 | 4.54 | 0.32 | 0.26 | 0.00 | 0.25 |
| SEQID-03905 | 0.00 | 0.00 | 0.00 | 0.00 | 0.00 | 0.00 | 0.13 | 0.03 | -30.46 | 0.34 | 0.00 | 5.81 | 0.34 | 0.22 | 0.00 | 0.00 |
| SEQID-03906 | 0.00 | 0.03 | 0.02 | 0.03 | 0.00 | 0.04 | 0.11 | 0.02 | -29.86 | 0.39 | -0.02 | 5.79 | 0.29 | 0.19 | 0.20 | 0.31 |
| SEQID-03907 | 0.01 | 0.02 | 0.06 | 0.00 | 0.00 | 0.06 | 0.23 | 0.01 | -30.42 | 0.29 | -0.16 | 3.92 | 0.32 | 0.22 | 0.23 | 0.32 |
| SEQID-03908 | 0.03 | 0.02 | 0.02 | 0.06 | 0.02 | 0.00 | 0.10 | 0.03 | -31.04 | 0.39 | -0.11 | 4.13 | 0.28 | 0.20 | 0.31 | 0.23 |
| SEQID-03909 | 0.03 | 0.00 | 0.05 | 0.00 | 0.02 | 0.02 | 0.16 | 0.06 | -31.07 | 0.42 | -0.07 | 4.57 | 0.29 | 0.20 | 0.00 | 0.30 |

SEQUENCE LISTING (4133 sequences)

SEQ ID NO: 1 - protein, 386 aa, Gallus gallus
MGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 2 - protein, 485 aa, Glycine max
MAKLVLSLCFLLFSGCFALREQAQQNECQIQKLNALKPDNRIESEGGFIETWNPNNKPFQCAGVALSRCTLNRNALRRPSYTNGPQEIYIQQGNGIFGMIFPGCPSTYQEPQESQQRGRSQRPQDRHQKVHRFREGDLIAVPTGVAWWMYNNEDTPVVAVSIIDTNSLENQLDQMPRRFYLAGNQEQEFLKYQQQQQGGSQSQKGKQQEEENEGSNILSGFAPEFLKEAFGVNMQIVRNLQGENEEEDSGAIVTVKGGLRVTAPAMRKPQQEEDDDDEEEQPQCVETDKGCQRQSKRSRNGIDETICTMRLRQNIGQNSSPDIYNPQAGSITTATSLDFPALWLLKLSAQYGSLRKNAMFVPHYTLNANSIIYALNGRALVQVVNCNGERVFDGELQEGGVLIVPQNFAVAAKSQSDNFEYVSFKTNDRPSIGNLAGANSLLNALPEEVIQHTFNLKSQQARQVKNNNPFSFLVPPQESQRRAVA

SEQ ID NO: 3 - protein, 178 aa, Bos taurus
MKCLLLALALTCGAQALIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCHI

SEQ ID NO: 4 - protein, 214 aa, Bos taurus
MKLLILTCLVAVALARPKHPIKHQGLPQEVLNENLLRFFVAPFPEVFGKEKVNELSKDIGSESTEDQAMEDIKQMEAESISSSEEIVPNSVEQKHIQKEDVPSERYLGYLEQLLRLKKYKVPQLEIVPNSAEERLHSMKEGIHAQQKEPMIGVNQELAYFYPELFRQFYQLDAYPSGAWYYVPLGTQYTDAPSFSDIPNPIGSENSEKTTMPLW

SEQ ID NO: 5 - protein, 224 aa, Bos taurus
MKVLILACLVALALARELEELNVPGEIVESLSSSEESITRINKKIEKFQSEEQQQTEDELQDKIHPFAQTQSLVYPFPGPIPNSLPQNIPPLTQTPVVVPPFLQPEVMGVSKVKEAMAPKHKEMPFPKYPVEPFTESQSLTLTDVENLHLPLPLLQSWMHQPHQPLPPTVMFPPQSVLSLSQSKVLPVPQKAVPYPQRDMPIQAFLLYQEPVLGPVRGPFPIIV

SEQ ID NO: 6 - protein, 142 aa, Bos taurus
MMSFVSLLLVGILFHATQAEQLTKCEVFRELKDLKGYGGVSLPEWVCTTFHTSGYDTQAIVQNNDSTEYGLFQINNKIWCKDDQNPHSSNICNISCDKFLDDDLTDDIMCVKKILDKVGINYWLAHKALCSEKLDQWLCEKL

SEQ ID NO: 7 - protein, 54 aa, Pentadiplandra brazzeana
QDKCKKVYENYPVSKCQLANQCNYDCKLDKHARSGECFYDEKRNLQCICDYCEY

SEQ ID NO: 8 - protein, 150 aa, Homarus americanus
MDSLDEEQIGALQKAFDSFDTDSKGFITPETVGVILRMMGVKISEKNLQEVIAETDEDGSGELEFEEFVELAAKFLIEEDEEALKTELREAFRVYDKEGNGYITTDVLKEILRELDNRLTEEDLDSIIEEVDEDGSGTLDFNEFMEMMNG

SEQ ID NO: 9 - protein, 262 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQEAPDSDPEADGDGLEDEYENGEGEEEEDDDEEDDLDEEVIDEEDDEDDDLEGEEEEDGVDDEEEDEEEDGEDEEDDEADDDLPRGEKRKRNLEDEGEEDPEDEEDDEDD

SEQ ID NO: 10 - protein, 267 aa, Zea mays
MATKILSLLALLALFASATNASIIPQCSLAPSSIIPQFLPPVTSMAFEHPAVQAYRLQQAIAASVLQQPIAQLQQQSLAHLTIQTIATQQQQQQFLPALSHLAMVNPVAYLQQQLLASNPLALANVVANQQQQQLQQFLPALSQLAMVNPAAYLQQQQLLSSSPLAVANAPTYLQQELLQQIVPALTQLAVANPVAYLQQLLPFNQLTMSNSVAYLQQRQQLLNPLAVANPLVAAFLQQQQLLPYNRFSLMNPVLSRQQPIVGGAIF

SEQ ID NO: 11 - protein, 239 aa, Unknown
  source: /note="Description of Unknown: YFP polypeptide"
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 12 - protein, 54 aa, Pentadiplandra brazzeana; identical to SEQ ID NO: 7

SEQ ID NO: 13 - protein, 50 aa, Pentadiplandra brazzeana
KKVYENYPVSKCQLANQCNYDCKLDKHARSGECFYDEKRNLQCICDYCEY

SEQ ID NO: 14 - protein, 51 aa, Pentadiplandra brazzeana
QDKCKKVYENYPVSKCQLANQCNYDCKLDKHARSGECFYDEKRNLQCICDY

SEQ ID NO: 15 - protein, 47 aa, Pentadiplandra brazzeana
KKVYENYPVSKCQLANQCNYDCKLDKHARSGECFYDEKRNLQCICDY

SEQ ID NO: 16 - protein, 101 aa, Unknown
  source: /note="Description of Unknown: polypeptide"
SDISLCLLDAYSLAMAALLDIQELMKALALVETCGAQSAEILKPTPEGDLENGEQATMKEKGLPLCAKIDALNELQLFCMEIPAVFNSADTDYKWLELEEQ

SEQ ID NO: 17 - protein, 101 aa, Unknown
  source: /note="Description of Unknown: polypeptide"
SMEDVFMGSIGAAFCFKENENIFVHHAPEYCPIAIMSAELLAMVYLGAEPINFTQFDKGDSIEALKNQDQALPGFSFAERDILSLLYVEITKPNDVYWEDE

SEQ ID NO: 18 - protein, 100 aa, Bos taurus
RRLRLQQLATLIQKTYRGWRCRTHYQLMRKSQIVISSWFRGNMQKKHYRKMKASALLIQAFVRGWKARKNYRKYFRSGAALILSNFIYKSMVQKFLLGLK

SEQ ID NO: 19 - protein, 100 aa, Unknown
  source: /note="Description of Unknown: polypeptide"
RRRFLHLKKAAVVFQKQLRGQIARRRRRFLHLKKAAVVFQKQLRGQIARRRRRFLHLKKAAVVFQKQLRGQIARRRRRFLHLKKAAVVFQKQLRGQIARR

SEQ ID NO: 20 - protein, 102 aa, Unknown
  source: /note="Description of Unknown: polypeptide"
LKMGSIGAAKDSTRFCFKEINKNIFVHHALAQCVKYCPIAKAIMSAMVYASRLGATQFDKVVRRDILNQFKSFLPGFSLKGLERREQTAASKPVQLYFRKIK

SEQ ID NO: 21 - protein, 107 aa, Unknown
  source: /note="Description of Unknown: polypeptide"
LKPHIYMTLIRNLPLQLIYRYVSVNPYQQKYVLEKANMASGAGKLPIYYQRDRSLKESKIGNVLVADRQVNSVKRDYALNNNSSRTYCILVAAVCGKSRKRPPTAGA

SEQ ID NO: 22 - protein, 263 aa, Zea mays
MATKILALLALLALLVSATNAFIIPQCSLAPSASIPQFLPPVTSMGFEHPAVQAYRLQLALAASALQQPIAQLQQQSLAHLTLQTIATQQQQQQFLPSLSHLAMVNPVTYLQQQLLASNPLALANVAAYQQQQQLQQFMPVLSQLAMVNPAVYLQLLSSSPLAVGNAPTYLQQQLLQQIVPALTQLAVANPAAYLQQLLPFNQLAVSNSAAYLQQRQQLLNPLAVANPLVATFLQQQQQLLPYNQFSLMNPALQQPIVGGAIF

SEQ ID NO: 23 - protein, 100 aa, Zea mays
LSPAMSSVCENPILLPYRIQQAIAAGILPLSPLFLQQSSALLQQLPLVHLLAQNIRAQQLQQLVLANLAAYSQQQQLPLVHLLAQNIRAQQLQQLVLANL

SEQ ID NO: 24 - protein, 100 aa, Gallus gallus
LQQIATDGSFAFTALDIRNLAALRELLLPNIVGVAQRLILLEAPTIVTEVIEVNKKDIVFLIDGSTALGTGPFNSIRDFVAKIVQRLEVGPDLIQVAVAQ

SEQ ID NO: 25 - protein, 102 aa, Gallus gallus
IEEAVPQILVLISGGESSDDIREGLLAVKQASIFSFSIGVLNADSAELQQIATDGSFAFTALDIRNLAALRELLLPNIVGVAQRLILLEAPTIVTEVIEVNK

SEQ ID NO: 26 - protein, 104 aa, Unknown
  source: /note="Description of Unknown: polypeptide"
LLGLLLTWLLLLGLLFGLIALAEEVRLLGLLLTWLLLLGLLFGLIALAEEVRLLGLLLAWLLLLGLLFGLIALAEEVRLLGLLLTWLLLLGLLFGLIALAEEVR

SEQ ID NO: 27 - protein, 102 aa, Unknown
  source: /note="Description of Unknown: polypeptide"
LEGSVGVEMTLDLVLLEPLEQESLIRNLQLRYEKKEIYTYIGNVLVSVNPYQQLPIYDLEFVAKYLKPHIYALSLTFCILYELVMSYITGEQVNSVKLLLVL

SEQ ID NO: 28 - protein, 102 aa, Unknown
  source: /note="Description of Unknown: polypeptide"
ALTVIDFTEDEVEDLLSIVASVLHLTVLSDLIPEIEYVVSIASYDEVEESLALTVIDFTEDEVEDLLSIVASVLHLNEIILQVCSGVDEQLGELVSGEEVVE

SEQ ID NO: 29 - protein, 104 aa, Unknown
  source: /note="Description of Unknown: polypeptide"
LEGSVGVEDLMTLLEPLVLEQESLIRNLQLRYEKKEIYDLTYIGNVLEFVSVNPYRDYYEQQSLVADRDQLPIYLVMSYGETEARDRALEQYQLLEASKYMDIE

SEQ ID NO: 30 - protein, 100 aa, Gallus gallus
KVHKLQIEVENVTSLLNEAESKNIKLTKDVATLGSQLQDTQELLQEETRQKLNVTTKLRQLEDDKNSLQEQLDEEVEAKQNLERHISTLTIQLSDSKKKL

SEQ ID NO: 31 - protein, 100 aa, Bos taurus
EEEEEARRSLEKQLQALQAQLTDTKKKVDDDLGTIENLEEAKKKLLKDVEVLSQRLEEKALAYDKLEKTKTRLQQELDDLLVDLDHQRQIVSNLEKKQKK

SEQ ID NO: 32 - protein, 101 aa, Gallus gallus
NDLLLQLQAEQDTLADAEERCDLLIKSKIQLEAKVKELTERVEDEEEMNSELTSKKRKLEDECSELKKDIDDLEITLAKVEKEKHATENKVKNLTEEMATL

SEQ ID NO: 33 - protein, 101 aa, Unknown
  source: /note="Description of Unknown: polypeptide"
IKTVTSLDLPVLRWLKLSAEHGSLHKDGKLVSIIAELLSTKTDMVEKALLYRQKLQLEKVTAEAKIKKMEEEILLLKVTTEAKLKKLEEDVIVLEDQNLKL

SEQ ID NO: 34 - protein, 101 aa, Unknown
  source: /note="Description of Unknown: polypeptide"
MKLIVTQCLLLALALTCGAQATMKGLDIQKVAGTWYSLAMAASDISLLDAQSAPLRVYVEELKPTPEGDLEILLQKWENGECAQKKIIAEKTKKIDAKKLE

SEQ ID NO: 35 - protein, 100 aa, Gallus gallus
KLQAVAKDKLVMAEAVQKVNRANGKTVPRLLLLTTEHLVLADPKAAQPKMVLSLCDIQGASVSRFSDGLLALHLKETSTAGGKGDLLLVSPHLIELVTRL

SEQ ID NO: 36 - protein, 100 aa, Unknown
  source: /note="Description of Unknown: polypeptide"
MMSFVSLLLVGILLTKFHATQAEQLKCEVFREDLKGYGGVSLIVQYGLINNKWVCTTFIWCKFLPEDDDLKILHTSGYFQDKWLVGINYAHKALKLWLKL

SEQ ID NO: 37 - protein, 89 aa, Unknown
  source: /note="Description of Unknown: polypeptide"
VLLKLLLLKVLMVLLFVTIKHKIKILHLKLTLTKMTLLWTKFLVKIVKKIMTLKVIIKFTIIITILHMKLFMLKWKLLVLFWTVLVLLT

SEQ ID NO: 38 - protein, 106 aa, Gallus gallus
CPCGSCCSWWKWLLGLLLAWLLLLGLLFGLIALAEEVRKLKSRVDNLEKINHSFLTVNQGNPYLEKDVSKVDFLHGVAPSSTFPFENEESVWLMVKSRLNKEIERG

SEQ ID NO: 39 - protein, 103 aa, Gallus gallus
KEKDFQGMLEYKKEDEQKLVKNLILELKPRGVAVNLIPGLPAYILFMCVRHADYLNDDQKVRSLLTSTINGIKKVLKKRGDDFETVSFWLSNTCRFLHCLKQY

SEQ ID NO: 40 - protein, 100 aa, Gallus gallus
FTALDIRNLAALRELLLPNIVGVAQRLILLEAPTIVTEVIEVNKKDIVFLIDGSTALGTGPFNSIRDFVAKIVQRLEVGPDLIQVAVAQYADTVRPEFYF

SEQ ID NO: 41 - protein, 100 aa, Bos taurus
IRSPKTLFYLEEQRRLRLQQLATLIQKTYRGWRCRTHYQLMRKSQIVISSWFRGNMQKKHYRKMKASALLIQAFVRGWKARKNYRKYFRSGAALILSNFI

SEQ ID NO: 42 - protein, 102 aa, Bos taurus
NFSQPYPEEEEVDEGFEADDDAFKDSPNPSEHGHSDQRTSGIRTSDESSEEDPYMNDTVVPTSPSADSTVLLAPSEHDSSAGEPTYCLPQTPGALPAPEGDY

SEQ ID NO: 43 - protein, 50 aa, Gallus gallus
AFTALDIRNLAALRELLLPNIVGVAQRLILLEAPTIVTEVIEVNKKDIVF

SEQ ID NO: 44 - protein, 50 aa, Gallus gallus
FTALDIRNLAALRELLLPNIVGVAQRLILLEAPTIVTEVIEVNKKDIVFL

SEQ ID NO: 45 - protein, 53 aa, Gallus gallus
LDIRNLAALRELLLPNIVGVAQRLILLEAPTIVTEVIEVNKKDIVFLIDGSTA

SEQ ID NO: 46 - protein, 52 aa, Gallus gallus
DIRNLAALRELLLPNIVGVAQRLILLEAPTIVTEVIEVNKKDIVFLIDGSTA

SEQ ID NO: 47 - protein, 50 aa, Gallus gallus
NLAALRELLLPNIVGVAQRLILLEAPTIVTEVIEVNKKDIVFLIDGSTAL

SEQ ID NO: 48 - protein, 31 aa, Clupea harengus
ARRRRSSSRPIRRRRPRRRTTRRRRAGRRRR

SEQ ID NO: 49 - protein, 248 aa, Unknown
  source: /note="Description of Unknown: polypeptide"
MGHHHHHHGGASKGEELFTGVVPILVELDGDVNGHKFSVRGEGEGDATNGKLTLKFICTTGKLPVPWPTLVTTLTYGVQCFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSALSKDPNEKRDHMVLLEFVTAAGITHGMDELYK

SEQ ID NO: 50 - protein, 50 aa, Bos taurus
MKLLILTCLVAVALARPKHPIKHQGLPQEVLNENLLRFFVAPFPEVFGKE

SEQ ID NO: 51 - protein, 50 aa, Bos taurus
KLLILTCLVAVALARPKHPIKHQGLPQEVLNENLLRFFVAPFPEVFGKEK

SEQ ID NO: 52 - protein, 50 aa, Bos taurus
LLILTCLVAVALARPKHPIKHQGLPQEVLNENLLRFFVAPFPEVFGKEKV

SEQ ID NO: 53 - protein, 50 aa, Bos taurus
LILTCLVAVALARPKHPIKHQGLPQEVLNENLLRFFVAPFPEVFGKEKVN

SEQ ID NO: 54 - protein, 50 aa, Bos taurus
ILTCLVAVALARPKHPIKHQGLPQEVLNENLLRFFVAPFPEVFGKEKVNE

SEQ ID NO: 55 - protein, 50 aa, Bos taurus
LTCLVAVALARPKHPIKHQGLPQEVLNENLLRFFVAPFPEVFGKEKVNEL

SEQ ID NO: 56 - protein, 50 aa, Bos taurus
ESISSSEEIVPNSVEQKHIQKEDVPSERYLGYLEQLLRLKKYKVPQLEIV

SEQ ID NO: 57 - protein, 50 aa, Bos taurus
SISSSEEIVPNSVEQKHIQKEDVPSERYLGYLEQLLRLKKYKVPQLEIVP

SEQ ID NO: 58 - protein, 50 aa, Bos taurus
ISSSEEIVPNSVEQKHIQKEDVPSERYLGYLEQLLRLKKYKVPQLEIVPN

SEQ ID NO: 59 - protein, 50 aa, Bos taurus
IVPNSVEQKHIQKEDVPSERYLGYLEQLLRLKKYKVPQLEIVPNSAEERL

SEQ ID NO: 60 - protein, 248 aa, Unknown
  source: /note="Description of Unknown: polypeptide"
MGHHHHHHGGASKGEELFDGVVPILVELDGDVNGHEFSVRGEGEGDATEGELTLKFICTTGELPVPWPTLVTTLTYGVQCFSDYPDHMDQHDFFKSAMPEGYVQERTISFKDDGTYKTRAEVKFEGDTLVNRIELKGIDFKEDGNILGHKLEYNFNSHDVYITADKQENGIKAEFEIRHNVEDGSVQLADHYQQNTPIGDGPVLLPDDHYLSTESALSKDPNEDRDHMVLLEFVTAAGIDHGMDELYK

SEQ ID NO: 61 - protein, 248 aa, Unknown
  source: /note="Description of Unknown: polypeptide"
MGHHHHHHGGASKGERLFRGKVPILVELKGDVNGHKFSVRGKGKGDATRGKLTLKFICTTGKLPVPWPTLVTTLTYGVQCFSRYPKHMKRHDFFKSAMPKGYVQERTISFKKDGKYKTRAEVKFEGRTLVNRIKLKGRDFKEKGNILGHKLRYNFNSHKVYITADKRKNGIKAKFKIRHNVKDGSVQLADHYQQNTPIGRGPVLLPRNHYLSTRSKLSKDPKEKRDHMVLLEFVTAAGIKHGRDERYK

SEQ ID NO: 62 - protein, 101 aa, Feline enteric coronavirus
  source: /note="strain 79-1683"
MLVFLHAVLVTALILLLIGRIQLLERLLLSHLLNLTTVSNVLGVPDSSLRVNCLQLLKPDCLDFNILHKVLAETRLLVVVLRVIFLVLLGFSCYTLLGALF

SEQ ID NO: 63 - protein, 146 aa, Candida albicans
MSLISGIASILAIGLLSPVQSILALILLFVTVAINLYTSGYVLMGILYILVYVGAIAILFLFILSLLNIEYKPTGGMHPLVIVLILIPLIPLDIAFEPIAIVESVSTTYNELSIVGTLFYSEYAPMLVIIGIILIVSVIGAIAMTR

SEQ ID NO: 64 - protein, 155 aa, Candida albicans
MFLISGISSILAIGLLSPVQSIVCLIVLFVSAAISLYSNGFVLMGILYVLIYVGAIAILFLFILSLLNIEYNYKGTIHPLIFTILIICLIPLDLSYETYGIVENVNIAYPFNSLLDWDLELTTVGSLLYTEYAIPMILIGLILILSVIGAIAITK

SEQ ID NO: 65 - protein, 150 aa, Haemophilus influenzae
  source: /note="ATCC 51907"
MTLQLNTIALLLVILLILGVLSNNSTITISAAVLLIMQQTFLSSHIPLLEKYGVKIGIIILTIGVLSPLVSGKIQLPDLSGFLSWKMALSISVGVLVAWLAGKGVPLMGEQPILVTGLLIGTIIGVAFLGGIPVGPLIAAGILALLLGKI

SEQ ID NO: 66 - protein, 155 aa, Aquifex aeolicus
MTFLFLILVFIIEILQLSVFPPIFGNAYIVPSLAFLLVLFSSYKIKEKALLLAFLSGLFYDAVVNFLGFISLLNVVFTYLYLVLNNILFVKNPKVEVFLIMPLILLLRKLTIFLVVNTKFPLNIGLKDFGVVLLIDLIFLILLYKVFNKYVYEKA

SEQ ID NO: 67 - protein, 137 aa, Methanocaldococcus jannaschii
  source: /note="ATCC 43067"
MDTAIILGLLVAVFYGVGTFFAKIVCEKNPLFQWIVVNIVGIILCLIILLKYKNIIITDQKILTYAIISAVLVVIGSLLLYYALYKGKASIVVPLSSIGPAITVALSILFLKETLTLPQMIGIVLIIIGIILLSISN

SEQ ID NO: 68 - protein, 214 aa, Unknown
  source: /note="Description of Unknown: polypeptide"
MKLLILTCLVLVILVRVKHLIKHQVLVQEVLNENLLRVLVLILVEVLIKEKVNELSKDIVSESTEDQLIEDIKQVELESISSSEEIVLNSVEQKHIQKEDVISERYLIYLEQLLRLKKYKVLQLEIVLNSLEERLHSVKELIHIQQKELLILVNQELIYIYVELVRQIYQLDLYLSVILYYVILITQYTDLLSISDILNLILSENSEKTTLVLW

SEQ ID NO: 69 - protein, 103 aa, Unknown
  source: /note="Description of Unknown: polypeptide"
MIEEAVPQILVLISGGVSSDDIREGLLAVKLASILSFSIGVLNADLAELQLIATDGSLALTLLDIRNLAVLVELLLPNIVGVAQRLILLEVPTIVTEVIEVNK

SEQ ID NO: 70 - protein, 103 aa, Unknown
  source: /note="Description of Unknown: polypeptide"
MIEEAVPQILVLISGGESSDDIREGLLAVKQASILSFSIGVLNADSAELQQIATDGSLVFTLLDIRNLAALRELLLPNIVGVAQRLILLEAPTIVTEVIEVNK

SEQ ID NO: 71 - protein, 50 aa, Unknown
  source: /note="Description of Unknown: polypeptide"
AFTVLDIRNLAVLRELLLLNIVGVAQRLILLEAPTIVTEVIEVNKKDIVF

SEQ ID NO: 72 - protein, 161 aa, Gallus gallus
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKTEEELSDLFRMFDKNADGYIDLEELKIMLQATGETITEDDIEELMKDGDKNNDGRIDYDEFLEFMKGVE

SEQ ID NO: 73 - protein, 152 aa, Mizuhopecten yessoensis
TEEFRASEKQILDAKQAFCNVDKKKEGTVSCKDLGAIFKSLGLLVKDDKIKDWSDEMDEEATGRLNCDAWIQLFERKLKEDLDERELKEAFRVLDKEKKGVIKVDVLRWILSSLGDELTEEEIENMIAETDTDGSGTVDYEEFKCLMMSSDA

SEQ ID NO: 74 - protein, 160 aa, Oryctolagus cuniculus
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDAEELAEIFRASGEHVTDEEIESLMKDGDKNNDGRIDFDEFLKMMEGVQ

SEQ ID NO: 75 - protein, 161 aa, Sus scrofa
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLEELKIMLQATGETITEDDIEELMKDGDKNNDGRIDYDEFLEFMKGVE

SEQ ID NO: 76 - protein, 161 aa, Bos taurus; identical to SEQ ID NO: 75

SEQ ID NO: 77 - protein, 150 aa, Crangon crangon
MDSLEPDQIDALKKAFDSFDTENQGFITADTVATILRMMGVKISDKNLAEVIAETDEDGSGQLEFEEFVDLSSKFLIEEDEEALKAELREAFRIYDKEGQGFITTDVLKEILTEIDNKLTPEDLDGIIEEVDEDGSGTLDFDEFMEMMSG

SEQ ID NO: 78 - protein, 161 aa, Oncorhynchus mykiss
MNDIYKAAVEQLTDEQKNEFKAAFDIFIQDAEDGCISTKELGKVMRMLGQNPTPEELQEMIDEVDEDGSGTVDFDEFLVMMVRCMKDDSKGKTEEELADLFCMFDKNADGYIDLQELKVMLEATGEAITEDDIEELMKDGDKNNDGKIDYDEFLEFMKGVE

SEQ ID NO: 79 - protein, 53 aa, Oryza sativa
  source: /note="subsp. japonica"
MIPLELRPLPQRCRPWIKLFRGLDFTCLSMVPLRVLGIGVLYKCFAVLLSILL

SEQ ID NO: 80 - protein, 206 aa, Oryza sativa
  source: /note="subsp. japonica"
MRRLFLEQFYKQIFSSTPITSFFLFLLYIVVTPLMIGFEKDFLCYFHLGLIWIPLLFSFLSEPFFRNDKEFGTLELYYLSAYCLPKILLLQLVGHWVIQISCVFCAFPMLQLLYQFDRSGMDWLNILLGSLVLTLLCGIHSGLALGITSSSGWNSLQNLTTLPTLLPLTVFCTSIETEGFHVLLLIGYFFLFVSLYPILVSISLQD

SEQ ID NO: 81 - protein, 96 aa, Oryza sativa
  source: /note="subsp. indica"
RSSTLWSQLLRSLQRVSRVWEPRLLRMMSKLFIVICQLALSAYFHDSSHYAESKFGSLALAFCYLLLMIQDCIFLSAWNFDMFVNLLGYILHAIVL

SEQ ID NO: 82 - protein, 240 aa, Bos taurus
MRCRRLCAFDAARGPRRLMRVGLALILVGHVNLLLGAVLHGTVLRHVANPRGAVTPEYTTANVISVGSGLLSVSLGLVALLASRNLFRPRLHWALLALALVNLLLSAACSLGLLLAVSLTVANGGRRLIADCHPGLLDPLVPLDQGSGHADCPFDPTKIYDTALALWIPSVFMSAAEAALSGYCCVAALTLRGVGPCRKDGLQEQLEELTELEFPKRKWQENVQLLDQTREIRTSQKSWV

SEQ ID NO: 83 - protein, 69 aa, Bos taurus
MSVLTPLLLRGLTGPARRLPVPRAQIHSKPPREQLGTMDIAIGLTSCFLCFLLPSGWVLSHMENYKKRE

SEQ ID NO: 84 - protein, 61 aa, Zea mays
MRECISIHIGQAGIQVGNACWELYCLEHGIQADGQMPGDKTIGGGDAEFDEGEDGDEGDEY

SEQ ID NO: 85 - protein, 151 aa, Bos taurus
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 86 - protein, 151 aa, Gallus gallus
MCDFSEEQTAEFKEAFQLFDRTGDGKILYSQCGDVMRALGQNPTNAEVMKVLGNPKSDEMNLKTLKFEQFLPMMQTIAKNKDQGCFEDYVEGLRVFDKEGNGTVMGAEIRHVLVTLGEKMTEEEVEQLVAGHEDSNGCINYEELVRMVLSG

SEQ ID NO: 87 - protein, 150 aa, Gallus gallus
MSFSPDEINDFKEAFLLFDRTGDAKITLSQVGDIVRALGQNPTNAEINKILGNPSKEEMNAKKITFEEFLPMLQAAANNKDQGTFEDFVEGLRVFDKEGNGTVMGAELRHVLATLGEKMTEEEVEELMKGQEDSNGCINYEAFVKHIMSV

SEQ ID NO: 88 - protein, 90 aa, Phaseolus angularis
AADCNGACSPFQMPPCGSTDCLCIPAGLLFVGYCTYPSGLSSVAKMIDEHPNLCQSDDECMKKGSGNFCARYPNNYMDYGWCFDSDSEAL

SEQ ID NO: 89 - protein, 804 aa, Bos taurus
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALAGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPAEEEEAAKEDKEESDDEAAVEEEEDEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADEKYNDTFWKEFGTNIKLGVIEDHSNRTRLAKLLRFQSSHHPSDMTSLDQYVERMKEKQDKIYFMAGASRKEAESSPFVERLLKKGYEVIYLTEPVDEYCIQALPEFDGKRFQNVAKEGVKFDESEKSKESREAVEKEFEPLLNWMKDKALKDKIEKAVVSQRLTESPCALVASQYGWSGNMERIMKAQAYQTGKDISTNYYASQKKTFEINPRHPLIRDMLRRVKEDEDDKTVSDLAVVLFETATLRSGYLLPDTKAYGDRIERMLRLSLNIDPDAKVEEEPEEEPEETTEDTAEDTEQDEEEEMDAGTDEEEQETAEKSTAEKDEL

SEQ ID NO: 90 - protein, 445 aa, Zea mays
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFVGNSTSIQEMFRRVSEQFTAMFRRKAFLHWYTGEGMDEMEFTEAESNMNDLVAEYQQYQDATAEDEEYEEEEEEEEET

SEQ ID NO: 91 - protein, 322 aa, Gallus gallus
ADACSGLQGFLIFHSFGGGTGSGFTSLLMERLSVDYGKKSKLEFAIYPAPQVSTAVVEPYNSILTTHTTLEHSDCAFMVDNEAIYDICCRNLDIERPTYTNLNRLISQIVSSITASLRFDGALNVDLTEFQTNLVPYPRIHFPLVTYAPIISSERAYHEQLSVAEITSSCFEPNNQMVKCDPRHGKYMACCMLYRGDVVPKDVNVAIAAIKTKRNIQFVDWCPTGVKVGINYQPPTVVPGGDLAQVQRAVCMLSNTTAIAEAWARLDHKFDLMYAKRAFVHWYVSEGMEEGEFAEAREDLAALEKDYEEVGTDSFEDENDEE

SEQ ID NO: 92 - protein, 159 aa, Sus scrofa
TDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNMDGYIDAEELAEIFRASGEHVTDEEIESIMKDGDKNNDGRIDFDEFLKMMEGVQ

SEQ ID NO: 93 - protein, 162 aa, Meleagris gallopavo
PSMTDQQAEARAFLSEEMIAEFKAAFDMFDADGGGDISTKELGTVMRMLGQNPTKEELDAIIEEVDEDGSGTIDFEEFLVMMVRQMKEDAKGKSEEELANCFRIFDKNADGFIDIEELGEILRATGEHVTEEEIEDLMKDSDKNNDGRIDFDEFLKMMEGVQ

SEQ ID NO: 94 - protein, 163 aa, Gallus gallus
MASMTDQQAEARAFLSEEMIAEFKAAFDMFDADGGGDISTKELGTVMRMLGQNPTKEELDAIIEEVDEDGSGTIDFEEFLVMMVRQMKEDAKGKSEEELANCFRIFDKNADGFIDIEELGEILRATGEHVTEEDIEDLMKDSDKNNDGRIDFDEFLKMMEGVQ

SEQ ID NO: 95 - protein, 178 aa, Sus scrofa
MRCLLLTLGLALLCGVQAVEVTPIMTELDTQKVAGTWHTVAMAVSDVSLLDAKSSPLKAYVEGLKPTPEGDLEILLQKRENDKCAQEVLLAKKTDIPAVFKINALDENQLFLLDTDYDSHLLLCMENSASPEHSLVCQSLARTLEVDDQIREKFEDALKTLSVPMRILPAQLEEQCRV

SEQ ID NO: 96 - protein, 142 aa, Bos grunniens
MMSFVSLLLVGILFHATQAEQLTKCEVFRELKDLKGYGGVSLPEWVCTTFHTSGYDTQAIVQNNDSTEYGLFQINNKIWCKDDQNPHSSDICNISCDKFLDDDLTDDIMCVKKILDKVGINYWLAHKALCSEKLDQWLCEKL

SEQ ID NO: 97 - protein, 284 aa, Bos taurus
MEAIKKKMQMLKLDKENALDRAEQAEAEQKQAEERSKQLEDELAAMQKKLKGTEDELDKYSEALKDAQEKLELAEKKAADAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESKCSELEEELKNVTNNLKSLEAQAEKYSQKEDKYEEEIKILTDKLKEAETRAEFAERSVAKLEKTIDDLEDELYAQKLKYKAISEELDHALNDMTSI

SEQ ID NO: 98 - protein, 73 aa, Lactococcus lactis
MAVFEKVQDIIVDELGKEKEEVTLETSFEELDADSLDLFQIINDIEDEFDVEVDTEADMKTVADLVKYVENNK

SEQ ID NO: 99 - protein, 81 aa, Thermosynechococcus elongatus
MNQSEILEKVKAIVADQLSVDPEKVVPEASFAEDLNADSLDSVELIMALEEEFGVEIPDEEAEKLKTVQDVLDFINNKVAA

SEQ ID NO: 100 - protein, 80 aa, Lactobacillus acidophilus
MSEEEIFNKIKDLIADNFEVDKDSITENTNFMNDLDADSIDLVEFILQLEDEFGAEIPDDEAEKIKTVGDAVSYIKSHQG

SEQ ID NO: 101 - protein, 81 aa, Thermotoga maritima
MASREEIFSKVKSIISEKLGVDESQVTEEAKLIDDLGADSLDLVDLVMDFESEFGVKVDDADLEKISTVGDIVSYIEKKLG

SEQ ID NO: 102 - protein, 80 aa, Lactobacillus johnsonii
MTEEEIFNKIADMISERFSIDRDKITKDLNFQNDLDADSIDFVELVMDLEDTFGAEIPDDDAEKLQTVGEAVEYIKSHQN

SEQ ID NO: 103 - protein, 154 aa, Oryza sativa
MEGLTSEQMVAFQEAFLLFDKNGDGCITLEELAAVTRSLGLEPTDQELNDMMREVDTDGNGIIDFQEFLSLIARKMKDGDGDEELKEAFEVLDKDQNGFISPTELRTVMTNLGEKMTDEEVEQMIREADTDGDGQVNYDEFVIMMKNAERKISG

SEQ ID NO: 104 - protein, 149 aa, Zea mays
MADQLTDEQIAEFKEAFSLFDKDGDGCITTKELGTVMRSLGQNPTEAELQDMINEVDADGNGTIDFPELLNLMARKMKDTDSEEELKEAFRVFDKDQNGFISAAELRHVMTNLGEKLTDEEVDEMIREADVDGDGQINYEEFVKVMMAK

SEQ ID NO: 105 - protein, 147 aa, Saccharomyces cerevisiae
MSSNLTEEQIAEFKEAFALFDKDNNGSISSSELATVMRSLGLSPSEAEVNDLMNEIDVDGNHQIEFSEFLALMSRQLKSNDSEQELLEAFKVFDKNGDGLISAAELKHVLTSIGEKLTDAEVDDMLREVSDGSGEINIQQFAALLSK

SEQ ID NO: 106 - protein, 149 aa, Capsicum annuum
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 107 - protein, 417 aa, Bos taurus
MLLPVPLLLGLLGLAAADPTVYFKEQFLDGDGWTERWIESKHKPDFGKFVLSSGKFYGDQEKDKGLQTSQDARFYALSARFEPFSNKGQTLVVQFTVKHEQNIDCGGGYVKLFPAGLDQTDMHGDSEYNIMFGPDICGPGTKKVHVIFNYKGKNVLINKDIRCKDDEFTHLYTLIVRPNNTYEVKIDNSQVESGSLEDDWDFLPPKKIKDPDAAKPEDWDDRAKIDDPTDSKPEDWDKPEHIPDPDAKKPEDWDEEMDGEWEPPVIQNPEYKGEWKPRQIDNPEYKGIWIHPEIDNPEYSPDSNIYAYENFAVLGLDLWQVKSGTIFDNFLITNDEAYAEEFGNETWGVTKAAEKQMKDKQDEEQRLHEEEEEKKGKEEEEADKDDDEDKDEDEEDEDEKEEEEEEDAAAGQAKDEL

SEQ ID NO: 108 - protein, 420 aa, Zea mays
MAIRKGSSYAVAALLALASVAAVAGEVFFQEKFEDGWESRWVKSEWKKDENMAGEWNHTSGKWNGDAEDKGIQTSEDYRFYAISAEYPEFSNKDKTLVLQFSVKHEQKLDCGGGYVKLLGGDVDQKTLGGDTSYSIISRPDISRYSTKKVHTILTKDGKNHLIKKDVPCQTDQLTHVYTFIIRPDATYSILIDNEEKHTGSIYEHWDILPPKKIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNIIITDDPALAKTFAEETWGKHKEAEKAAFDEAEKKKEEEDAAKGGDDEDDDLEDEEDDEKADEDKADSDAEDGKDSDDEKHDEL

SEQ ID NO: 109 - protein, 54 aa, Gallus gallus
LAWIPLDGGESEEVVLSGDADSYVIEGLLPNTEYEVSLLAVFDDETESEVVAVL

SEQ ID NO: 110 - protein, 50 aa, Bos taurus
LEYSREGLVWEDIDWIDNGECLDLIEKKLGLLALINEESHFPQATDSTLL

SEQ ID NO: 111 - protein, 50 aa, Sus scrofa
VPKCEWEYPEDCEQVHEGKKLMQCLPNLEEIKLALELYKLSLETKLLELQ

SEQ ID NO: 112 - protein, 51 aa, Gallus gallus
LQQQFNMHVFKLEQEEYMKEQIPWTLIDFYDNQPCINLIEAKMGVLDLLDE

SEQ ID NO: 113 - protein, 58 aa, Sus scrofa
LCINFANEHLQQFFVRHVFKLEQEEYDLESIDWLHIEFTDNQDALDMIANKPMNIISL

SEQ ID NO: 114 - protein, 50 aa, Gallus gallus
LFVKEPPILITHPLEDQMVMVGERVEFECEVSEEGATVKWEKDGVELTRE

SEQ ID NO: 115 - protein, 101 aa, Sus scrofa
EDEDDKTVSDLAVVLFETATLRSGYLLPDTKAYGDRIERMLRLSLNIDPDAKVEEEPEEEPEETTEDTTEDTEQDDDEEMDAGADEEEQETSETSTAEKDE

SEQ ID NO: 116 - protein, 100 aa, Sus scrofa
DEDDKTVSDLAVVLFETATLRSGYLLPDTKAYGDRIERMLRLSLNIDPDAKVEEEPEEEPEETTEDTTEDTEQDDDEEMDAGADEEEQETSETSTAEKDE

SEQ ID NO: 117 - protein, 100 aa, Gallus gallus
NWIVDHVNKALHSTVKQHSFIGVLDIYGFETFEINSFEQFCINYANEKLQQQFNMHVFKLEQEEYMKEQIPWTLIDFYDNQPCINLIEAKMGVLDLLDEE

SEQ ID NO: 118 - protein, 101 aa, Sus scrofa
EVKNPRRSIGLLDIFGFENFAVNSFEQLCINFANEHLQQFFVRHVFKLEQEEYDLESIDWLHIEFTDNQDALDMIANKPMNIISLIDEESKFPKGTDTTML

SEQ ID NO: 119 - protein, 100 aa, Gallus gallus
LMVEVANPDADVKWLKNGQEIQVSGSKYIFEAIGNKRILTINHCSLADDAAYECVVAEEKSFTELFVKEPPILITHPLEDQMVMVGERVEFECEVSEEGA

SEQ ID NO: 120 - protein, 101 aa, Gallus gallus
NGQEIQVSGSKYIFEAIGNKRILTINHCSLADDAAYECVVAEEKSFTELFVKEPPILITHPLEDQMVMVGERVEFECEVSEEGATVKWEKDGVELTREETF

SEQ ID NO: 121 - protein, 203 aa, Bos taurus
EPPVDEYAPEDIMEYDYEYGEAEYKEAESVTETPTVTEETIAQTEANIVDDFQEYNYGTESYQTEAPRSVSGSNEPNPVEEVFTEEYLTGEDYDSQRKNSEDMLYENKQIDGRDSDLLVDGDLGEYDFYEYKEYEDKPTSPTNEEFGPGVPAETDITETSINGHGAYGEKGQKGEPAVVEPGMLIEGPPGPAGPAGLMGPPGL

SEQ ID NO: 122 - protein, 201 aa, Bos taurus
  MOD_RES (9)..(9): Any amino acid
DYCEHYSPXCDSSAPEAAQAQEPPVDEYAPEDIMEYDYEYGEAEYKEAESVTETPTVTEETIAQTEANIVDDFQEYNYGTESYQTEAPRSVSGSNEPNPVEEVFTEEYLTGEDYDSQRKNSEDMLYENKQIDGRDSDLLVDGDLGEYDFYEYKEYEDKPTSPTNEEFGPGVPAETDITETSINGHGAYGEKGQKGEPAVVE

SEQ ID NO: 123 - protein, 201 aa, Bos taurus
ISLTDENALAGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPAEEEEAAKEDKEESDDEAAVEEEEDE

SEQ ID NO: 124 - protein, 202 aa, Gallus gallus
TDENALAGNEELTVKIKCDKEKNMLHVTDTGIGMTKEELIKNLGTIAKSGTSEFLNKMTEMQDDSQSTSELIGQFGVGFYSAFLVADRVIVTSKHNNDTQHIWESDSNEFSVIDDPRGNTLGRGTTITLVLKEEASDYLELDTVKNLVKKYSQFINFPIYVWSSKTETVEEPVEEEEAKEEKEETDDNEAAVEEEEEEKKPK

SEQ ID NO: 125 - protein, 201 aa, Spinacia oleracea
YEIETLTGWLLKQEMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGE

SEQ ID NO: 126 - protein, 203 aa, Bos taurus
TEASLQKLQQLRDEELRRLEDEACRAAQEFLESLNFDEIDECVRNIERSLSVGSGCTGEQGAGAEKPSFNFSQPYPEEEEVDEGFEADDDAFKDSPNPSEHGHSDQRTSGIRTSDESSEEDPYMNDTVVPTSPSADSTVLLAPSEHDSSAGEPTYCLPQTPGALPAPEGDYDYDQDDYEDGAITSGSSVTFSNSCSSQWSPDY

SEQ ID NO: 127 - protein, 178 aa, Sus scrofa; identical to SEQ ID NO: 95

SEQ ID NO: 128 - protein, 142 aa, Equus caballus
MALAAADRATVRALWKKMGSNVGVYATEALERMFLGFPSTTTYFLHLDLSLGSTQVKAHGQKVADALTLAVEHLEDLPRALSALRHRHVRELRVDPASFQLLGHCLLVTPARHFPGDFSPTLHASLVKFLSHVISALASDCR

SEQ ID NO: 129 - protein, 141 aa, Bos taurus
MLSAQERAHITQVWDLIAGHEAPFGAELLRRLFTVYPSTKVYFRHLGDHPDEVQLLSHGQRMLQAVGVAVQYMDNLRAVLSPLADLHAQVLRVDPTNFPLVIQCFQVVLASHLQGEFTVEMQAAWDKFLTGVAVVLTEKYR

SEQ ID NO: 130 - protein, 147 aa, Anas platyrhynchos
MVHWTAEEKQLITGLWGKVNVADCGAEALARLLIVYPWTQRFFASFGNLSSPTAILGNPMVRAHGKKVLTSFGDAVKNLDNIKNTFAQLSELHCDKLHVDPENFRLLGDILIIVLAAHFTKDFTPECQAAWQKLVRVVAHALARKYH

SEQ ID NO: 131 - protein, 162 aa, Ovis orientalis
IIVTQTMKGLDIQKVAGTWHSLAMAASDISLLDAQSAPLRVYVEELKPTPEGNLEILLQKWENGECAQKKIIAEKTKIPAVFKIDALNENKVLVLDTDYKKYLLFCMENSAEPEQSLACQCLVRTPEVDNEALEKFDKALKALPMHIRLAFNPTQLEGQCHV

SEQ ID NO: 132 - protein, 51 aa, Gallus gallus
LLGLLLAWLLLLGLLFGLIALAEEVRKLKSRVDNLEKINHSFLTVNQGNPY

SEQ ID NO: 133 - protein, 51 aa, Bos taurus
KWLLGLLLTWLLLLGLLFGLIALAEEVRKLKARVEELEKMRGRLSYNEKME

SEQ ID NO: 134 - protein, 53 aa, Saccharomyces cerevisiae
RPLLTLSSATRSVLFSLLASDMSIILSISPNTGILLCIGHLLASDIEDVVIVL

SEQ ID NO: 135 - protein, 52 aa, Equus grevyi
VGDALTLAVGHLDDLPGALSNLSDLHAHKLRVDPVNFKLLSHCLLSTLAVHL

SEQ ID NO: 136 - protein, 52 aa, Bubalus bubalis
VAAALTKAVGHLDDLPGALSELSDLHAHKLRVDPVNFKLLSHSLLVTLASHL

SEQ ID NO: 137 - protein, 52 aa, Bos taurus
ILAAILHLGNLKFVVDGDTTLIEDGKLVSIIAELLSTKTDMVEKALLYRTVA

SEQ ID NO: 138 - protein, 52 aa, Gallus gallus
SDGLLALHLKETSTAGGKGDLLLVSPHLIELVTRLHQTLMDATAQALPLSIA

SEQ ID NO: 139 - protein, 51 aa, Bos taurus
KLLKDVEVLSQRLEEKALAYDKLEKTKTRLQQELDDLLVDLDHQRQIVSNL

SEQ ID NO: 140 - protein, 51 aa, Gallus gallus
LHLPFLFDSQWHKLMISVETTSVTLFIDCIKVETLNIKPKGKISVDGFSVL

SEQ ID NO: 141 - protein, 52 aa, Saccharomyces cerevisiae
MIHGGVRYLEKAFWEFSKAQLDLVIEALNERKHLINTAPHLCTVLPILIPIY

SEQ ID NO: 142 - protein, 52 aa, Saccharomyces cerevisiae
LIMKRNFLSWKRGLQLNYNVTRLEEWCKTHGLTDGTECLQHLIQTAKLLQVR

SEQ ID NO: 143 - protein, 53 aa, Saccharomyces cerevisiae
LYLEEVSKNLVEINPLKLEVKAKPWFVYTPMHGVGFDIFSTIVKKTLCLVEGK

SEQ ID NO: 144 - protein, 51 aa, Saccharomyces cerevisiae
KLFTFLNEFDAVLCKFQVVDSMHTKIFNDTLKYLNVMLFNDLITKCPALNW

SEQ ID NO: 145 - protein, 51 aa, Zea mays
EMLVNLGVPWVILGHSERRALLGESNEFVGDKVAYALSQGLKVIACVGETL

SEQ ID NO: 146 - protein, 51 aa, Gallus gallus
GVDGSLQTASFLHLPFLFDSQWHKLMISVETTSVTLFIDCIKVETLNIKPK

SEQ ID NO: 147 - protein, 102 aa, Saccharomyces cerevisiae
VNVIRRESGNPDLLELLMDLNCYTLEVTEGYLKKVNVTEVNGDNVLGPIHVITTVVSSLVRNGLLIQSSKFISKVLLTVESIVMSLPKDETMLGGIFWLSNL

SEQ ID NO: 148 - protein, 103 aa, Bos taurus
LLWALAAALQRREPNLVSRLERHGVELKVAKAEVELSVKRLRAWGARVQAQGCALQVAELRGPVLRLREPLGVLAIVCPDEWPLLAFVSLLAPALAHGNTVVL

SEQ ID NO: 149 - protein, 101 aa, Gallus gallus
LQAVAKDKLVMAEAVQKVNRANGKTVPRLLLLTTEHLVLADPKAAQPKMVLSLCDIQGASVSRFSDGLLALHLKETSTAGGKGDLLLVSPHLIELVTRLHQ

SEQ ID NO: 150 - protein, 102 aa, Saccharomyces cerevisiae
LTLIYLNDLENETLKVFDKIYSTWLVKFMKHASAHIEIFDMVLNEKLFKNSGDEKFAKLFTFLNEFDAVLCKFQVVDSMHTKIFNDTLKYLNVMLFNDLITK

SEQ ID NO: 151 - protein, 101 aa, Bos taurus
VLMRNVALPEDIRGKCTALLQLYDASNSEWQLGKTKVFLRESLEQKLEKRQEEEVTRAAMVIRAHVLGYLARKQYKKVLDCVVIIQKNYRAFLLRRRFLHL

SEQ ID NO: 152 - protein, 101 aa, Ovis aries
WLLLCNPGLAELIAEKIGEDYVKDLSQLTKLNSFLGDDIFLREISNVKQENKLKFSQFLEKEYKVKINPSSMFDVQVKRIHEYKRQLLNCLHVVTMYNRIK

SEQ ID NO: 153 - protein, 102 aa, Sus scrofa
LDTQKVAGTWHTVAMAVSDVSLLDAKSSPLKAYVEGLKPTPEGDLEILLQKRENDKCAQEVLLAKKTDIPAVFKINALDENQLFLLDTDYDSHLLLCMENSA

SEQ ID NO: 154 - protein, 102 aa, Bos taurus
SLWAKVNVEVVGGESLARLLIVCPWTQRFFDSFGNLYSESAIMGNPKVKVYGRKVLNSFGNAIKHMDDLKGTFADLSELHCDKLHVDPENFRLLGNMILIVL

SEQ ID NO: 155 - protein, 106 aa, Sus scrofa
LLNRLADLIERDRTYLAALETLDNGKPYVISYLVDLDMVLKCLRYYAGWADKYHGKTLPIDGDYFSYTRHEPVGVCGQIIPWNFPLLMQAWKLGPALATGNVVVMK

SEQ ID NO: 156 - protein, 101 aa, Gallus gallus
QGMLEYKKEDEQKLVKNLILELKPRGVAVNLIPGLPAYILFMCVRHADYLNDDQKVRSLLTSTINGIKKVLKKRGDDFETVSFWLSNTCRFLHCLKQYSGE

SEQ ID NO: 157 - protein, 469 aa, Oryza sativa
MPREIITIQVGQCGNQIGMEFWKQLCLEHGIGKDGLLEDFATQGGDRKDVFFYQADDQHYIPRALLVDLEPRVINGIQNSEYRNLYNHENIFVAEHGGGAGNNWASGYHQGEQVVDDIMDMIDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLANPTFAQTNSLVSTVMSASTTTLRYPGYMNNDLVGLLASLIPTPRCHFLMTGYTPLTVERQVNMIRKTTVLDVMRRLLQTKNIMVSSYARNKEASQAKYISILNIIQGEVDPTQVHESLQRIRERKLVNFIEWGPASIQVALSRKSPYVQTTHRVSGLMLANHTSIRHLFSKCLGQYEKLRKKQAFLDNYRKFPMFEDNDLSEFDESREIIESLVDEYKACESPDYIKWGMEDAGEANVAAALDSKLVV

SEQ ID NO: 158 - protein, 202 aa, Saccharomyces cerevisiae
QVKPKLVNVIRRESGNPDLLELLMDLNCYTLEVTEGYLKKVNVTEVNGDNVLGPIHVITTVVSSLVRNGLLIQSSKFISKVLLTVESIVMSLPKDETMLGGIFWLSNLSRLPAFAANQKTLYEANGGDEKDKLTLIYLNDLENETLKVFDKIYSTWLVKFMKHASAHIEIFDMVLNEKLFKNSGDEKFAKLFTFLNEFDAVL

SEQ ID NO: 159 - protein, 202 aa, Oryza sativa
HVPRAVLMDLEPGTMDSLRSGPIGGIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPF

SEQ ID NO: 160 - protein, 202 aa, Saccharomyces cerevisiae
TLEVTEGYLKKVNVTEVNGDNVLGPIHVITTVVSSLVRNGLLIQSSKFISKVLLTVESIVMSLPKDETMLGGIFWLSNLSRLPAFAANQKTLYEANGGDEKDKLTLIYLNDLENETLKVFDKIYSTWLVKFMKHASAHIEIFDMVLNEKLFKNSGDEKFAKLFTFLNEFDAVLCKFQVVDSMHTKIFNDTLKYLNVMLFNDL

SEQ ID NO: 161 - protein, 201 aa, Zea mays
YSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIDWAPASIQVA

SEQ ID NO: 162 - protein, 52 aa, Pinus thunbergii
MIIPNLLPNLLSNLLSNLLPILPSILVPLVGLLLPAITMVLSHLYIQKDEIL

SEQ ID NO: 163 - protein, 95 aa, Porphyra purpurea
MYKTLLAQVFFHSIAKKKLYFFWLPRLFSLLLVPGFLFDIEILFLFHPIILLHASLGLSVIIEDYIHIETIKFQYLSLIKLLLVLLINLNILYLL

SEQ ID NO: 164 - protein, 62 aa, Synechococcus elongatus
MVILFQLALLLLVVMSFVLIVGVPVLYATNGDRVQSNRLILVGGLAWTALVVLVGVLNYFVV

SEQ ID NO: 165 - protein, 62 aa, Porphyra purpurea
MIIAIQLLVLLLITLSTILVVGVPVVLASPGQWEQSKGLIYTGAGLWTGLVIVTSLVNSLVV

SEQ ID NO: 166 - protein, 105 aa, Salmo trutta
RNQPTAALGHLLPEGTPVPLIPVLIIIETISLFIRPLALGVRLTANLTAGHLLIQLIATAAFVLLPMMPTVAILTSIVLFLLTLLEIAVAMIQAYVFVLLLSLYL

SEQ ID NO: 167 - protein, 227 aa, Struthio camelus
MNLSFFDQFASPQLLGIPLILLSLLFPTLLLPSPNNRWINNRLSTLQLWFLQLITKQLMMPLNKAGHKWALILTSLMTFLLLINLLGLLPYTFTPTTQLSMNMALAFPLWLATLLTGLRNQPSISLGHLLPEGTPTPLIPALILIETTSLLIRPLALGVRLTANLTAGHLLIQLISTATLALLPTMPTISVLTATVLLLLTILELAVAMIQAYVFVLLLSLYLQENI

SEQ ID NO: 168 - protein, 225 aa, Alligator mississippiensis
MNLFDQFLTPSLLGISLLMPALLMTTILLLNPKNQWLSHPTTTIKSWFINQAAKQIMTPINPTGHKHSLILISLLILLSLTNLLGLLPYTFTPTTQLSMNMAIALPLWLVTVLIGLRTQPTTSLAHLLPEGTPMLLIPILILIETISLLIRPIALGVRLTANLTAGHLLIQLISIATLNLWFMMPPLSLLTSTVLILLLLLEFAVAMIQAYVFVLLLSLYLQENS

SEQ ID NO: 169 - protein, 56 aa, Pinus koraiensis
MIIPNLPFNLPFNLPFNLPFNLPSILPSILVPLVGLLLPAITMVLSHLYIQNDEIL

SEQ ID NO: 170 - protein, 227 aa, Gallus gallus
MNLSFFDQFSSPCLLGIPLILPSLLLPALLLPSPGNRWINNRLSTIQLWFTHLITKQLMTPLNKAGHKWALLLTSLILMLLSINLLGLLPYTFTPTTQLSMNMALALPLWLATLLTGLRNQPSASLGHLLPEGTPTPLIPALIMIETTSLLIRPLALGVRLTANLTAGHLLIQLISTATIALLPMMPSISALTALILFLLTILEVAVAMIQAYVFVLLLSLYLQENI

SEQ ID NO: 171 - protein, 219 aa, Oncorhynchus masou
FMSPTYLGIPLIAVALTLPWILFPTPSARWLNNRLITLQGWFINRFTQQLLLPLNLGGHKWAALLTSLMLFLITLNMLGLLPYTFTPTTQLSLNMGLAVPLWLATVIIGMRNQPTAALGHLLPEGTPVPLIPVLIIIETISLFIRPLALGVRLTANLTAGHLLIQLIATAAFVLLPLMPTVAILTSIVLFLLTLLEIAVAMIQAYVFVLLLSLYLQENV

SEQ ID NO: 172 - protein, 98 aa, Lagenorhynchus albirostris
MSLVHINVLIAFTVSLTGLLMYRSHLMSALLCLEGMVLSLFILAALTILNTHFTLANMMPIILLVFAACEAAIGLALLVMVSNTYGTDYVQNLNLLQC

SEQ ID NO: 173 - protein, 223 aa, Oncorhynchus mykiss
MTLSFFDQFMSPTYLGIPLIAVALTLPWILFPTPSARWLNNRLITLQGWFINRFTQQLLLPLNLGGHKWAALLTSLMLFLITLNMLGLLPYTFTPTTQLSLNMGLAVPLWLATVIIGMRNQPTAALGHLLPEGTPVPLIPVLIIIETISLFIRPALGVRLTANLTAGHQLIATAAFVLLPMMPTVAILTSIVLFLLTLLEIAVAMIQAYVFVLLLSLYLQENV

SEQ ID NO: 174 - protein, 133 aa, Thunnus obesus
LALTLPWVLFPTPTSRWLNNRLLTLQNWFIGRFGHELFTPVNLPGHKWAVLLTSLMLFLISLNMLGLLPYTFTPTTQLSLNMGLAFPLWLATVIIGMRNQPTEALGHLLPEGTPTLLIPVLIVIETISLFIRP

SEQ ID NO: 175 - protein, 58 aa, Brassica tournefortii
GFAWTMLCMNEIFYFIGALGPLFIVLALTGLELGVAILQAYVFTILICIYLNDAINLH

SEQ ID NO: 176 - protein, 226 aa, Bos indicus
MNENLFASFITPVILGLPLVTLIVLFPSLLFPTSNRLVSNRFVTLQQWMLQLVSKQMMSIHNSKGQTWALMLMSLILFIGSTNLLGLLPHSFTPTTQLSMNLGMAIPLWAGAVITGFRNKTKASLAHFLPQGTPTPLIPMLVIIETISLFIQPVALAVRLTANITAGHLLIHLIGGATLALMSISTTTALITFTILILLTILEFAVAMIQAYVFTLLVSLYLHDNT

SEQ ID NO: 177 - protein, 108 aa, Populus trichocarpa
VFLGLGLILGGLGVVLLTNPIFSAFSLGLVLVCISLFYILSNSHFVAAAQLLIYVGAINVLILFAVMFMNGSEYYKDFNLWTVGNGLTSLICTSLFVLLITIISNTTW

SEQ ID NO: 178 - protein, 103 aa, Brassica napus
HFFSFLLPAGVPLPLAPFLVLLELISYCFRALSLGIRLFANMMAGHSLVKILSGFAWTMLCMNEIFYFIGALGPLFIVLALTGLELGVAILQAYVFTILICIY

SEQ ID NO: 179 - protein, 101 aa, Triticum aestivum
CECYFDLSGLILCPVLGSIILLFIPNSSIRLIRLIGLCVSLITFLYSLVLWIQFDPSTAKFQFVESLRWLPYENIHLYMGIDGLSLFFVILTTFLIPICIL

SEQ ID NO: 180 - protein, 101 aa, Oncorhynchus mykiss
WFVASLANLALPPLPNLMGELMIITSMFNWSYWTLILTGLGTLITASYSLYLFLMTQRGPLPSHIIALEPTHTREHLLIILHLIPIVLLILKPELMWGWCF

SEQ ID NO: 181 - protein, 101 aa, Phoca vitulina
YSLLISLISLSFLNQLGDNCMSLSLLFFTDSLSAPLLALTTWLLPLMLMASQFHLSKEPLTRKKLYITMLILLQLFLIMTFTATELIMFYILFEATLVPTL

SEQ ID NO: 182 - protein, 102 aa, Equus asinus
WYFLFAYAILRSIPNKLGGVLALILSILILALIPTLHMSKQRSMMFRPLSQCVFWLLVADLLTLTWIGGQPVEHPYVIIGQLASILYFSLILIFMPLASTIE

SEQ ID NO: 183 - protein, 102 aa, Fagopyrum esculentum
QLLIYVGAINVLIIFAVMFINGLEYDKNLRLFTLGDGMTLVICTGIFFLLITTILNTSGYGIIWTTKLNQILEQDLINNSQQIGIHLSTDFFPPFELISIIL

SEQ ID NO: 184 - protein, 101 aa, Triticum aestivum
LYSLVLWIQFDPSTAKFQFVESLRWLPYENIHLYMGIDGLSLFFVILTTFLIPICILVGWSGMRSFGKEYIIAFLICEFLMIAVFCMLDLLLFYVFFESVL

SEQ ID NO: 185 - protein, 101 aa, Triticum aestivum
GSIILLFIPNSSIRLIRLIGLCVSLITFLYSLVLWIQFDPSTAKFQFVESLRWLPYENIHLYMGIDGLSLFFVILTTFLIPICILVGWSGMRSFGKEYIIA

SEQ ID NO: 186 - protein, 107 aa, Triticum aestivum
MIAVFCMLDLLLFYVFFESVLIPMFIIIGVWGSRQRKIKAAYQFFLYTLLGSVFMLLAILLILLQTGTTDLQILLTTEFSERRQILLWIAFFASFAVKVPMVPVHIW

SEQ ID NO: 187 - protein, 102 aa, Brassica napus
SFFLLLIHFITKKGGGNLVPNAWQSLVELLYDFVLNLVKEQIGGLSGNVKQMFFPCILVTFLFLLFCNLQGMIPYSFTVTSHFLITLALSFSIFIGITIVGF

SEQ ID NO: 188 - protein, 102 aa, Alligator mississippiensis
LPLWLVTVLIGLRTQPTTSLAHLLPEGTPMLLIPILILIETISLLIRPIALGVRLTANLTAGHLLIQLISIATLNLWFMMPPLSLLTSTVLILLLLLEFAVA

SEQ ID NO: 189 - protein, 101 aa, Coturnix coturnix
LMGMPLILPSLLLPTLLFPTPGRRWISNRLSTLQLWVINLITKQLMTPLNKTGHKWALLLTSLILLLLSINLMGLLPYTFTPTTQLSMNMALAFPLWLATL

SEQ ID NO: 190 - protein, 102 aa, Gallus gallus
WALLLTSLILMLLSINLLGLLPYTFTPTTQLSMNMALALPLWLATLLTGLRNQPSASLGHLLPEGTPTPLIPALIMIETTSLLIRPLALGVRLTANLTAGHL

SEQ ID NO: 191 - protein, 101 aa, Alligator mississippiensis
KQIMTPINPTGHKHSLILISLLILLSLTNLLGLLPYTFTPTTQLSMNMAIALPLWLVTVLIGLRTQPTTSLAHLLPEGTPMLLIPILILIETISLLIRPIA

SEQ ID NO: 192 - protein, 102 aa, Coturnix coturnix
LATLLIGLRNQPSASLAHLLPEGTPTPLIPILIMIETTSLLIRPLALGVRLTANLTAGHLLIQLISTATIALLPTMPSISTLTALILLLLTILEVAVAMIQA

SEQ ID NO: 193 - protein, 50 aa, Gallus gallus
LEFLSMINVNLLSISNLPKLNKLRKLELSDNRISGGLEVLAERTPNLTHL

SEQ ID NO: 194 - protein, 50 aa, Gallus gallus
FLSMINVNLLSISNLPKLNKLRKLELSDNRISGGLEVLAERTPNLTHLNL

SEQ ID NO: 195 - protein, 50 aa, Gallus gallus
LSMINVNLLSISNLPKLNKLRKLELSDNRISGGLEVLAERTPNLTHLNLS

SEQ ID NO: 196 - protein, 146 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLD

SEQ ID NO: 197 - protein, 147 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDG

SEQ ID NO: 198 - protein, 148 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGF

SEQ ID NO: 199 - protein, 149 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFD

SEQ ID NO: 200 - protein, 150 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDA

SEQ ID NO: 201 - protein, 151 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDAD

SEQ ID NO: 202 - protein, 152 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADE

SEQ ID NO: 203 - protein, 153 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQ

SEQ ID NO: 204 - protein, 154 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQE

SEQ ID NO: 205 - protein, 161 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQEAPDSDPE

SEQ ID NO: 206 - protein, 50 aa, Bos taurus
LKVLQRNCAAYLKLRHWQWWRVFTKVKPLLQVTRQEEELQAKDEELLKVK

SEQ ID NO: 207 - protein, 67 aa, Bos taurus
YLKLRHWQWWRVFTKVKPLLQVTRQEEELQAKDEELLKVKEKQTKVEGELEEMERKHQQLLEEKNIL

SEQ ID NO: 208 - protein, 55 aa, Bos taurus
EEELQAKDEELLKVKEKQTKVEGELEEMERKHQQLLEEKNILAEQLQAETELFAE

SEQ ID NO: 209 - protein, 105 aa, Bos taurus
LARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAE

SEQ ID NO: 210 - protein, 100 aa, Bos taurus
YLKLRHWQWWRVFTKVKPLLQVTRQEEELQAKDEELLKVKEKQTKVEGELEEMERKHQQLLEEKNILAEQLQAETELFAEAEEMRARLAAKKQELEEILH

SEQ ID NO: 211 - protein, 105 aa, Bos taurus
YLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESR

SEQ ID NO: 212 - protein, 50 aa, Bos taurus
LEEAKKKLLKDVEVLSQRLEEKALAYDKLEKTKTRLQQELDDLLVDLDHQ

SEQ ID NO: 213 - protein, 50 aa, Bos taurus
GTIENLEEAKKKLLKDVEVLSQRLEEKALAYDKLEKTKTRLQQELDDLLV

SEQ ID NO: 214 - protein, 70 aa, Bos taurus
QLQALQAQLTDTKKKVDDDLGTIENLEEAKKKLLKDVEVLSQRLEEKALAYDKLEKTKTRLQQELDDLLV

SEQ ID NO: 215 - protein, 55 aa, Bos taurus
KKLLKDVEVLSQRLEEKALAYDKLEKTKTRLQQELDDLLVDLDHQRQIVSNLEKK

SEQ ID NO: 216 - protein, 65 aa, Bos taurus
KKLLKDVEVLSQRLEEKALAYDKLEKTKTRLQQELDDLLVDLDHQRQIVSNLEKKQKKFDQLLAE

SEQ ID NO: 217 - protein, 55 aa, Bos taurus
VDDDLGTIENLEEAKKKLLKDVEVLSQRLEEKALAYDKLEKTKTRLQQELDDLLV

SEQ ID NO: 218 - protein, 55 aa, Bos taurus
GTIENLEEAKKKLLKDVEVLSQRLEEKALAYDKLEKTKTRLQQELDDLLVDLDHQ

SEQ ID NO: 219 - protein, 50 aa, Bos taurus
KKLLKDVEVLSQRLEEKALAYDKLEKTKTRLQQELDDLLVDLDHQRQIVS

SEQ ID NO: 220 - protein, 65 aa, Bos taurus
DTKKKVDDDLGTIENLEEAKKKLLKDVEVLSQRLEEKALAYDKLEKTKTRLQQELDDLLVDLDHQ

SEQ ID NO: 221 - protein, 60 aa, Bos taurus
LEEAKKKLLKDVEVLSQRLEEKALAYDKLEKTKTRLQQELDDLLVDLDHQRQIVSNLEKK

SEQ ID NO: 222 - protein, 50 aa, Bos taurus
EKANKLQNELDNVSTLLEEAEKKGIKFAKDAAGLESQLQDTQELLQEETR

SEQ ID NO: 223 - protein, 50 aa, Bos taurus
EKALAYDKLEKTKTRLQQELDDLLVDLDHQRQIVSNLEKKQKKFDQLLAE

SEQ ID NO: 224 - protein, 60 aa, Bos taurus
DTKKKVDDDLGTIENLEEAKKKLLKDVEVLSQRLEEKALAYDKLEKTKTRLQQELDDLLV

SEQ ID NO: 225 - protein, 100 aa, Bos taurus
RSLEKQLQALQAQLTDTKKKVDDDLGTIENLEEAKKKLLKDVEVLSQRLEEKALAYDKLEKTKTRLQQELDDLLVDLDHQRQIVSNLEKKQKKFDQLLAE

SEQ ID NO: 226 - protein, 100 aa, Bos taurus
QLQALQAQLTDTKKKVDDDLGTIENLEEAKKKLLKDVEVLSQRLEEKALAYDKLEKTKTRLQQELDDLLVDLDHQRQIVSNLEKKQKKFDQLLAEEKNIS

SEQ ID NO: 227 - protein, 100 aa, Bos taurus
DTKKKVDDDLGTIENLEEAKKKLLKDVEVLSQRLEEKALAYDKLEKTKTRLQQELDDLLVDLDHQRQIVSNLEKKQKKFDQLLAEEKNISARYAEERDRA

SEQ ID NO: 228 - protein, 112 aa, Bos taurus
DTKKKVDDDLGTIENLEEAKKKLLKDVEVLSQRLEEKALAYDKLEKTKTRLQQELDDLLVDLDHQRQIVSNLEKKQKKFDQLLAEEKNISARYAEERDRAEAEAREKETKAL

SEQ ID NO: 229 - protein, 51 aa, Bos taurus
GKSALLDEKRRLEARIAQLEEELEEEQSNMELLNDRFRKTTLQVDTLNTEL

SEQ ID NO: 230 - protein, 51 aa, Bos taurus
QNKELKAKLQELEGAVKSKFKATISALEAKIGQLEEQLEQEAKERAAANKL

SEQ ID NO: 231 - protein, 89 aa, Bos taurus
IAQLEEELEEEQSNMELLNDRFRKTTLQVDTLNTELAAERSAAQKSDNARQQLERQNKELKAKLQELEGAVKSKFKATISALEAKIGQL

SEQ ID NO: 232 - protein, 99 aa, Bos taurus
ELLNDRFRKTTLQVDTLNTELAAERSAAQKSDNARQQLERQNKELKAKLQELEGAVKSKFKATISALEAKIGQLEEQLEQEAKERAAANKLVRRTEKKL

SEQ ID NO: 233 - protein, 110 aa, Gallus gallus
ILVLISGGESSDDIREGLLAVKQASIFSFSIGVLNADSAELQQIATDGSFAFTALDIRNLAALRELLLPNIVGVAQRLILLEAPTIVTEVIEVNKKDIVFLIDGSTALGT

SEQ ID NO: 234 - protein, 105 aa, Gallus gallus
ILVLISGGESSDDIREGLLAVKQASIFSFSIGVLNADSAELQQIATDGSFAFTALDIRNLAALRELLLPNIVGVAQRLILLEAPTIVTEVIEVNKKDIVFLIDGS

SEQ ID NO: 235 - protein, 118 aa, Gallus gallus
YSTKADVLDAVKALSFRGGKEANTGAALEYVVENLFTQAGGSRIEEAVPQILVLISGGESSDDIREGLLAVKQASIFSFSIGVLNADSAELQQIATDGSFAFTALDIRNLAALRELLL

SEQ ID NO: 236 - protein, 65 aa, Bos taurus
ALQEAHQQTLDDLQAEEDKVNTLTKAKTKLEQQVDDLEGSLEQEKKLRMDLERAKRKLEGDLKLA

SEQ ID NO: 237 - protein, 50 aa, Bos taurus
EEDKVNTLTKAKTKLEQQVDDLEGSLEQEKKLRMDLERAKRKLEGDLKLA

SEQ ID NO: 238 - protein, 55 aa, Bos taurus
LEDECSELKKDIDDLELTLAKVEKEKHATENKVKNLTEEMAGLDETIAKLTKEKK

SEQ ID NO: 239 - protein, 50 aa, Bos taurus
LEQEKKLRMDLERAKRKLEGDLKLAQESTMDIENDKQQLDEKLKKKEFEM

SEQ ID NO: 240 - protein, 50 aa, Bos taurus
DLEGSLEQEKKLRMDLERAKRKLEGDLKLAQESTMDIENDKQQLDEKLKK

SEQ ID NO: 241 - protein, 115 aa, Bos taurus
SELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLA

SEQ ID NO: 242 - protein, 50 aa, Struthio camelus
RFFLVAILFLLFDLEIALLLPLPWAIQLSQPLLTLLWTSILLLLLTLGLV

SEQ ID NO: 243 - protein, 50 aa, Bos taurus
GLEVGSLLLPLLLLLLLLLWYCQIQYRPFFPLTATLGLAGFTLLLSLLAF

SEQ ID NO: 244 - protein, 52 aa, Gallus gallus
LQGSSLITALLLSTLMKLPPITLLLLTSQSLNTTLLTLLAISSTLIGGWMGL

SEQ ID NO: 245 - protein, 52 aa, Gallus gallus
LGLVPFHFWFPEVLQGSSLITALLLSTLMKLPPITLLLLTSQSLNTTLLTLL

SEQ ID NO: 246 - protein, 51 aa, Gallus gallus
LGTLHQLAIVTGILISQVLGLDFLLGNDELWPLLLGLSGVAALLQFFLLLL

SEQ ID NO: 247 - protein, 99 aa, Gallus gallus
LLMGLAKMGPSHILIIAGRAITGLYCGLSSGLVPMYVSEVSPTALRGALGTLHQLAIVTGILISQVLGLDFLLGNDELWPLLLGLSGVAALLQFFLLLL

SEQ ID NO: 248 - protein, 54 aa, Alligator mississippiensis
LKLITKELTLPLLATPTLFILAPTAALMLALAMWSPLPMPSPLADLNLGLLLLL

SEQ ID NO: 249 - protein, 99 aa, Alligator mississippiensis
LLIISILMAVAFLTALERKIMGHMQLRKGPNIVGPLGLLQPFADGLKLITKELTLPLLATPTLFILAPTAALMLALAMWSPLPMPSPLADLNLGLLLLL

SEQ ID NO: 250 - protein, 51 aa, Bos taurus
LWETPTLLWEAPLLGLDTAQGLELLSLLGTVLALGALLTRQLHHPLVYLLL

SEQ ID NO: 251 - protein, 68 aa, Bos taurus
LLQVLIILTGNYNFFNLLTLVLTTALLDDTHLAAKSSTSRRKRMPSSWPKALLAMLTLLLELAVYGLL

SEQ ID NO: 252 - protein, 51 aa, Bos taurus
LLTVLWVVPTLGTDRLLLALLLTLYLGLAHGLDQHDLRYLRAQLQRKLHLL

SEQ ID NO: 253 - protein, 92 aa, Bos taurus
LLCFVLHVISWLLIFSILLVFDYAELMGLKQVYYHVLGLGEPLALKSPRALRLFSHLRHPVCVELLTVLWVVPTLGTDRLLLALLLTLYLGL

SEQ ID NO: 254 - protein, 81 aa, Bos taurus
LLIFSILLVFDYAELMGLKQVYYHVLGLGEPLALKSPRALRLFSHLRHPVCVELLTVLWVVPTLGTDRLLLALLLTLYLGL

SEQ ID NO: 255 - protein, 50 aa, Oryza sativa
  source: /note="subsp. japonica"
LVLAALVILLALLLTLVLSHFLPLLLNPKAPKGSFGWPLLGETLRFLSPH

SEQ ID NO: 256 - protein, 52 aa, Oryza sativa
  source: /note="subsp. japonica"
MVGGELVLAALVILLALLLTLVLSHFLPLLLNPKAPKGSFGWPLLGETLRFL

SEQ ID NO: 257 - protein, 54 aa, Salmo salar
LLLPLNLGGHKWAVLLTSLMLFLITLNMLGLLPYTFTPTTQLSLNMGLAVPLWL

SEQ ID NO: 258 - protein, 50 aa, Pisum sativum
IPLFLHLLLMSRKLLMKRRTKVVRRMNLMLLLTLLLSPLSLRQGKLHWRL

SEQ ID NO: 259 - protein, 51 aa, Saccharomyces cerevisiae
KAFTSLLCGLGLSTTLAKAISLQRPLGLDKDVLLQAAEKFGLDLDLDHLLK

SEQ ID NO: 260 - protein, 50 aa, Bos taurus
GLFLLKLGLSLLMLLAGPDHPGLLCLFIASNRVFTEGTCKLLTLVVTDLV

SEQ ID NO: 261 - protein, 52 aa, Saccharomyces cerevisiae
LLNLGFITLCLLILFESLNSTVLIPLRDDEHLQLFNVLFNYLPLLKSNLTTL

SEQ ID NO: 262 - protein, 55 aa, Bos taurus
VTFLSLTDLQKNETLDHLISLSGAVQLRHLSNNLETLLKRDFLKLLPLELSFYLL

SEQ ID NO: 263 - protein, 52 aa, Bos taurus
LPLQMLLCLSGTYYALYFLATLLLLVYKSQVFTYPHSCLVLDLTLLFLMGIL

SEQ ID NO: 264 - protein, 243 aa, Bos taurus
ADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESTMDIENDKQQLDEKLKKKEFEMSNLQSKIEDEQALAMQLQKKIKELQARIEELEEEIEAERASRAKAEKQRSDLSR

SEQ ID NO: 265 - protein, 270 aa, Bos taurus
SEGDRLRVELAEKANKLQNELDNVSTLLEEAEKKGIKFAKDAAGLESQLQDTQELLQEETRQKLNLSSRIRQLEEERSSLQEQQEEEEEARRSLEKQLQALQAQLTDTKKKVDDDLGTIENLEEAKKKLLKDVEVLSQRLEEKALAYDKLEKTKTRLQQELDDLLVDLDHQRQIVSNLEKKQKKFDQLLAEEKNISARYAEERDRAEAEAREKETKALSLARALEEALEAREEAERQNKQLRADMEDLMSSKDDVGKNVHELEKSKRALE

SEQ ID NO: 266 - protein, 65 aa, Unknown
  source: /note="Description of Unknown: polypeptide"
DTKKKVDDDLGTIENLEEAKKKLLKDLEVLSQRLEEKALAYDKLEKTKTRLQQELDDLLLDLDHQ

SEQ ID NO: 267 - protein, 65 aa, Unknown
  source: /note="Description of Unknown: polypeptide"
DTKKKLDDDLGTLENLEEAKKKLLKDLEVLSQRLEEKALAYDKLEKTKTRLQQELDDLLLDLDHQ

SEQ ID NO: 268 - protein, 65 aa, Unknown
  source: /note="Description of Unknown: polypeptide"
DTKKKLDDDLGTLENLEEAKKKLLKDLELLSQRLEELALAYDKLEKTKTRLQQELDDLLLDLDHQ

SEQ ID NO: 269 - protein, 65 aa, Unknown
  source: /note="Description of Unknown: polypeptide"
DLKKKLDDDLGTLENLEELKKKLLKDLELLSQRLEELALAYDKLEKTKTRLQQELDDLLLDLDHQ

SEQ ID NO: 270 - protein, 65 aa, Unknown
  source: /note="Description of Unknown: polypeptide"
DLKKKLDDDLGTLENLEELKKKLLKDLELLSQRLEELLLLYDKLEKTKTRLQQELDDLLLDLDHQ

SEQ ID NO: 271 - protein, 65 aa, Unknown
  source: /note="Description of Unknown: polypeptide"
DLKKKLDDDLGLLELLEELKKKLLKDLELLSQRLEELLLLYDKLEKTKTRLQQELDDLLLDLDHQ

SEQ ID NO: 272 - protein, 65 aa, Unknown
  source: /note="Description of Unknown: polypeptide"
DTKKKLDDDLGTLENLEEAKKKLLKDLELLSQRLEEKLLAYDKLEKTKTRLQQELDDLLLDLDHQ

SEQ ID NO: 273 - protein, 65 aa, Unknown
  source: /note="Description of Unknown: polypeptide"
DTKKKLDDDLGTLELLEEAKKKLLKDLELLSQRLEEKLLLYDKLEKTKTRLQQELDDLLLDLDHQ

SEQ ID NO: 274 - protein, 65 aa, Unknown
  source: /note="Description of Unknown: polypeptide"
DTKKKLDDDLLLLELLEEAKKKLLKDLELLSQRLEEKLLLYDKLEKTKTRLQQELDDLLLDLDHQ

SEQ ID NO: 275 - protein, 65 aa, Unknown
  source: /note="Description of Unknown: polypeptide"
DLKKKLDDDLLLLELLEELKKKLLKDLELLSQRLEEKLLLYDKLEKTKTRLQQELDDLLLDLDHQ

SEQ ID NO: 276 - protein, 65 aa, Unknown
  source: /note="Description of Unknown: polypeptide"
DTKKKLDDDLLLLELLEEAKKKLLKDLELLLQRLEEKLLLLDKLEKTKTRLQQELDDLLLDLDHQ

SEQ ID NO: 277 - protein, 94 aa, Ovis aries
IWVMAAALCLPELLYSQVKEEHGTAICTVVYSSNESTKLKSAVLTLKVTLGFFLPFVVMACCYAIIIHTLIRAKKSSKHKALKVTITVLTVFVL

SEQ ID NO: 278 - protein, 272 aa, Clostridium thermocellum
VVNTPFVAVFSNFDSSQWEKADWANGSVFNCVWKPSQVTFSNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYEYVKYYPNGVPQDNPTPTPTIAPSTPTNPNLPLKGDVNGDGHVNSSDYSLFKRYLLRVIDRFPVGD

SEQ ID NO: 279 - protein, 65 aa, Unknown
  source: /note="Description of Unknown: polypeptide"
DTKKKLDDDLGLLELLEELKKKLLKDLELLSQRLEELLLLYDKLEKTKTRLQQELDDLLLDLDHQ

SEQ ID NO: 280 - protein, 65 aa, Unknown
  source: /note="Description of Unknown: polypeptide"
DLKKKLDDDLLLLELLEEAKKKLLKDLELLSQRLEEKLLLYDKLEKTKTRLQQELDDLLLDLDHQ

SEQ ID NO: 281 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 282 - protein, 25 aa, Schizosaccharomyces pombe
  source: /note="strain 972 / ATCC 24843"
LCERLKEQSWTIVFKTLIVFHVMLK

SEQ ID NO: 283 - protein, 53 aa, Arabidopsis thaliana
VRDTEFVHQITNVIKLRRAEPLRRSLKPYECKFKTDHLIWVLMKIKCDYRLVL

SEQ ID NO: 284 - protein, 113 aa, Arabidopsis thaliana
KLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWK

SEQ ID NO: 285 - protein, 60 aa, Gallus gallus
IFLRVTARHVIEVELKAARVLHKLELKCLQKIETSEMTWKRMDLERVFPVLTLHFTYIRK

SEQ ID NO: 286 - protein, 54 aa, Saccharomyces cerevisiae
  source: /note="strain ATCC 204508 / S288c"
LDVLKGKNQVCLFVSLRHKETGTIFVVLNTHLYWKYDEVKLTQCMIIMRELSKI

SEQ ID NO: 287 - protein, 73 aa, Saccharomyces cerevisiae
  source: /note="strain ATCC 204508 / S288c"
LVLGALLDTSHKFRNLDKDLCEKCAKCISMIGVLDVTKHEFKRTTYSENEVYDLNDSVQTIKFLIWVINDILV

SEQ ID NO: 288 - protein, 232 aa, Acipenser transmontanus
MQKVKVLQVCAWVLLLWRCWGVLGYPLDCKDEQGSIISCTSISLEKLLDRVIQHAELIYHVSEESCTLFEEMFVPVSMRTQQNRARNTCITKAFPIPGSKSEIQKISDKWLLHSVLMLVQSWIEPLVYLQKTLDRYDDAPDTILNKTKWVTNKLSSLEQGIVELIRKMLDEGLLAVDHQQTLTRFDVQPEVVESILRDYAVLTCFKKDAHKMEVFLKLLKCRHTDKMSCYIS

SEQ ID NO: 289 - protein, 206 aa, Arabidopsis thaliana
MANDVTKDPTPKSDIVEDIYLWRRKKLAFSTLLVSTSTWILLSFYGFTTITIVSWIGIAVVSMIFLWGSLLRLLSKVEPELSGLEVSEEFVVETVRSCRMLMEEMVRWMFRVGAESEWFVFARTVLGFWILSRIGNLLDFHTCLFIGLVMGLTVPKLWEEYGDQIQKHLGSLKDKSKGAYNTTHEKILEMKNKLHHGTEEKVKKSE

SEQ ID NO: 290 - protein, 361 aa, Arabidopsis thaliana
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEMLEFHKSHGGEASIMVTKVDEPSKYGVVVMEESTGRVEKFVEKPKLYVGNKINAGIYLLNPSVLDKIELRPTSIEKETFPKIAAAQGLYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 291 - protein, 90 aa, Saccharomyces cerevisiae
  source: /note="strain ATCC 204508 / S288c"
LVLGALLDTSHKFRNLDKDLCEKCAKCISMIGVLDVTKHEFKRTTYSENEVYDLNDSVQTIKFLIWVINDILVPAFWQSENPSKQLFVAL

SEQ ID NO: 292 - protein, 70 aa, Saccharomyces cerevisiae
  source: /note="strain ATCC 204508 / S288c"
LVLGALLDTSHKFRNLDKDLCEKCAKCISMIGVLDVTKHEFKRTTYSENEVYDLNDSVQTIKFLIWVIND

SEQ ID NO: 293 - protein, 75 aa, Saccharomyces cerevisiae
  source: /note="strain ATCC 204508 / S288c"
TLVLGALLDTSHKFRNLDKDLCEKCAKCISMIGVLDVTKHEFKRTTYSENEVYDLNDSVQTIKFLIWVINDILVP

SEQ ID NO: 294 - protein, 76 aa, Saccharomyces cerevisiae
  source: /note="strain ATCC 204508 / S288c"
LVLGALLDTSHKFRNLDKDLCEKCAKCISMIGVLDVTKHEFKRTTYSENEVYDLNDSVQTIKFLIWVINDILVPAF

SEQ ID NO: 295 - protein, 74 aa, Saccharomyces cerevisiae
  source: /note="strain ATCC 204508 / S288c"
ITLVLGALLDTSHKFRNLDKDLCEKCAKCISMIGVLDVTKHEFKRTTYSENEVYDLNDSVQTIKFLIWVINDIL

SEQ ID NO: 296 - protein, 76 aa, Saccharomyces cerevisiae
  source: /note="strain ATCC 204508 / S288c"
SDITLVLGALLDTSHKFRNLDKDLCEKCAKCISMIGVLDVTKHEFKRTTYSENEVYDLNDSVQTIKFLIWVINDIL

SEQ ID NO: 297 - protein, 154 aa, Ovis aries
MGLSDGEWQLVLNAWGKVEADVAGHGQEVLIRLFTGHPETLEKFDKFKHLKTEAEMKASEDLKKHGNTVLTALGGILKKKGHHEAEVKHLAESHANKHKIPVKYLEFISDAIIHVLHAKHPSDFGADAQGAMSKALELFRNDMAAQYKVLGFQG

SEQ ID NO: 298 - protein, 154 aa, Bos taurus
MGLSDGEWQLVLNAWGKVEADVAGHGQEVLIRLFTGHPETLEKFDKFKHLKTEAEMKASEDLKKHGNTVLTALGGILKKKGHHEAEVKHLAESHANKHKIPVKYLEFISDAIIHVLHAKHPSDFGADAQAAMSKALELFRNDMAAQYKVLGFHG

SEQ ID NO: 299 - protein, 154 aa, Sus scrofa
MGLSDGEWQLVLNVWGKVEADVAGHGQEVLIRLFKGHPETLEKFDKFKHLKSEDEMKASEDLKKHGNTVLTALGGILKKKGHHEAELTPLAQSHATKHKIPVKYLEFISEAIIQVLQSKHPGDFGADAQGAMSKALELFRNDMAAKYKELGFQG

SEQ ID NO: 300 - protein, 402 aa, Sus scrofa
MSAADRMGARAVPGLRLALLLLLVLGTPKSGVHGEEGLDFPQYDGVDRVVNVNAKNYKNVFKKYEVLALLYHEPPEDDKASQKQFELEELILELAAQVLEDKGVGFGMVDSEKDAAVAKKLGLTEEDSIYVFKGDEVIEYDGEFSADTLVEFLLDVLEDPVELIEGERELQAFENIEDEIKLIGYFKNKDSEHYKAFEDAAEEFHPYIPFFATFDSKVAKKLTLKLNEIDFYEAFMEEPVTIPDKPNSEEEIVHFVEKHRRSTLRKLKPESMYETWEDDMDGIHIVAFAEEADPDGYEFLETLKSVAQDNTDNPDLSIIWIDPDDFPLLVPYWEKTFDIDLSAPQIGVVNVTDADSIWMEMDDEEDLPSAEELEDWLEDVLSGEINTEDDDEDDDDDDDDDD

SEQ ID NO: 301 - protein, 395 aa, Bos taurus
MSAADRMGARAVPGLRLALLLLMVLGTPKSGVQGEEGLDFPEYDGVDRVVNVNAKNYKNVFKKYEVLALLYHEPPEDDKASQRQFEMDELILELAAQVLEDKGVGFGMVDSEKDAAVAKKLGLTEEDSVYVFKGDEVIEYDGEFSADTLVEFLLDVLEDPVELIEGERELQAFENIEDDNKLIGYFKNKDSEHYKAYEDAAEEFHPYIPFFATFDSKVAKKLTLKLNEIDFYEAFMEEPVTIPDKPNSEEEIVSFVEAHKRSTLRKLKPESMYETWEDDLDGIHIVAFAEETDPDGYEFLETLKAVAQDNTDNPDLSIIWIDPDDFPLLVPYWEKTFNIDLSAPQIGVVNVTDADSVWMEMDDEEDLPSAEELEDWLEDVLEGEINTEDDDEEDD

SEQ ID NO: 302 - protein, 400 aa, Arthrospira platensis C1
MAKKTVANLSASELSGKKVLVRADFNVPLDNGSISDDTRIRAALPTIQDLTSKGAKVILSSHFGRPQGQVVESMRLTPVAARLSELLGKTVKKCDDCIGEEVAVAVGAMSDGDVLLLENVRFHAAEEKNDPEFAKQLASVADLYVNDAFGTAHRAHASTEGVTKYLSPCVAGYLIEKELQFLQGAIESPQRPLAAIIGGSKVSSKIGVIEALLDKCDKLLLGGGMIFTFYKARGLSVGNSLVEEDKLELAKSLEAKAKEKGVTMLLPTDVVLADKFAADADSQTVSVEAIPDGWMGLDIGPDSVKVFQEALGDCKTVLWNGPMGVFEFEKFAAGTRAIAQTLAELTSTGTTTIIGGGDSVAAVEQLNLGEKMSHISTGGGASLELLEGKQLPGIVALDDA

SEQ ID NO: 303 - protein, 437 aa, Arthrospira platensis C1
MYQVIEVKQVLAVILGGGAGTRLYPLTKMRAKPAVPLAGKYRLIDIPISNCINSEILKIYILTQFNSASLNRHIARTYNFSGFTDGFAEVLAAQQTSVTNPQWFQGTADAVRQYLWLMEEWDVEHFLILSGDHLYRMDYRDFVQRHIDTGADITLSVLPVDEKRASAFGLMKIDESTGRIIDFSEKPKGEALKQMAVDTSSLGLSPEEAAESPYIASMGIYVFKKDVLFKLLKDAPDQTDFGKEVIPGAAKDHNVQAYLFNDYWEDIGTIEAFFEANLALTQQPQPAFSFYDENAPIYTRSRYLPPSKMLDCQITESIIAEGCILKECRIDHSVLGLRSRVESGSLVEDTMLMGSDFYQPFAERQYGLEKGSVPIGIGNNTTIRRAIVDKNARIGRHVQIINKDHVQEAEREEDGFYIRGGITVILKNAVIPDGTII

SEQ ID NO: 304 - protein, 334 aa, Arthrospira platensis C1
MVNQPDRVVLIGVAGDSGCGKSTFLRRITDIFGEDFVTVICLDDYHSLDRKQRKETGITALDPRANNFDLMYEQIKTLKSGQSINKPIYNHETGLIDPPERIDPNHIVVIEGLHPLYDERVRGLLDFSVYLDISDEVKISWKIQRDMAERGHRYEDVLASINARRPDFEAYIDPQKQYADVVIQILPTKLIPDDKEHKVLRVRLMQRDGVEGFEPAYLFDEGSTIHWTPCGRKLTCSYPGIKMFYGPDGYYGNEVSVLEVDGKFDNLEEMIYVEGHMSNIATKYYGELTHLLREHQDYPGSNDGTGLFQVLVGLKMRSTYERLVGKGEKVAAAV

SEQ ID NO: 305 - protein, 364 aa, Bos taurus
MPHQYPALTPEQKKELCDIAHRIVAPGKGILAADESTGSIAKRLQSIGTENTEENRRFYRQLLLTADDRVNPCIGGVILFHETLYQKADDGRPFPQVIKAKGGVVGIKVDKGVVPLAGTNGETTTQGLDGLSERCAQYKKDGADFAKWRCVLKIGEHTPSSLAIMENANVLARYASICQQNGIVPIVEPEILPDGDHDLKRCQYVTEKVLAAVYKALSDHHIYLEGTLLKPNMVTPGHACTQKYSHEEIAMATVTALRRTVPPAVPGITFLSGGQSEEEASINLNAINKCPLLKPWALTFSYGRALQASALKAWGGKKENLKAAQEEYVKRALANSLACQGKYTPSGKAGAAASESLFISNHAY

SEQ ID NO: 306 - protein, 417 aa, Ovis aries
MSLSNKLTLDKLDVKGKRVVMRVDFNVPMKNNQITNNQRIKAAVPSIKYCLDSGAKSVVLMSHLGRPDGVPMPDKYSLQPVAVELKSLLGKDVLFLKDCVGPEVEKACADPAAGSVILLENLRFHVEEEGKGKDASGNKVKAEPTKIEAFRASLSKLGDVYVNDAFGTAHRAHSSMVGVNLPKKAGGFLMKKELNYFAKALESPERPFLAILGGAKVADKIQLISNMLDKVNEMIIGGGMAFTFLKVLNNMEIGTSLFDEEGSKIVKDLMSKADKNGVKITLPVDFVTADKFDENAKTGQATVASGIPVGWMGLDCGPESSKKYAEAVARAKQIVWNGPVGVFEWEAFARGTKALMDEVVKATSRGCITIIGGGDTATCCAKWNTEDKVSHVSTGGGASLELLEGKVLPGVDALSSV

SEQ ID NO: 307 - protein, 306 aa, Bacillus subtilis
  source: /note="strain 168"
MKLKTKASIKFGICVGLLCLSITGFTPFFNSTHAEAKSIEDTNMASCITNKKFVQLEKKFDARLGVYAIDIGSNKTIAYRPNERFAYASTYKVLAAAAVLKKNSIEKLNEVIHYSKDDLVTYSPITEKHLDTGMSLKEISEAAIRYSDNTAGNILLQQLGGPKGFEKSLKQIGDHVTKAKRFETDLNSAIPGDIRDTSTAKALATDLKAFTLDNTLTTDKRMILTDWMRGNATGDELIRAGAPIGWEVGDKSGAGSYGTRNDIAIVWPPNRAPIVVAILSNRFTKDANYDNALIAEAAKVVLNDLK

SEQ ID NO: 308 - protein, 455 aa, Bacillus subtilis
  source: /note="strain 168"
MKKLLTVMTMAVLTAGTLLLPAQSVTPAAHAVQISNSERELPFKAKHAYSTISQLSEAIGPRIAGTAAEKKSALLIASSMRKLKLDVKVQRFNIPDRLEGTLSSAGRDILLQAASGSAPTEEQGLTAPLYNAGLGYQKDFTADAKGKIALISRGDLTYYEKAKNAEAAGAKAVIIYNNKESLVPMTPNLSGNKVGIPVVGIKKEDGEALTQQKEATLKLKAFTNQTSQNIIGIKKPKNIKHPDIVYVTAHYDSVPFSPGANDNGSGTSVMLEMARVLKSVPSDKEIRFIAFGAEELGLLGSSHYVDHLSEKELKRSEVNFNLDMVGTSWEKASELYVNTLDGQSNYVWESSRTAAEKIGFDSLSLTQGGSSDHVPFHEAGIDSANFIWGDPETEEVEPWYHTPEDSIEHISKERLQQAGDLVTAAVYEAVKKEKKPKTIKKQMKAKASDIFEDIK

SEQ ID NO: 309 - protein, 288 aa, Bacillus subtilis
  source: /note="strain 168"
MTKKAWFLPLVCVLLISGWLAPAASASAQTTLSLNDRLASSPSGTGSLLSLAAPAAPYADTDTYYEGAEGKTGDSLKSTLHRIISGHTMLSYSEVWNALKETDEDPRNPNNVILLYTNESRSKNLNGGNVGDWNREHVWAKSHGDFGTSKGPGTDIHHLRPADVQVNSARGNMDFDNGGTEYAKAPGNYYDGDSWEPRDDVKGDVARMLFYMAVRYEGDDGYPDLELNDKTGNGSAPYHGKQSVLLEWNKQDPVDDRERKRNEIIYEKYQHNRNPFIDHPEWADEIWP

SEQ ID NO: 310 - protein, 143 aa, Bacillus halodurans
  source: /note="strain ATCC BAA-125 / DSM 18197 / FERM 7344 / JCM 9153 / C-125"
MAVIRTTSRDIDLLARLMRAEAEGEGDLGMLMAGNVMVNRVRVGCLDFADINTVERMVFQSPGGFEATQKGYFYQRAREKERRLAQRIVNGERTHPAEFSLWFFRPDGPCPEQWYGQWNSGRYKAHCFFNPTSADCPEVYGVF

SEQ ID NO: 311 - protein, 142 aa, Bacillus subtilis
  source: /note="strain 168"
MAVVRATSADVDLMARLLRAEAEGEGKQGMLLVGNVGINRLRANCSDFKGLRTIRQMIYQPHAFEAVTHGYFYQRARDSERALARRSINGERRWPAKFSLWYFRPQGDCPAQWYNQPFVARFKSHCFYQPTAETCENVYNTF

SEQ ID NO: 312 - protein, 161 aa, Bacillus pseudofirmus
  source: /note="strain OF4"
MKGKVVLLSALLILLVLVGGYAFSSQPASSSLDDQESMGKVERGEQTQEINGLKMTVNNVRTEESEQEGMHNVIIDITLENASSTVQEFSLFKMSLADPEGYAYTHSSRVETKGILGGQLHPERKNRGEIAFEVPVHEEYEMIYTDHLRTGQVTWPITLDQ

SEQ ID NO: 313 - protein, 491 aa, Bacillus subtilis [sequence omitted]

SEQ ID NO: 314 - protein, 389 aa, Bacillus subtilis
  source: /note="strain 168"
MKRLLSTLLIGIMLLTFAPSAFAKQDGKRTSELAHEAKSAVLIERDTGKVLYNKNSNERLAPASMTKIMTMLLIMEALDKGKIKMSDKVRTSEHAASMGGSQIFLEPGEEMTVKEMLKGIAIASGNDASVAMAEFISGSEEEFVKKMNKKAKELGLKNTSFKNPTGLTEEGHYSSAYDMAIMAKELLKYESITKFTGTYEDYLRENTDKKFWLVNTNRLIKFYPGVDGVKTGYTGEAKYCLTASAKKGNMRAIAVVFGASTPKERNAQVTKMLDFAFSQYETHPLYKRNQTVAKVKVKKGKQKFIELTTSEPISILTKKGEDMNDVKKEIKMKDNISAPIQKGQELGTLVLKKDGEVLAESPVAAKEDMKKAGFITFLKRTMGDWTKFK

SEQ ID NO: 315 - protein, 350 aa, Bacillus subtilis
  source: /note="strain 168"
MKSLLACLALMIAGIATALFIGFHDHTGNKKIVYDDDQEGLQDQIVFKFSHVVAENTPKGLAANKFADLVNEKSGGKIKIEVFPNGSLYSDIEEIEALQNGDVQFIAPSTSKLGMLSPEWGVLDLPYAFTDYNAVKKGLNGSIGTQLFDSLKKNQLKGLAYWTNGFKQITTNQGPVKTPDDLKGQDLRIMQSDVIEDQFKLLGATPHQESFNSTFQLLENNVVDGEENTISNIYSKKFYNVQDYLTISSHGYLGYAVMTDEHFWKAQTPETRRILTEAMKETTEWNETYAEQMNKEQLEEIKKNSAIHIYELSDKEKQEWMKRLDPVYRQYEPIFGRELIRELLELRKDS

SEQ ID NO: 316 - protein, 416 aa, Bacillus subtilis
  source: /note="strain 168"
MSDEQKKPEQIHRRDILKWGAMAGAAVAIGASGLGGLAPLVQTAAKPSKKDEKEEEQIVPFYGKHQAGITTAHQTYVYFAALDVTAKDKSDIITLFRNWTSLTQMLTSGKKMSAEQRNQYLPPQDTGESADLSPSNLTVTFGFGPGFFEKDGKDRFGLKSKKPKHLAALPAMPNDNLDEKQGGGDICIQVCADDEQVAFHALRNLLNQAVGTCEVRFVNKGFLSGGKNGETPRNLFGFKDGTGNQSTKDDTLMNSIVWIQSGEPDWMTGGTYMAFRKIKMFLEVWDRSSLKDQEDTFGRRKSSGAPFGQKKETDPVKLNQIPSNSHVSLAKSTGKQILRRAFSYTEGLDPKTGYMDAGLLFISFQKNPDNQFIPMLKALSAKDALNEYTQTIGSALYACPGGCKKGEYIAQRLLES

SEQ ID NO: 317 - protein, 532 aa, Bacillus halodurans
  source: /note="strain ATCC BAA-125 / DSM 18197 / FERM 7344 / JCM 9153 / C-125"
MRIGGIASGIDTESMIKQLMQVERIPLNKFTQRKITLEWQRDAYREVNLLLKKLDDAAANIRLRSSLNTKEASTTSKAFTAQPNAQVRNGSYQLKVNQIATQSRNISSEAISNGSTKISTTRALNEQNVYADGLNIEDYHGQTFTITTYNSSGAAVEKSFTIDTSKSLDSLFKDINSAGLGVRMSYNSTYDKVIIERTETGAFNAADGSNDYQIVFGGDTGFLNDVLKLNQANEVSGTNAEVEFIDPIMSSEPIVVSDSRTNRVTVGGITFSLTGTTEGFETLNVSSNTDAAFEKVMEFVDTYNATITELRSLLSEPRYRDYPPLTEEQRRELSEREAELWDEKAKSGLLRNDSMLNSLLAQMRADLYAPVQTNGQFSSITQIGITTSSDYRLGGFLEVDEDKLRAALEADPDSVHQLLNGTANSSLTSIPVKDRTSQQRSEIYSQTGLVGRIRSSLSSTMNDIVARAGNERRTEQQFTIGRQILDVDKRIDHFQQRLIQIENRYWAQFSRMEQMMNQANAQYASLQQFFVT

SEQ ID NO: 318 - protein, 362 aa, Bacillus subtilis
  source: /note="strain 168"
MFKKHTISLLIIFLLASAVLAKPIEAHTVSPVNPNAQQTTKTVMNWLAHLPNRTENRVLSGAFGGYSHDTFSMAEADRIRSATGQSPAIYGCDYARGWLETANIEDSIDVSCNGDLMSYWKNGGIPQISLHLANPAFQSGHFKTPITNDQYKKILDSSTVEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSAAVNKGASALYHDSWTLNKGEIWNGDSLTPIVE

SEQ ID NO: 319 - protein, 677 aa, Bacillus cellulosilyticus
  source: /note="strain ATCC 21833 / DSM 2522 / FERM P-1141 / JCM 9156 / N-4"
MDRGYKMWLRYNQITNQEVLEEYQSCLQHLHFSVNTATILAAVDELQAGLSSMINHSLHVLKTKDQRATLLLTIEESIAKEENVQVEIEDEGYVIKSIKNNRLIIFGKTDIGVLYGVFHLLRLMQTQCSLKHIYIVEQPKNSLRMLNEWDNMDGSIERGYAGVSIFFENNQFTKDWERVKDYARLLASVGINGIAFNNVNVHEQETKLITPEYLPTVAKVANIFRMYGIKTFLSINYASPISLGGMDTADPLNEEVRQWWKDKAKEIYRFIPDFGGVLVKADSEHRPGPFTYNRTHADGANMLAGAFAPFDGIVLWRCFVYDCMQDWRDRSTDRARAAYDHFKPIDGKFHKNVVLQIKNGPMDFQVREAVSPLFGAMPNTNQMLELQITQEYTGQQKHLCYLVPQWKEILDFDTYANGVNTPIKSIVDGSQYKYDHCGITAVSNVGNDDNWTGHTLAQANLYGYARLAWNPDLSAELITDEWAKLTFGVDEQVVQVVSNMLLQSWHIYEKYTSPLGVGWMVNPGHHYGPNVDGYEYSVWGTYHFADSKGIGVDRTVATGTGFTNQYFKENKELYETLNNCPDELLLFFHHVPYTHQLKSGDTVIQHIYNTHFEGVEEAIGLKKSWLSLEAKISPSIFNGVSERLQHQIEHAKEWRDVINTYFYRKSGIEDEKNRKIY

SEQ ID NO: 320 - protein, 490 aa, Bacillus halodurans
  source: /note="strain ATCC BAA-125 / DSM 18197 / FERM 7344 / JCM 9153 / C-125"
MARKKNREYWIGRHQQWLNRQDNKDEKATRKLKKEYDRIARELEKEIADYFQRYGRDNVIEFRVMMQELSEEDRELLFRNMDAFAEKYPEFAHLLPVRESIYQLNRLQGLHYSTMLKLLELGAIENRELERHLRETYGYHYEQMMRELGLGHRFLAMNEAILRDTIYSGWINEENFSDRIWNNKEKLLNHLQNRYRDALARGDNYEKLIKEVRERFGVSYYDARRLVWTEAAFILNQAHLHAYKNAGVEEYELVAIIDRKTSDICRRMHGKVFRFDELEVGVNFPPFHPHCRTTFIGVFEPRTIDPKRFESPDEVREWLGKDDLNWIKGLSADENEAIREYTGTAYRKINGYLRGKRPGSERVKEQIKHIDEAIRKFELKDGIMVYRNVGRDALPSSSERLKDLEGTIYKDDGYMSTSVLREGAFSSYDVMFEITVPGGKGRGAYINEISLFKDEEYEFLIKRGASFRITEVVEEGRMTVIRMEMIDDVE

SEQ ID NO: 321 - protein, 290 aa, Bacillus subtilis
  source: /note="strain 168"
MQFQIGDMVARKSYQMDVLFRIIGIEQTSKGNSIAILHGDEVRLIADSDFSDLVAVKKDEQMMRKKKDESRMNESLELLRQDYKLLREKQEYYATSQYQHQEHYFHMPGKVLHLDGDEAYLKKCLNVYKKIGVPVYGIHCHEKKMSASIEVLLDKYRPDILVITGHDAYSKQKGGIDDLNAYRHSKHFVETVQTARKKIPHLDQLVIFAGACQSHFESLIRAGANFASSPSRVNIHALDPVYIVAKISFTPFMERINVWEVLRNTLTREKGLGGIETRGVLRIGMPYKSN

SEQ ID NO: 322 - protein, 620 aa, Bacillus subtilis
  source: /note="strain 168"
MRRSCLMIRRRKRMFTAVTLLVLLVMGTSVCPVKAEGAARQMEALNRGLVAVKTDGGIFVSWRFLGTENASVLFNVYRDGQKLNAAPVKTTNYVDKNGSAGSTYTVRAVVNGTEQPASEKASVWAQPYHSVPLDKPAGGTTPKGESYTYSANDASVGDVDGDGQYELILKWDPSNSKDNSQDGYTGDVLIDAYKLDGTKLWRINLGKNIRAGAHYTQFMVYDLDGDGKAEVAMKTADGTKDGTGKVIGNANADYRNEQGRVLSGPEYLTVFQGSTGKELVTANFEPARGNVSDWGDSYGNRVDRFLAGIAYLDGQRPSLIMTRGYYAKTMLVAYNFRDGKLSKLWTLDSSKSGNEAFAGQGNHNLSIADVDGDGKDEIIFGSMAVDHDGKGMYSTGLGHGDALHTGDLDPGRPGLEVFQVHEDKNAKYGLSFRDAATGKILWGVYAGKDVGRGMAADIDPRYPGQEVWANGSLYSAKGVKIGSGVPSSTNFGIWWDGDLLREQLDSNRIDKWDYQNGVSKNMLTASGAAANNGTKATPTLQADLLGDWREEVVWRTEDSSALRIYTTTIPTEHRLYTLMHDPVYRLGIAWQNIAYNQPPHTSFFLGDGMAEQPKPNMYTP

SEQ ID NO: 323 - protein, 363 aa, Bacillus subtilis
  source: /note="strain 168"
MITLGFMSLSRQHEADYSAELAKRAPEFGIRFIRFTPFDISPDTLRVKASVYHSASSTWNETEMAIPDYIYDRCFYGKDSHSQKAKPIVEWLKKYPKTEFIGRGLPDKWTVLHDLQQHSVINPYIPETIKVSRYEQIHSFLSKEKACILKPAFGAGGRGVILLKLGKKNITATYHIGKDKQTKTFSNQTSFKTWCKKVLQHQYLLQPYLNIQDKEQYPCDIRLFMEKNEAGEWNTVGKAVRRGYKHGLLANLSGGSDALTFDSWFEDIPKKQQVVLLDDVFSITQSVPYYLDERYGPLFELGLDICLAKDGRIWILDINSKPGRKSILRVSPEQKEQLYTCPLKRCQYLFSEQSQKGVLPRES

SEQ ID NO: 324 - protein, 339 aa, Bacillus subtilis
  source: /note="strain 168"
MVKGTIKEKYGIHIRQLSMYQHTYQCFQTPNSYFLIVPVSQFSETELAELYYMSQYLQEQSDPYVSVFIFTKEGELTFEHEGKTYALLKAAPPYSNRAFSIGAELAEFHRKGRGYPYEVKAAGRIGQWKDLWGKRIDQLEAFWQRKVQTPPHEPFDKKMIESFPYYLGLSENAIQYLVDTELDDKPQAADSGTICHQRMERHTWSPESLIRIPADWVFDHASRDLAEYMRHTFLHHRQDFNQQGFLFLQEYEQVTPLSSFSKRLLYSRLLFPLHYFEIVESYYMSSESEKHYFEEQLDFILNDCGRYEQFLNTAQEFMNMRAQKLFVPRVSWLGKGSSR

SEQ ID NO: 325 - protein, 105 aa, Saccharomyces cerevisiae
  source: /note="strain ATCC 204508 / S288c"
MLMPKQERNKIHQYLFQEGVVVAKKDFNQAKHEEIDTKNLYVIKALQSLTSKGYVKTQFSWQYYYYTLTEEGVEYLREYLNLPEHIVPGTYIQERNPSQRPQRRY

SEQ ID NO: 326 - protein, 111 aa, Arthrospira platensis C1
MQTLPKERRYETLSYLPPLTDAQTQKQLQYILEQGFIAGVEFSESSAPEQHYWTLWKLPLFNATSVREVMAEIDECRREYPKCFIRVMGFDNVKQCQVLSFIVHRPTGSLY

SEQ ID NO: 327 - protein, 113 aa, Bacillus mycoides Rock1-4
MQVYRGTDIKPFKDLIELGKDGRSDFESLINKTIKDDGFVSTAILKASSFDYMEVSWEINVPKGASAAYVGKISQFSNEAELLLNASHEMIIKSVNVERNGKLHVTLDLILKK

SEQ ID NO: 328 - protein, 118 aa, Arthrospira platensis NIES-39
MTRVKRGNVARKRRKKILKLAKGFRGSQSKNFRIANQRVMQALRNAYRDRKKRKRDFRRLWITRINAAARVHGISYSQLMGNLKKADIEINRKMLAEMAVLDPDTFEKVVAKAAQAQS

SEQ ID NO: 329 - protein, 121 aa, Zea mays
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDPQ

SEQ ID NO: 330 - protein, 146 aa, Saccharomyces cerevisiae
  source: /note="strain ATCC 204508 / S288c"
MSLVVQEQGSFQHILRLLNTNVDGNIKIVYALTTIKGVGRRYSNLVCKKADVDLHKRAGELTQEELERIVQIMQNPTHYKIPAWFLNRQNDITDGKDYHTLANNVESKLRDDLERLKKIRAHRGIRHFWGLRVRGQHTKTTGRRRA

SEQ ID NO: 331 - protein, 157 aa, Bacillus amyloliquefaciens
MMKMEGIALKKRLSWISVCLLVLVSAAGMLFSTAAKTETSSHKAHTEAQVINTFDGVADYLQTYHKLPDNYITKSEAQALGWVASKGNLADVAPGKSIGGDIFSNREGKLPGKSGRTWREADINYTSGFRNSDRILYSSDWLIYKTTDHYQTFTKIR

SEQ ID NO: 332 - protein, 176 aa, Arthrospira platensis NIES-39
MTSTQTKTRLYSSRIDLPEDTRSQVITILNQSLATTLDLKTQVKQAHWNVKGLNFYSLHLLFDELAGELEGYVDMIAERVTALGGYAMGTARRAASESILPEYPLDIDNGTDHIVALADRFGVYAKSLREAIDKTDNLGDADTADLYTEISRTADMRLWFLEAHLQGDSNQPLRSH

SEQ ID NO: 333 - protein, 179 aa, Bacillus mycoides Rock3-17
MLKKKTVQFFENLNLNGGSKKPLSNLVEAHEWGSKHFDSWIESLTESERSAIRQYTGDDYRKINNYLRGIADSLDGVESSVIDNIKSGLNKASVPYDIQVYRGTDLNSFENLMSRFFYFKKKSALILLSLLQWTKRFQCCHIFYIKSIFSKKVYMLSAQVVKYVLAIPHWNHTYSLILL

SEQ ID NO: 334 - protein, 197 aa, Glycine max
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIKQRHIRVGRQVVNIPSFLVRVDSQKHIDFSLTSPLGGGRPGRVKRRNQRAAAKKAAGGDGDEEDED

SEQ ID NO: 335 - protein, 202 aa, Arthrospira platensis NIES-39
MSRYRGPRLRVARRLGDLPGLTRKTARRAYPPGQHGQARRKRSEYAVRLEEKQKLRFNYGLSERQLLRYVRKARRASGSTGQVLLQYLEMRLDNTVFRLGMAPTIPAARQLVNHGHITVNGKVVDIASYQCRPGEIIGVRNRDKSREMVKANLQYPGLANVPSHLELDKNNLTATVNGVIEREWVALSINELLVVEYYSRMA

SEQ ID NO: 336 - protein, 207 aa, Zea mays
MVSLKLQKRLAASVLKCGKGKVWLDPNEVSEISMANSRQNIRKLVKDGFIIRKPQKVHSRSRARRAHEAKQKGRHSGYGKRRGTREARLPTKILWMRRMRVLRRLLRKYREAKKIDKHMYHDMYMKVKGNMFKNKRVLMESIHKSKAEKAREKTLSDQFEAKRAKSKASRERKIARREERLAQGPREPTAPVAAPAPSTGVPKKAKK

SEQ ID NO: 337 - protein, 221 aa, Glycine max
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDLAAQQQHEAELLAAASQPLPDDDDDQFE

SEQ ID NO: 338 - protein, 222 aa, Saccharomyces cerevisiae
  source: /note="strain ATCC 204508 / S288c"
MSSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 339 - protein, 230 aa, Lactobacillus acidophilus
  source: /note="strain 30SC"
MSKLVLIRHGQSEWNLSNQFTGWVDVNLSEKGVEEAKKAGRLIKEHGLEFDQAYTSLLTRAIKTLHYALEESGQLWIPETKTWRLNERHYGALQGLNKKKTAEKYGDEQVHIWRRSYDVLPPAIDDDNKYSQAHDRRYANLDPHIVPKAENLHVCLDRVMPFWEDHIAPDLLDGKNVIIAAHGNSLRALTKYIENISDDDIMNLEMKTGEPVVYTFDENLDVVNKEKLDD

SEQ ID NO: 340 - protein, 242 aa, Arthrospira platensis C1
MGQKIHPIGFRLGVTQEHKSRWFADASQYPQLLQEDHTIRKYIQKNLSNAGISDVRIERKADQIDLEVLTARPGVVVGRGGAGIDSLRQGLQKELGSNRQIRINVVEVSRVDADATLIAENIAAQLEKRVSFRRVVRQAITRAQKAGIEGIKIQVSGRLNGAEIARTEWTREGRVPLHTLRADIDYAYCTALTIYGILGVKVWVFKGEIIPGQEETPAPNTRAPKSRRTPIRQKYDDRSSDT

SEQ ID NO: 341 - protein, 267 aa, Saccharomyces cerevisiae
  source: /note="strain ATCC 204508 / S288c"
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 342 - protein, 301 aa, Bacillus circulans
MHMSNARPSKSRTKFLLAFLCFTLMASLFGATALFGPSKAAAASPDDNFSPETLQFLRNNTGLDGEQWNNIMKLINKPEQDDLNWIKYYGYCEDIEDERGYTIGLFGATTGGSRDTHPDGPDLFKAYDAAKGASNPSADGALKRLGINGKMKGSILEIKDSEKVFCGKIKKLQNDAAWRKAMWETFYNVYIRYSVEQARQRGFTSAVTIGSFVDTALNQGATGGSDTLQGLLARSGSSSNEKTFMKNFHAKRTLVVDTNKYNKPPNGKNRVKQWDTLVDMGKMNLKNVDSEIAQVTDWEMK

SEQ ID NO: 343 - protein, 312 aa, Glycine max
MATLIAPSHHSRVEDAEALRNAFKGWGADDKAIIAILGHRNVHQRQEIRKAYEEIYQEDLIKRLESEISGDFERAMYRWMLQPADRDAVLVNVAIKNGTKDYHVIAEIACVLSAEELLAVRRAYHRRYKCSLEEDVAANTTGNLRQLLVGLVTSYRYEGDEINVKFSQTEANVLHESVKEKKGNSEEVIRILTTRSKTQLVATFNRYRDEHGISISKKLLDQTSDDFHKVLHTAIRCINDHKKYYEKVLRNAVKKFGTDEDGLSRVIVTRAEKDLKDIKELYYKRNSVHLEDEVSKETSGDYKKFLLTLLGK

SEQ ID NO: 344 - protein, 312 aa, Arthrospira platensis NIES-39
MRPPSSPHRKSGPNRGKVKPSSSRSHSPREDKPAIHPRRRDRPVASAETEPPEEDLIYGRHTVLAALENGRSLNRVWVISQLRSDTRFQPLLQEAKAKGAIVDGASYQRLDQITRGASHQGIVAQVTPYKYWDLTTLITQAKSANSQPVLVAVDGITDPHNLGAIIRTAEAIGAQGLILPQRRAVGINATVMKVAAGALETFPVARVINLNRTFTELKSAGFWIYGTVAGEYQPLYKADLSGAIVLVVGSEGEGLSHAIAENCDVLLSIPLSGVTPSLNVSVATGMALYEIFRQRQSQSQSQNQNQNQNQHQ

SEQ ID NO: 345 - protein, 315 aa, Arthrospira platensis NIES-39
MNTLDLQNQRILVTGGAGFLGKQVIDQLLKAGAKSENISVPRSHNCDLRNLEACQQAAKGQDIIIHLAAHVGGIGLNQVKPAELFYDNLMMGTQLIHSAYQAGVKKFVCVGTICAYPKFTPVPFQEDDLWNGYPEETNAPYGIAKKALLVQLQAYRQQYGFNGIYLLPVNLYGPEDNFNPKSSHVIPALVRKVYEAQQRGDKQLPVWGDGSPSREFLYSTDAARGIVMATQHYDEPDPVNLGTNSEVTIRDLVELICELMEFQGEIVWETDKPNGQPRRCLDTNRAKERFGFVAEVEFRQGLKNTIDWYRQNPDL

SEQ ID NO: 346 - protein, 329 aa, Arthrospira platensis NIES-39
MYYDADANLDLLAGKTIAIVGYGSQGHAHALNLKDSGMNVIVGLYPGSKSATKAKDAGLTVYPVDEAAKIADLIMILLPDEVQKTVYKNEIEPNLSEGKTLAFAHGFNIHFGQVVPPENVDVIMVAPKGPGHLVRRTYQEGQGVPCLFAVYQDASGQARDRAMAYAKGIGGTRGGILETTFREETETDLFGEQAVLCGGLSALIKAGFETLVEAGYQPELAYFECLHEVKLIVDLVVEGGLAQMRDSISNTAEYGDYTRGPRVITDATRAEMRKILKEIQTGQFAREFVLENQSGKAGFTAMRRQEAEHPIEEVGHDLRAMFSWLKKKA

SEQ ID NO: 347 - protein, 331 aa, Bacillus amyloliquefaciens
  source: /note="subsp. plantarum YAU B9601-Y2"
MSIKKMSALFFILLLTAFTAACSSETSGGQESSTAKVKIKDTAWAASDDTEHSAALKVTVTVKNTGKDPLTVKSSDFSLYQDDAKTAKADKEDLLQSGTLHAGKTVTGNLYFTADEGKSYELVYQPQAKDAKPLSYKLKVKGTASNAKPDPADALSAYIDVMLYGKHNKDFTRLTGVNEKMTAAAYQESAKASFIASAGISQEQADSKAITAIIDAMSSALRDNTELKVHTKSMSGKKAVLEAKVTPLDMSPLAGQLQDRVQDYAGKHPDADENEIVSHLLSVYPEEFMRLKPASSSVTREIEMKKNARGQWYLDTDADLEGLTEAFLKTS

SEQ ID NO: 348 - protein, 332 aa, Salmo salar
MTTKEKLITHVLVGEPVGSRSKVTVVGVGMVGMASAVSVLLKDLCDELCLIDVMEEKLKGEVMDLQHGSLFCKTHKIVGDKDYSTTAHSKVVVVTAGARQQEGESRLNLVQRNVNIFKFIIPQIVKYSPNAILLVVSNPVDILTYVAWKLSGFPRHRVIGSGTNLDSGRFRHLMGEKLHLHPSSCHGWIIGEHGDSSVPVWSGVNVAGVSLKGLNPHMGTDADKEDWKHLHKMVVDGAYEVIKLKGYTSWAIGMSVADLVESILKNLHKVHPVSTLVKGMHGVKDEVFLSVPCVLGNSGLTDVIHMTLKPEEEKQLINSAETLWGVQKELTL

SEQ ID NO: 349 - protein, 342 aa, Arthrospira platensis NIES-39
MSNNKPALITGITGQDGSYLSELLLEKGYEVHGIIRRSSSFNTDRIEHIYKDPHHPNARLFLHYGDLTDGTTLRRILEEVKPVEIYNLGAQSHVRVSFDCPEYTVDTVGLGVLRLLEAIRDYQHRTGIQVRFYQAGSSEMFGKVQEIPQKETTHFYPRSPYACAKVYGHWQTVNYRESYGLFACNGILFNHESPRRGPTFVTRKITRAVARIVKGMQKELYLGNLDAKRDWGYAKDYVRGMWMMLQHDQPDDYVLATNETHSIREFLDVAFNYVNLDWHDYVKFDERYLRPAEVELLIGDSSKAQNVLGWKPLVSFEELVKLMVDSDLTLLEEPHQEGDHFD

SEQ ID NO: 350 - protein, 357 aa, Gallus gallus
MRLVLLFVLLLPVCLATRFHQKGLFDFMIEDEGSADMAPTDDPVISGFGPVCPFRCQCHLRVVQCSDLGLERVPKDLPPDTTLLDLQNNKITEIKEGDFKNLKNLHALILVNNKISKISPAAFAPLKKLERLYLSKNNLKELPENMPKSLQEIRAHENEISKLRKAVFNGLNQVIVLELGTNPLKSSGIENGAFQGMKRLSYIRIADTNITSIPKGLPPSLTELHLDGNKISKIDAEGLSGLTNLAKLGLSFNSISSVENGSLNNVPHLRELHLNNNELVRVPSGLGEHKYIQVVYLHNNKIASIGINDFCPLGYNTKKATYSGVSLFSNPVQYWEIQPSAFRCIHERSAVQIGNYK

SEQ ID NO: 351 - protein, 401 aa, Glycine max
MATKRSVGTLKEGDLKGKRVFVRVDLNVPLDDNLNITDDTRVRAAVPTIKYLTGYGAKVILSSHLGRPKGVTPKYSLKPLVPRLSQLLGIEVTMANDSIGEEVEKLVTQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDTTQTIIWNGPMGVFEFDKFATGTEAIAKKLAELSGKGVTTIIGGGDSVAAVEKVGLADKMSHISTGGGASLELLEGKQLPGVLALDDA

SEQ ID NO: 352 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 353 - protein, 409 aa, Paenibacillus thiaminolyticus
MSKVKGFIYKPLMVMLALLLVVVSPAGAGAAHSDASSDITLKVAIYPYVPDPARFQAAVLDQWQRQEPGVKLEFTDWDSYSADPPDDLDVFVLDSIFLSHFVDAGYLLPFGSQDIDQAEDVLPFALQGAKRNGEVYGLPQILCTNLLFYRKGDLKIGQVDNIYELYKKIGTSHSEQIPPPQNKGLLINMAGGTTKASMYLEALIDVTGQYTEYDLLPPLDPLNDKVIRGLRLLINMAGEKPSQYVPEDGDAYVRASWFAQGSGRAFIGYSESMMRMGDYAEQVRFKPISSSAGQDIPLFYSDVVSVNSKTAHPELAKKLANVMASADTVEQALRPQADGQYPQYLLPARHQVYEALMQDYPIYSELAQIVNKPSNRVFRLGPEVRTWLKDAKQVLPEALGLTDVSSLAS

SEQ ID NO: 354 - protein, 417 aa, Ovis aries; identical to SEQ ID NO: 306

SEQ ID NO: 355 - protein, 468 aa, Bos taurus
MASRLTPLTLLLLLLLAGDRVTSDMIVGPGNLQEGESEGDSQKGGILDGESIQGNEDSPTLPITNLTVVPATVTKPFSQPATEPVQSTIQPTAEPFCLAPVTSCSDSEIRSAEAVLGEALTDFSLRLYQDFSVLKKRETNFIFSPFSIASLLTQILLGAGGETRVSLEHLLSYPQNFSCVHHALRAFMSEGFTSFSQIFHSSDLTIKDTFAEASQRLYGSSPRPLGNDSTASLELINDWVAKKTNLRIRRLLDSLPEDTRLILLNAVALSAKWKIAFDKGRTSTKPFHLKSSAIKVPMMNSKKYPVASFTDRTLNRPGGRLQLSHNLSFVILVPQTVKHHLQDLEQALSTAVFKAVIKKLEMTKFHPTHLTMPRIKVQSSQDMLDYFDFIYDVNLCGLTEDPDVQVSGIRHQATLELTESGVDATAASVVSVARNLLLFEVQQPFLFLLWDQQHKFPVFMGRVYDPKG

SEQ ID NO: 356 - protein, 469 aa, Glycine max
MATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQGKEYVFVANSDNLGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDL

SEQ ID NO: 357 - protein, 473 aa, Arthrospira platensis NIES-39
MKPLNRRTKIVATIGPASNSREVLYQMIQAGMNVVRLNFSHGSHEQHTKTVALLKEISQELKTSITLLQDLQGPKIRVGQLPDGGIQLMAGEYITLVPIDQYESKPNTIAIDYLHLGEEAEIGAQVLLDDGLLELKVEEISGNQVKCKIIEGGTLKSRKGVNLPSLTLRLPSLTEKDQQDLEFGISLGVDWVSLSFVRNAEDVRVLKDFLASKNASQISVMAKIEKPQAIANLEEIISECNGLMVARGDLGVEMSPERVPLLQKQIIRLCNQKGIPVITATQMLDSMINNPRPTRAEASDVANAIIDGTDAVMLSGESAVGKYPIRAVEMLAKIAEDVEPEINFINYPPAFNDETHAISEAINTIDKIIDLHCIIAYTCSGYTGQLAAAERPKAPVVALTPNPKVYHRLNLVWGVKPLLLEQEVESFEELINQAQTYLLVRQMASPGDKILIIGGIPSGKAKGTNFIKIHTIG

SEQ ID NO: 358 - protein, 476 aa, Arthrospira platensis NIES-39
MSYSQTQTKSKAGYQAGVKDYKLTYYTPDYTPKDTDILAAFRVSPQPGVPPEEAGAAVAAESSTGTWTTVWTDLLTDLDRYKGRCYHIEPVPGEDNQFFCFVAYPLDLFEEGSVTNMLTSIVGNVFGFKALRGLRLEDMRIPIAYLKTFQGPPHGITVERDKLNKYGRPLLGCTIKPKLGLSAKNYGRAVYECLRGGLDFTKDDENINSQPFMRWRDRFLFVQEAIEKAQAETNEIKGHYLNVTAPTCEEMMKRAEFAKEIGTPIIMHDFFTAGFTANTTLARWCRDNGLLLHIHRAMHAVVDRQRNHGIHFRVLAKCLRMSGGDHLHSGTVVGKLEGEKGITMGFVDLMREDHIEEDRSRGIFFTQDWASMPGVMPVASGGIHVWHMPALVEIFGDDSCLQFGGGTLGHPWGNAPGATANRVALEACIQARNEGRNLFREGGDVIREACKWSPELAVACELWKEIKFEFEAMDTL

SEQ ID NO: 359 - protein, 484 aa, Arthrospira platensis NIES-39
MLELGSQRNRAKNNHIGDLMSQSFESLGISEQRARHLETLGFTEPTPVQIQAIPEMLSGRDVVGMAQTGTGKTAAFSLPILEQIDVHAAGIQALVLTPTRELAMQVKEAIRTFSDDNALYVLTVYGGQSIDRQIQRLRRGVQVVVGTPGRILDLLNRGELKLDLLRWLVLDEADEMLSMGFIQDVEKILESADSEHRQTAFFSATMDASISKLVRRHLKSPVTVKVETPKATPKRIEQSVYMVPRGWSKARALEPILELEDPESAIIFVRTKQSAADLTNQLQAAGHSVDEYHGNLNQSQRERLLMRLRRRQVRWIVATDIAARGLDVDHLTHVINYDLPDQVDSYVHRIGRTGRAGREGKAITLIQPIDRRKLRNIERHLRQTLSIQSIPKRAEIEARYIDRLKDRVRDALAGERMASFLPIVSQLSEEYDPHAIAAAALQLAYDQTRPASIGRDDYEDDDDAVSNKPKLIKRRRPASVSNNS

SEQ ID NO: 360 - protein, 496 aa, Glycine max
MATSDSNMLLNYVPVYVMLPLGVVNVDNVFEDPDGLKEQLLQLRAAGVDGVMVDVWWGIIELKGPKQYDWRAYRSLFQLVQECGLTLQAIMSFHQCGGNVGDIVNIPIPQWVLDIGESNHDIFYTNRSGTRNKEYLTVGVDNEPIFHGRTAIEIYSDYMKSFRENMSDFLESGLIIDIEVGLGPAGELRYPSYPQSQGWEFPGIGEFQCYDKYLKADFKAAVARAGHPEWELPDDAGKYNDVPESTGFFKSNGTYVTEKGKFFLTWYSNKLLNHGDQILDEANKAFLGCKVKLAIKVSGIHWWYKVENHAAELTAGYYNLNDRDGYRPIARMLSRHHAILNFTCLEMRDSEQPSDAKSGPQELVQQVLSGGWREDIRVAGENALPRYDATAYNQIILNARPQGVNNNGPPKLSMFGVTYLRLSDDLLQKSNFNIFKKFVLKMHADQDYCANPQKYNHAITPLKPSAPKIPIEVLLEATKPTLPFPWLPETDMKVDG

SEQ ID NO: 361 - protein, 501 aa, Ovis aries
MPSANASRRSQEKPREIMDAAEDYAKERYGVSSMIQSQEKPDRVLVRISDLTVQKAGEVVWVRARVHASRAKGKQCFLVLRQQQFNVQALVAVGDHASKQMVKFAANINKESIVDVEGVVRKVNQKIGSCTQQDVELRVQKVYVISSAEPRLPLQLDDAVRPEVEGEEEGRATVNQDTRLDNRVIDLRTSTSQAIFRLQSGICHLFRETLTNKGFVEIQTPKIISAASEGGANVFTVSYFKNNAYLAQSPQLYKQMCICADFEKVFCIGPVFRAEDSNTHRHLTEFVGLDIEMAFNYHYHEVVEEIADTLVQIFKGLQKRFQTEIQMVNKQFPCEPFKFLEPTLRLEYCEALAMLREAGIEMGDEEDLSTPNEKLLGRLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 362 - protein, 505 aa, Saccharomyces cerevisiae
  source: /note="strain ATCC 204508 / S288c"
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 363 - protein, 616 aa, Aspergillus niger
ATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 364 - protein, 73 aa, Gallus gallus
EKPKEVKITSMARREEIHEEKMEIYEKPKKVYEEWEEDYGEDHDYYFKEEGYDEGEEEWEETYDKREVAYEEE

SEQ ID NO: 365 - protein, 81 aa, Bos taurus
YRFNWDHCGKMEPACKRHFIQDTCLYECSPNLGPWIREVNQRWRKERVLGVPLCKEDCQSWWEDCRTSYTCKSNWHKGWNW

SEQ ID NO: 366 - protein, 69 aa, Saccharomyces cerevisiae
  source: /note="strain ATCC 204508 / S288c"
WFKESRSSKTNPKRDWFFWRPPKGYDAEGKPIPPNNWKSFFGGSAWTFDETTNEFYLRLFASRQVDLNW

SEQ ID NO: 367 - protein, 70 aa, Saccharomyces cerevisiae
  source: /note="strain ATCC 204508 / S288c"
YYYQFPGQAYYYSPEYGYDDEDGEEEDQDEDMVGDSGTTRQEDGGEDSNSRRYPSYYHCNTARNNRTNQQ

SEQ ID NO: 368 - protein, 76 aa, Sus scrofa
LEEMRKTTIDLLEIESMELSRLYFLLETIPNSVSRELEECVRDARRLNLFEINQLHLKITRINNEIEFWKKKILDL

SEQ ID NO: 369 - protein, 69 aa, Bos taurus
QQTQLIHDLNMQKARLQTQNGELSHQVEEKAALISQLTKGKQVLTQQLEDLKRQLEEETKAKSALAHAL

SEQ ID NO: 370 - protein, 73 aa, Oreochromis niloticus
LNEMEIQLSQANRQAAEAQKQVKTLQAFLKDTQLQLDDTQHGNDDLKENIALLERRNNLIQAELEEVRAALEQ

SEQ ID NO: 371 - protein, 85 aa, Zea mays
MQEHTDLQHEKHELEQQLLEVRKELDGAYHTIVNQEEQASLREIKWDTFRIYSEDRLEAEQQRAEELELQVAALKQQLQEAEEEQ

SEQ ID NO: 372 - protein, 70 aa, Arthrospira platensis NIES-39
TVEEIKTFLYEQLRNAYDIKEAQVNQIRPGLMRDAERFFILQQIDSLWREHLQQMDALRESVGLRGYGQK

SEQ ID NO: 373 - protein, 77 aa, Arthrospira platensis NIES-39
QASLLHTGFDEIEPWNQIMEELSVRSRSCYRALIYEQPDLVDFFEQVTPIQEISQLQISSRPARRQSDKKKDISGLR

SEQ ID NO: 374 - protein, 84 aa, Saccharomyces cerevisiae
  source: /note="strain ATCC 204508 / S288c"
QTREYARHFLQTSNRLLMADVVHDEELKYNGRVVSVRFTPVGIDAFDLQSQLKDGSVMQWRQLIRERWQGKKLIVCRDQFDRIR

SEQ ID NO: 375 - protein, 69 aa, Bos taurus
ITDLRGMLRRLKRMRRVEKKSAAFARILDPAYQVDKGGRVRFVVELADPKLEVKWYKNGQEIRPSTKYI

SEQ ID NO: 376 - protein, 114 aa, Glycine max
RGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIIL

SEQ ID NO: 377 - protein, 230 aa, Arthrospira platensis C1
QEQLQQELEQTKSELRDVWEELERVQSQFEQVSGELQQAQTQIPQQETASDTDCQQELEAVRSQLNQVLAELEQAKTQIHQQEAEKAQLESLQQELQTTQDSLNTTRTQLDQVQTQIQQGETDKAELESVQQQLQETQAKLTSTTEELEKAKTQIQEAQGSKAQLESVQQHLQETQAKLTSTTEELEKVNCQFDEVLGELEETHFKLHQIQQETASDTESKQELERVNSQ

SEQ ID NO: 378 - protein, 181 aa, Oreochromis niloticus
VTTAIQQESEKAAAVEQLEESKSKIEGLLDWISNVGNKNKSSLDQTDHVSQENGNLPEEPSAKGLITEDDDANGNALQTTDKDFGRETNGENNESPNLDKQYQRLKAHHQEILSQQQDLIMATQSAQAMLDKQANVLSPQEKEALQKNIQELKERYETSLTQAEQQMKQVQCVQEELKKFQ

SEQ ID NO: 379 - protein, 127 aa, Gallus gallus
QEQQVALLDLQNTLFSTQLEVQKLKRAQRQKEHQLVEAKRAAQLLETTVHEEEQQKEATWKHNQELRAVVQQLQVELQDKAQQIQAMEWEKCRELQAQEQRVQCLSQHLARKEQLLQESRELLQCQQ

SEQ ID NO: 380 - protein, 74 aa, Gallus gallus
LERAVDEKFCALEEKEQELQQLRLSIKERGGDLERLRNVLSSNEATIHSLESLLKAKTLELEQMSATCENLRWL

SEQ ID NO: 381 - protein, 113 aa, Bos taurus
LLLKSLMLAKAKECWEQEHEEREAEKKRYLAERIPALQTRGLSLSALQDLCRDLHAKVEVVDEERYDIEAKCLHNTREIKDLKLKVLDLRGKFKRPPLRRVRVSADAMLRALL

SEQ ID NO: 382 - protein, 71 aa, Bos taurus
REIKDLKLKVLDLRGKFKRPPLRRVRVSADAMLRALLGSKHKVSMDLRANLKSVKKEDTEKERPVEVGDWR

SEQ ID NO: 383 - protein, 70 aa, Glycine max
RPYEKERLDAELKLVGEYGLRCKRELWRVQYALSRIRNNARNLLTLDEKNPRRIFEGEALLRRMFRYGLL

SEQ ID NO: 384 - protein, 99 aa, Glycine max
RELWRVQYALSRIRNNARNLLTLDEKNPRRIFEGEALLRRMFRYGLLDETQNKLDYVLALTVENFLERRLQTLVFKSGMAKSIHHARVLIKQRHIRVGR

SEQ ID NO: 385 - protein, 67 aa, Saccharomyces cerevisiae
  source: /note="strain ATCC 204508 / S288c"
MDSKTPVTLAKVIKVLGRTGSRGGVTQVRVEFLEDTSRTIVRNVKGPVRENDILVLMESEREARRLR

SEQ ID NO: 386 - protein, 127 aa, Arthrospira platensis NIES-39
MTLQSRSSSPQRGVPMSTSGSSLADILERVLDKGIVIAGDISVSVGSTELLSIRIRLLIASVDKAKEIGINWWESDPYLSSQAQQLSQSNQQLLEEVKRLQEEVRSLKALTSQSSQPVTPPNSENDD

SEQ ID NO: 387 - protein, 170 aa, Zea mays
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARTMRPRSMAKEMSGCVKEILGTCVSVGCTVDGKDPKDLQQEIDDGEDWSLGGLSVY

SEQ ID NO: 388 - protein, 169 aa, Zea mays
MPPKLDPSQVVEVFVRVTGGEVGAASSLAPKIGPLGLSPKKIGEDIAKETAKDWKGLRVTVKLTVQNRQAKVSVVPSAAALVIKALKEPERDRKKVKNIKHSGNISLDDVIEIARTMRPRSMAKEMSGCVKEILGTCVSVGCTVDGKDPKDLQQEIDDGEDWSLGGLSV

SEQ ID NO: 389 - protein, 179 aa, Arthrospira platensis NIES-39
MSRIGKRPIPIPAKVTLTLDGQKVTVKGPKGELSRVLPNEVILSLEGDTLIVKRRDESLVARQRHGLCRTLVANMVDGVSQGFERRLEIQGVGYRAQVQGKNLILNVGYSKPVEMVPPEGCSVAVENNTNVIVSGINKELVGNMAAKIRAVRPPEPYKGKGIRYAGEQVRRKAGKAGKK

SEQ ID NO: 390 - protein, 270 aa, Bacillus subtilis
  source: /note="strain 168"
KSIEDTNMASCITNKKFVQLEKKFDARLGVYAIDIGSNKTIAYRPNERFAYASTYKVLAAAAVLKKNSIEKLNEVIHYSKDDLVTYSPITEKHLDTGMSLKEISEAAIRYSDNTAGNILLQQLGGPKGFEKSLKQIGDHVTKAKRFETDLNSAIPGDIRDTSTAKALATDLKAFTLDNTLTTDKRMILTDWMRGNATGDELIRAGAPIGWEVGDKSGAGSYGTRNDIAIVWPPNRAPIVVAILSNRFTKDANYDNALIAEAAKVVLNDLK

SEQ ID NO: 391 - protein, 462 aa, Bacillus subtilis
  source: /note="strain 168"
AEKQDALSGQIDKILADHPALEGAMAGITVRSAETGAVLYEHSGDTRMRPASSLKLLTAAAALSVLGENYSFTTEVRTDGTLKGKKLNGNLYLKGKGDPTLLPSDFDKMAEILKHSGVKVIKGNLIGDDTWHDDMRLSPDMPWSDEYTYYGAPISALTASPNEDYDAGTVIVEVTPNQKEGEEPAVSVSPKTDYITIKNDAKTTAAGSEKDLTIEREHGTNTITIEGSVPVDANKTKEWISVWEPAGYALDLFKQSLKKQGITVKGDIKTGEAPSSSDVLLSHRSMPLSKLFVPFMKLSNNGHAEVLVKEMGKVKKGEGSWEKGLEVLNSTLPEFGVDSKSLVLRDGSGISHIDAVSSDQLSQLLYDIQDQSWFSAYLNSLPVAGNPDRMVGGTLRNRMKGTPAQGKVRAKTGSLSTVSSLSGYAETKSGKKLVFSILLNGLIDEEDGKDIEDQIAVILANQ

SEQ ID NO: 392 - protein, 332 aa, Bacillus subtilis
  source: /note="strain 168"
LFIGFHDHTGNKKIVYDDDQEGLQDQIVFKFSHVVAENTPKGLAANKFADLVNEKSGGKIKIEVFPNGSLYSDIEEIEALQNGDVQFIAPSTSKLGMLSPEWGVLDLPYAFTDYNAVKKGLNGSIGTQLFDSLKKNQLKGLAYWTNGFKQITTNQGPVKTPDDLKGQDLRIMQSDVIEDQFKLLGATPHQESFNSTFQLLENNVVDGEENTISNIYSKKFYNVQDYLTISSHGYLGYAVMTDEHFWKAQTPETRRILTEAMKETTEWNETYAEQMNKEQLEEIKKNSAIHIYELSDKEKQEWMKRLDPVYRQYEPIFGRELIRELLELRKDS

SEQ ID NO: 393 - protein, 388 aa, Bacillus subtilis
  source: /note="strain 168"
IGASGLGGLAPLVQTAAKPSKKDEKEEEQIVPFYGKHQAGITTAHQTYVYFAALDVTAKDKSDIITLFRNWTSLTQMLTSGKKMSAEQRNQYLPPQDTGESADLSPSNLTVTFGFGPGFFEKDGKDRFGLKSKKPKHLAALPAMPNDNLDEKQGGGDICIQVCADDEQVAFHALRNLLNQAVGTCEVRFVNKGFLSGGKNGETPRNLFGFKDGTGNQSTKDDTLMNSIVWIQSGEPDWMTGGTYMAFRKIKMFLEVWDRSSLKDQEDTFGRRKSSGAPFGQKKETDPVKLNQIPSNSHVSLAKSTGKQILRRAFSYTEGLDPKTGYMDAGLLFISFQKNPDNQFIPMLKALSAKDALNEYTQTIGSALYACPGGCKKGEYIAQRLLES

SEQ ID NO: 394 - protein, 336 aa, Bacillus subtilis
  source: /note="strain 168"
HTVSPVNPNAQQTTKTVMNWLAHLPNRTENRVLSGAFGGYSHDTFSMAEADRIRSATGQSPAIYGCDYARGWLETANIEDSIDVSCNGDLMSYWKNGGIPQISLHLANPAFQSGHFKTPITNDQYKKILDSSTVEGKRLNAMLSKIADGLQELENQGVPVLFRPLHEMNGEWFWWGLTSYNQKDNERISLYKQLYKKIYHYMTDTRGLDHLIWVYSPDANRDFKTDFYPGASYVDIVGLDAYFQDAYSINGYDQLTALNKPFAFTEVGPQTANGSFDYSLFINAIKQKYPKTIYFLAWNDEWSAAVNKGASALYHDSWTLNKGEIWNGDSLTPIVE

SEQ ID NO: 395 - protein, 379 aa, Paenibacillus thiaminolyticus
AHSDASSDITLKVAIYPYVPDPARFQAAVLDQWQRQEPGVKLEFTDWDSYSADPPDDLDVFVLDSIFLSHFVDAGYLLPFGSQDIDQAEDVLPFALQGAKRNGEVYGLPQILCTNLLFYRKGDLKIGQVDNIYELYKKIGTSHSEQIPPPQNKGLLINMAGGTTKASMYLEALIDVTGQYTEYDLLPPLDPLNDKVIRGLRLLINMAGEKPSQYVPEDGDAYVRASWFAQGSGRAFIGYSESMMRMGDYAEQVRFKPISSSAGQDIPLFYSDVVSVNSKTAHPELAKKLANVMASADTVEQALRPQADGQYPQYLLPARHQVYEALMQDYPIYSELAQIVNKPSNRVFRLGPEVRTWLKDAKQVLPEALGLTDVSSLAS

SEQ ID NO: 396 - protein, 96 aa, Bacillus subtilis
  source: /note="strain 168"
QYISRCMFEKETKELYIGENLLQNGVLLSIRHVLEERKGQEGTQQFLYGRVSYYIHDTSIKEQKEINLRVSTDSGTERTAQIVFDQKQKKLLRWTE

SEQ ID NO: 397 - protein, 206 aa, Bacillus subtilis
  source: /note="strain 168"
KFVKNPNTSESWHFTVDDSVIYQHLPIDENGWHAGDGTNGTGNRKSIGIEICENADGDFEKATSNAQWLIRKLMKENNIPLNRVVPHKKWSGKECPRKLLDHWNSFLNGISSSDTPPKETSPSYPLPSGVIKLTSPYRKGTNILQLQKALAVLHFYPDKGAKNNGIDGVYGPKTANAVKRFQLMNGLTADGIYGPKTKAKLKSKLK

SEQ ID NO: 398 - protein, 267 aa, Bacillus subtilis
  source: /note="strain 168"
ASKGNLLSPDRILTVAHRGASGYVPEHTILSYETAQKMKADFIELDLQMTKDGKLIVMHDEKLDRTTNGMGWVKDHTLADIKKLDAGSWFNEAYPEKAKPQYVGLKVPTLEEVLDRFGKHANYYIETKSPDTYPGMEEKLIASLQKHKLLGKHSKPGQVIIQSFSKESLVKVHQLQPNLPTVQLLEAKQMASMTDAALEEIKTYAVGAGPDYKALNQENVRMIRSHGLLLHPYTVNNEADMHRLLDWGVTGVFTNYPDLFHKVKKGY

SEQ ID NO: 399 - protein, 289 aa, Bacillus subtilis
  source: /note="strain 168"
DSKGDKLHVVTTFYPMYEFTKQIVKDKGDVDLLIPSSVEPHDWEPTPKDIANIQDADLFVYNSEYMETWVPSAEKSMGQGHAVFVNASKGIDLMEGSEEEHEEHDHGEHEHSHAMDPHVWLSPVLAQKEVKNITAQIVKQDPDNKEYYEKNSKEYIAKLQDLDKLYRTTAKKAEKKEFITQHTAFGYLAKEYGLKQVPIAGLSPDQEPSAASLAKLKTYAKEHNVKVIYFEEIASSKVADTLASEIGAKTEVLNTLEGLSKEEQDKGLGYIDIMKQNLDALKDSLLVKS

SEQ ID NO: 400 - protein, 244 aa, Bacillus subtilis
  source: /note="strain 168"
ASSAHEKHLNVSKMNVDDEFKDTDGTFILHDLQKDQTFVYNRKRANQRQTPQSTFKVVNALIGLQVKAVRDEYDVKRWDGVKREFESWNRDHTLGSAMRESAIWYYQALARDIGEERMKTWLHTLSYGNEDISGGIDQFWLQSSLTISPLEQETFLEKLAKEELPFDKPVMKIVKRMMIQEEGDHYTLYGKTGTRLTDMGLGWFVGFIKTEHGSYVFVTNVDDSGTKAKNITVDILKKYGLITS

SEQ ID NO: 401 - protein, 124 aa, Bacillus subtilis
  source: /note="strain 168"
QSASIEAKTVNSTKEWTISDIEVTYKPNAVLSLGAVEFQFPDGFHATTRDSVNGRTLKETQILNDGKTVRLPLTLDLLGASEFDLVMVRKTLPRAGTYTIKGDVVNGLGIGSFYAETQLVIDPR

SEQ ID NO: 402 - protein, 287 aa, Bacillus subtilis
  source: /note="strain 168"
QNNNGSGKSESKDSRVIHDEEGKTTVSGTPKRVVVLELSFLDAVHNLGITPVGIADDNKKDMIKKLVGSSIDYTSVGTRSEPNLEVISSLKPDLIIADAERHKNIYKQLKKIAPTIELKSREATYDETIDSFTTIAKALNKEDEGKEKLAEHKKVINDLKAELPKDENRNIVLGVARADSFQLHTSSSYDGEIFKMLGFTHAVKSDNAYQEVSLEQLSKIDPDILFISANEGKTIVDEWKTNPLWKNLKAVKNGQVYDADRDTWTRFRGIKSSETSAKDVLKKVYNK

SEQ ID NO: 403 - protein, 431 aa, Bacillus subtilis
  source: /note="strain 168"
VTPAAHAVQISNSERELPFKAKHAYSTISQLSEAIGPRIAGTAAEKKSALLIASSMRKLKLDVKVQRFNIPDRLEGTLSSAGRDILLQAASGSAPTEEQGLTAPLYNAGLGYQKDFTADAKGKIALISRGDLTYYEKAKNAEAAGAKAVIIYNNKESLVPMTPNLSGNKVGIPVVGIKKEDGEALTQQKEATLKLKAFTNQTSQNIIGIKKPKNIKHPDIVYVTAHYDSVPFSPGANDNGSGTSVMLEMARVLKSVPSDKEIRFIAFGAEELGLLGSSHYVDHLSEKELKRSEVNFNLDMVGTSWEKASELYVNTLDGQSNYVWESSRTAAEKIGFDSLSLTQGGSSDHVPFHEAGIDSANFIWGDPETEEVEPWYHTPEDSIEHISKERLQQAGDLVTAAVYEAVKKEKKPKTIKKQMKAKASDIFEDIK

SEQ ID NO: 404 - protein, 153 aa, Bacillus subtilis
  source: /note="strain 168"
AESTSTKAHTESTMRTQSTASLFATITGASKTEWSFSDIELTYRPNTLLSLGVMEFTLPSGFTANTKDTLNGNALRTTQILNNGKTVRVPLALDLLGAGEFKLKLNNKTLPAAGTYTFRAENKSLSIGNKFYAEASIDVAKRSTPPTQPCGCN

SEQ ID NO: 405 - protein, 291 aa, Bacillus subtilis
  source: /note="strain 168"
AFWGASNELLHDPTMIKEGSSWYALGTGLTEERGLRVLKSSDAKNWTVQKSIFTTPLSWWSNYVPNYGQNQWAPDIQYYNGKYWLYYSVSSFGSNTSAIGLASSTSISSGGWKDEGLVIRSTSSNNYNAIDPELTFDKDGNPWLAFGSFWSGIKLTKLDKSTMKPTGSLYSIAARPNNGGALEAPTLTYQNGYYYLMVSFDKCCDGVNSTYKIAYGRSKSITGPYLDKSGKSMLEGGGTILDSGNDQWKGPGGQDIVNGNILVRHAYDANDNGIPKLLINDLNWSSGWPSY

SEQ ID NO: 406 - protein, 234 aa, Bacillus subtilis
  source: /note="strain 168"
AFNDIKSKDATFASGTLDLSAKENSASVNLSNLKPGDKLTKDFQFENNGSLAIKEVLMALNYGDFKANGGSNTSPEDFLSQFEVTLLTVGKEGGNGYPKNIILDDANLKDLYLMSAKNDAAAAEKIKKQIDPKFLNASGKVNVATIDGKTAPEYDGVPKTPTDFDQVQMEIQFKDDKTKDEKGLMVQNKYQGNSIKLQFSFEATQWNGLTIKKDHTDKDGYVKENEKAHSEDKN

SEQ ID NO: 407 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 408 - protein, 247 aa, Aspergillus niger
  source: /note="strain CBS 513.88 / FGSC A1513"
FPQQGAPHPLPWSPPGPNDVRAPCPMLNTLANHGYLPHNGKDITERHTINALYNALGIEEELAIYLHQEAVTTNPAPNATTFSLNDLSRHDILEHDASLSRQDAYFGDNHDFNQTIFDETRSYWTSPIIDVKQAAVSRQARVNTSMATNPNYTMSELGDSFSYGETAAYIIVLGDKEKGLVNRSRVEYLFENERLPLDLGWSRAKENITFDDLSTMLQRIINATGGEMDFRATIALPRLVYIYYEEA

SEQ ID NO: 409 - protein, 427 aa, Aspergillus niger
  source: /note="strain CBS 513.88 / FGSC A1513"
LVRPDGVGRTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQC

SEQ ID NO: 410 - protein, 318 aa, Aspergillus niger
  source: /note="strain CBS 513.88 / FGSC A1513"
SPLMDTLLQIPDLSTYAEVYNLTGGIVEINPLFLKRYNYDEDKRNYTFLAPTNDAWAKIPDAIFTTLMTQQAYPLTEALLRTHIIEARLTASELVKLSESEGAGGISTSLQLSNTTEQYHNGVLTKTVQGYYIDSVISSNGTVQIDDQAAIVTANIVADNGLIHAIDQVIDPFLIYGGGPSNRTLAPTSETTNLTIGELLKIDSRLVNSSKILTENSPDTLRRLSKQTGSMQFFVAPQNEAYDLMPTILPIFHTLVAPYKSPFNTLMWQYGWLDSDGETFADLNFTRPVTVASDVTGLNITVTQEKSAIFIMNAGLVT

SEQ ID NO: 411 - protein, 373 aa, Aspergillus niger
  source: /note="strain CBS 513.88 / FGSC A1513"
SSIPQTDYDVIVVGGGPAGLSVLSSLGRMRRKTVMFDSGEYRNGVTREMHDVLGFDGTPPAQFRGLARQQISKYNSTSVIDIKIDSITPVEDAAANSSYFRAVDANGTQYTSRKVVLGTGLVDVIPDVPGLREAWGKGIWWCPWCDGYEHRDEPLGILGGLPDVVGSVMETHTLYSDIIAFTNGTYTPANEVALAAKYPNWKQQLEAWNVGIDNRSIASIERLQDGDDHRDDTGRQYDIFRVHFTDGSSVVRNTFITNYPTAQRSTLPEELSLVMVDNKIDTTDYTGMRTSLSGVYAVGDCNSDGSTNVPHAMFSGKRAGVYVHVEMSREESNAAISKRDFDRRALEKQTERMVGNEMEDLWKRVLENHHRRS

SEQ ID NO: 412 - protein, 851 aa, Aspergillus niger
  source: /note="strain CBS 513.88 / FGSC A1513"
AVIGPRANSQSCPGYKASNVQKQARSLTADLTLAGTPCNSYGKDLEDLKLLVEYQTDERLHVMIYDADEEVYQVPESVLPRVGSDEDSEDSVLEFDYVEEPFSFTISKGDEVLFDSSASPLVFQSQYVNLRTWLPDDPYVYGLGEHSDPMRLPTYNYTRTLWNRDAYGTPNNTNLYGSHPVYYDHRGKSGTYGVFLLNSNGMDIKINQTTDGKQYLEYNLLGGVLDFYFFYGEDPKQASMEYSKIVGLPAMQSYWTFGVCPPPPNPITVRVVVYNYSQAKIPLETMWTDIDYMDKRRVFTLDPQRFPLEKMRELVTYLHNHDQHYIVMVDPAVSVSNNTAYITGVRDDVFLHNQNGSLYEGAVWPGVTVFPDWFNEGTQDYWTAQFQQFFDPKSGVDIDALWIDMNEASNFCPYPCLDPAAYAISADLPPAAPPVRPSSPIPLPGFPADFQPSSKRSVKRAQGDKGKKVGLPNRNLTDPPYTIRNAAGVLSMSTIETDLIHAGEGYAEYDTHNLYGTRLVMSSASRTAMQARRPDVRPLVITRSTFAGAGAHVGHWLGDNFSDWVHYRISIAQILSFASMFQIPMVGADVCGFGSNTTEELCARWASLGAFYTFYRNHNELGDISQEFYRWPTVAESARKAIDIRYKLLDYIYTALHRQSQTGEPFLQPQFYLYPEDSNTFANDRQFFYGDALLVSPVLNEGSTSVDAYFPDDIFYDWYTGAVVRGHGENITLSNINITHIPLHIRGGNIIPVRTSSGMTTTEVRKQGFELIIAPDLDDTASGSLYLDDGDSLNPSSVTELEFTYSKGELHVKGTFGQKAVPKVEKCTLLGKSARTFKGFALDAPVNFKLK

SEQ ID NO: 413 - protein, 358 aa, Aspergillus niger
  source: /note="strain CBS 513.88 / FGSC A1513"
VRPRSTACNNSPDLCSKSYGEITHLGAHDSPFLRDASTDYSTFGDQYYNTTLQLDAGVRLVTAQVHKSNSQWRLCHSSCDYLDAGLLSTWLSDIKSWLDSNPNDVVTVLLVNSDDATASDLHSQFETANLTNYTYTPTSQTSAPSSWPTLQELINNGTRLMTFVASLDASSNTVAPYLMDEFTFIWENNYDVTSASNFSCEPDRPTSLQNELSTALSSNRLPFMNHFLYQETLDIEYPNVSYISTTNAASGGTGNLGDTATKCKKEYNGRQPTFILVDFFDKGPAIDTVDSLNNVTNATGRKNLTSVSVTSSASTYSNVFKGLVEVVQKAKDGANPSMGEWIWAGGDWGSLLGGGIAV

SEQ ID NO: 414 - protein, 989 aa, Aspergillus niger
  source: /note="strain CBS 513.88 / FGSC A1513"
ASIKHRINGFTLTEHSDPAKRELLQKYVTWDDKSLFINGERIMIFSGEFHPFRLPVKELQLDIFQKVKALGFNCVSFYVDWALVEGKPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCCGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVFYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSAGSVTIPQLGGTLTLNGRDSKIHVTDYNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVIDNMGLEENWTVGEDLMKTPRGILNFLLAGRPSSAISWKLTGNLGGEDYEDKVRGPLNEGGLYAERQGFHQPEPPSQNWKSSSPLEGLSEAGIGFYSASFDLDLPKGWDVPLFLNIGNSTTPSPYRVQVYVNGYQYAKYISNIGPQTSFPVPEGILNYRGTNWLAVTLWALDSAGGKLESLELSYTTPVLTALGEVESVDQPKYKKRKGAY

SEQ ID NO: 415 - protein, 910 aa, Aspergillus niger
  source: /note="strain CBS 513.88 / FGSC A1513"
QYIRDLSTEKWTLSSRALNRTVPAQFPSQVHLDLLRAGVIGEYHGLNDFNLRWIAAANWTYTSQPIKGLLDNYDSTWLVFDGLDTFATISFCGQQIASTDNQFRQYAFDVSTALGSCKGDPVLSINFGSAPNIVDAIAQDSNSQKWPDDVQLTYEYPNRWFMRKEQSDFGWDWGPAFAPAGPWKPAYIVQLDKKESVYVLNTDLDIYRKGQINYLPPDQSQPWVVNASIDILGPLPTKPTMSIEVRDTHSGTILTSRTLNNVSVAGNAITGVTVLDGLTPKLWWPQGLGDQNLYNVSITVQSRGNQTVASVNKRTGFRTIFLNQRNITEAQRAQGIAPGANWHFEVNGHEFYAKGSNLIPPDSFWTRVTEEKMSRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVVSYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKIGHSSKKTTVTVEATSGVSLYTWLDYPEGVVGYFEENAFVLAPGEKKEISFTVLEDTTDGAWVRNITVQSLWDQKVRG

SEQ ID NO: 416 - protein, 380 aa, Aspergillus niger
  source: /note="strain CBS 513.88 / FGSC A1513"
KSTGDPFQLYTISAENITAKLIPYGARLTSLLVPDRDGNFQDVVVGYDDPKQYLKDTETNHTYFGAVVGRYANRIKNGTFSIGSDVYHIPENENDGEDTLHGGTVGYDQRNWTVTAYSNSSITFTLVDRAFEDFPGDVITHATFSVQTKVTPENPQGLPQLTTKLVSLALTETTPIMLANHIYWNLNAFKDETILEDTWLQLPLSKRLIGTNGILIPNGTILDVDVYDGAPDFVSGKLVGQDIEKTDGLCGTDCIGYDNCFIVDRPPQYAARNSIVPIIHMNSSTTGISLDVATNQQALQIYACNSQNGTIPVKQSQVQRNKAEGVDGAEYVNQHGCIVIETEGWIDGINNPQWGQLPDQIYSPETGPAVNWATYQFGTV

SEQ ID NO: 417 - protein, 308 aa, Aspergillus niger
  source: /note="strain CBS 513.88 / FGSC A1513"
EPIEPRQASVSIDTKFKAHGKKYLGNIGDQYTLTKNSKTPAIIKADFGALTPENSMKWDATEPSRGQFSFSGSDYLVNFAQSNNKLIRGHTLVWHSQLPSWVQSITDKNTLIEVMKNHITTVMQHYKGKIYAWDVVNEIFNEDGSLRDSVFYKVIGEDYVRIAFETARAADPNAKLYINDYNLDSASYPKLTGMVSHVKKWIAAGIPIDGIGSQTHLSAGGGAGISGALNALAGAGTKEIAVTELDIAGASSTDYVEVVEACLNQPKCIGITVWGVADPDSWRSSSTPLLFDSNYNPKPAYTAIANAL

SEQ ID NO: 418 - protein, 394 aa, Aspergillus niger
  source: /note="strain CBS 513.88 / FGSC A1513"
VPRVRRQGASSSFDYKSQIVRGVNLGGWLVTEPWITPSLYDSTGGGAVDEWTLCQILGKDEAQAKLSSHWSSFITQSDFDRMAQAGLNHVRIPIGYWAVAPIDGEPYVSGQIDYLDQAVTWARAAGLKVLVDLHGAPGSQNGFDNSGHRGPIQWQQGDTVNQTMTAFDALARRYAQSDTVTAIEAVNEPNIPGGVNEDGLKNYYYGALADVQRLNPSTTLFMSDGFQPVESWNGFMQGSNVVMDTHHYQVFDTGLLSMSIDDHVKTACSLATQHTMQSDKPVVVGEWTGALTDCAKYLNGVGNAARYDGTYMSTTKYGDCTGKSTGSVADFSADEKANTRRYIEAQLEAYEMKSGWLFWTWKTEGAPGWDMQDLLANQLFPTSPTDRQYPHQCS

SEQ ID NO: 419 - protein, 841 aa, Aspergillus niger
  source: /note="strain CBS 513.88 / FGSC A1513"
DELAYSPPYYPSPWANGQGDWAEAYQRAVDIVSQMTLAEKVNLTTGTGWELELCVGQTGGVPRLGIPGMCAQDSPLGVRDSDYNSAFPAGVNVAATWDKNLAYLRGQAMGQEFSDKGADIQLGPAAGPLGRSPDGGRNWEGFSPDPALSGVLFAETIKGIQDAGVVATAKHYIAYEQEHFRQAPEAQGYGFNITESGSANLDDKTMHELYLWPFADAIRAGAGAVMCSYNQINNSYGCQSSYTLNKLLKAELGFQGFVMSDWAAHHAGVSGALAGLDMSMPGDVDYDSGTSYWGTNLTISVLNGTVPQWRVDDMAVRIMAAYYKVGRDRLWTPPNFSSWTRDEYGFKYYYVSEGPYEKVNQFVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYIDVDGNLGDRRNLTLWRNGDNVIKAAASNCNNTIVIIHSVGPVLVNEWYDNPNVTAILWGGLPGQESGNSLADVLYGRVNPGAKSPFTWGKTREAYQDYLYTEPNNGNGAPQEDFVEGVFIDYRGFNKRNETPIYEFGYGLSYTTFNYSNLQVEVLSAPAYEPASGETEAAPTFGEVGNASDYLYPDGLQRITKFIYPWLNSTDLEASSGDASYGQDASDYLPEGATDGSAQPILPAGGGAGGNPRLYDELIRVTVTIKNTGKVAGDEVPQLYVSLGGPNEPKIVLRQFERITLQPSEETQWSTTLTRRDLANWNVETQDWEITSYPKMVFVGSSSRKLPLRASLPTVH

SEQ ID NO: 420 - protein, 344 aa, Aspergillus niger
  source: /note="strain CBS 513.88 / FGSC A1513"
AAAPLEKRSCTFTSASAAKSGKSSCSTITLDNIAVPAGETLDLTGLKKGTTVIFEGETTFGYKEWKGPLISMSGTDITVKQASGAKINCDGARWWDGKGSNGGKTKPKFFQAHKLDQSSITGLKVYNTPVQGFSILADHLTITDVTIDNSAGTSKGHNTDAFDIGQSTYITIDGATVYNQDDCLAINSGEHITFTNGYCDGGHGLSIGSIGGRSDNTVNDVTISNSKVLNSQNGVRIKTIYGKTGTVENVKFEDITLSDISKYGIVVEQDYENGSPTGTPTNGVKVEDITFKKVTGSVKSSGTDIYILCGSGSCSNWTWSGVDVTGGKKSSKCKNVPSGASCSD

SEQ ID NO: 421 - protein, 966 aa, Aspergillus niger
  source: /note="strain CBS 513.88 / FGSC A1513"
ASQSLLSTTAPSQPQFTIPASADVGAQLIANIDDPQAADAQSVCPGYKASKVQHNSRGFTASLQLAGRPCNVYGTDVESLTLSVEYQDSDRLNIQILPTHVDSTNASWYFLSENLVPRPKASLNASVSQSDLFVSWSNEPSFNFKVIRKATGDALFSTEGTVLVYENQFIEFVTALPEEYNLYGLGEHITQFRLQRNANLTIYPSDDGTPIDQNLYGQHPFYLDTRYYKGDRQNGSYIPVKSSEADASQDYISLSHGVFLRNSHGLEILLRSQKLIWRTLGGGIDLTFYSGPAPADVTRQYLTSTVGLPAMQQYNTLGFHQCRWGYNNWSDLADVVANFEKFEIPLEYIWTDIDYMHGYRNFDNDQHRFSYSEGDEFLSKLHESGRYYVPIVDAALYIPNPENASDAYATYDRGAADDVFLKNPDGSLYIGAVWPGYTVFPDWHHPKAVDFWANELVIWSKKVAFDGVWYDMSEVSSFCVGSCGTGNLTLNPAHPSFLLPGEPGDIIYDYPEAFNITNATEAASASAGASSQAAATATTTSTSVSYLRTTPTPGVRNVEHPPYVINHDQEGHDLSVHAVSPNATHVDGVEEYDVHGLYGHQGLNATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVVPVLEPLVNTVKGVFPGVGHGEVWYDWYTQAAVDAKPGVNTTISAPLGHIPVYVRGGNILPMQEPALTTREARQTPWALLAALGSNGTASGQLYLDDGESIYPNATLHVDFTASRSSLRSSAQGRWKERNPLANVTVLGVNKEPSAVTLNGQAVFPGSVTYNSTSQVLFVGGLQNLTKGGAWAENWVLEW

SEQ ID NO: 422 - protein, 439 aa, Aspergillus niger
  source: /note="strain CBS 513.88 / FGSC A1513"
APSSTIKARDDVTAITVKGNAFFKGDDRFYIRGVDYQPGGSSKLADPIADADGCKRDIEKFKELGLNTIRVYSVDNSKDHDECMNALADAGIYLVLDVNTPKYSLNRADPAPSYNDVYLQYIFATVDKFASYKNTLAFFSGNEVINDGPSSKAAPYVKAVTRDLRQYIRSRNYREIPVGYSAADIDTNRLQMAEYMNCGTDDERSDFFAFNDYSWCDPSSFTTSGWDQKVKNFTGYGLPLFLSEYGCNTNKREFEEVSALYDTKMTGVYSGGLVYEYSQESSNYGLVEINGDSVKTLSDYDALKSAYSKTSNPEGDGGYNKTGGANPCPAKDSPNWDVDGDSLPAIPEPAKKYMTEGAGKGAGFSGSGSMNAGTASTSTATPGSGSASSSSSSSGSSGTSTSSTGAAAGLQVPGFAMAPVMVGLVTVLSTVFGAGLVLL

SEQ ID NO: 423 - protein, 483 aa, Bacillus Amyloliquefaciens
VNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDHPDVVAETKKWGIWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 424 - protein, 478 aa, Aspergillus oryzae
  source: /note="strain ATCC 42149 / RIB 40"
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 425 - protein, 1025 aa, Kluyveromyces lactis
MSCLIPENLRNPKKVHENRLPTRAYYYDQDIFESLNGPWAFALFDAPLDAPDAKNLDWETAKKWSTISVPSHWELQEDWKYGKPIYTNVQYPIPIDIPNPPTVNPTGVYARTFELDSKSIESFEHRLRFEGVDNCYELYVNGQYVGFNKGSRNGAEFDIQKYVSEGENLVVVKVFKWSDSTYIEDQDQWWLSGIYRDVSLLKLPKKAHIEDVRVTTTFVDSQYQDAELSVKVDVQGSSYDHINFTLYEPEDGSKVYDASSLLNEENGNTTFSTKEFISFSTKKNEETAFKINVKAPEHWTAENPTLYKYQLDLIGSDGSVIQSIKHHVGFRQVELKDGNITVNGKDILFRGVNRHDHHPRFGRAVPLDFVVRDLILMKKFNINAVRNSHYPNHPKVYDLFDKLGFWVIDEADLETHGVQEPFNRHTNLEAEYPDTKNKLYDVNAHYLSDNPEYEVAYLDRASQLVLRDVNHPSIIIWSLGNEACYGRNHKAMYKLIKQLDPTRLVHYEGDLNALSADIFSFMYPTFEIMERWRKNHTDENGKFEKPLILCEYGHAMGNGPGSLKEYQELFYKEKFYQGGFIWEWANHGIEFEDVSTADGKLHKAYAYGGDFKEEVHDGVFIMDGLCNSEHNPTPGLVEYKKVIEPVHIKIAHGSVTITNKHDFITTDHLLFIDKDTGKTIDVPSLKPEESVTIPSDTTYVVAVLKDDAGVLKAGHEIAWGQAELPLKVPDFVTETAEKAAKINDGKRYVSVESSGLHFILDKLLGKIESLKVKGKEISSKFEGSSITFWRPPTNNDEPRDFKNWKKYNIDLMKQNIHGVSVEKGSNGSLAVVTVNSRISPVVFYYGFETVQKYTIFANKINLNTSMKLTGEYQPPDFPRVGYEFWLGDSYESFEWLGRGPGESYPDKKESQRFGLYDSKDVEEFVYDYPQENGNHTDTHFLNIKFEGAGKLSIFQKEKPFNFKISDEYGVDEAAHACDVKRYGRHYLRLDHAIHGVGSEACGPAVLDQYRLKAQDFNFEFDLAFE

SEQ ID NO: 426 - protein, 269 aa, Thermomyces lanuginosus [sequence omitted]

SEQ ID NO: 427 - protein, 441 aa, Candida antarctica
APAAETLDRRAALPNPYDDPFYTTPSNIGTFAKGQVIQSRKVPTDIGNANNAASFQLQYRTTNTQNEAVADVATVWIPAKPASPPKIFSYQVYEDATALDCAPSYSYLTGLDQPNKVTAVLDTPIIIGWALQQGYYVVSSDHEGFKAAFIAGYEEGMAILDGIRALKNYQNLPSDSKVALEGYSGGAHATVWATSLAESYAPELNIVGASHGGTPVSAKDTFTFLNGGPFAGFALAGVSGLSLAHPDMESFIEARLNAKGQRTLKQIRGRGFCLPQVVLTYPFLNVFSLVNDTNLLNEAPIASILKQETVVQAEASYTVSVPKFPRFIWHAIPDEIVPYQPAATYVKEQCAKGANINFSPYPIAEHLTAEIFGLVPSLWFIKQAFDGTTPKVICGTPIPAIAGITTPSADQVLGSDLANQLRSLDGKQSAFGKPFGPITPP

SEQ ID NO: 428 - protein, 269 aa, Rhizomucor miehei
SIDGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALDLYQREEGLSSSNLFLYTQGQPRVGDPAFANYVVSTGIPYRRTVNERDIVPHLPPAAFGFLHAGEEYWITDNSPETVQVCTSDLETSDCSNSIVPFTSVLDHLSYFGINTGLCT

SEQ ID NO: 429 - protein, 483 aa, Bacillus licheniformis
ANLKGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNGTVVSKHPLKAVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 430 - protein, 65 aa, Unknown
  source: /note="Description of Unknown: polypeptide"
DMKKKMDDDMGTMENMEEMKKKMMKDMEMMSQRMEEMAMAYDKMEKTKTRMQQEMDDMMMDMDHQ

SEQ ID NO: 431 - protein, 65 aa, Unknown
  source: /note="Description of Unknown: polypeptide"
DHKKKHDDDHGTHENHEEHKKKHHKDHEHHSQRHEEHAHAYDKHEKTKTRHQQEHDDHHHDHDHQ

SEQ ID NO: 432 - protein, 65 aa, Unknown
  source: /note="Description of Unknown: polypeptide"
DKKKKKDDDKGTKENKEEKKKKKKKDKEKKSQRKEEKAKAYDKKEKTKTRKQQEKDDKKKDKDHQ

SEQ ID NO: 433 - protein, 65 aa, Unknown
  source: /note="Description of Unknown: polypeptide"
DRKKKRDDDRGTRENREERKKKRRKDRERRSQRREERARAYDKREKTKTRRQQERDDRRRDRDHQ

SEQ ID NO: 434 - protein, 65 aa, Unknown
  source: /note="Description of Unknown: polypeptide"
DQKKKQDDDQGTQENQEEQKKKQQKDQEQQSQRQEEQAQAYDKQEKTKTRQQQEQDDQQQDQDHQ

SEQ ID NO: 435 - protein, 65 aa, Unknown
  source: /note="Description of Unknown: polypeptide"
DLRRRLDDDLGTLENLEELRRRLLRDLELLSRRLEERALAYDRLERTRRRLQQELDDLLLDLRRR

SEQ ID NO: 436 - protein, 65 aa, Unknown
  source: /note="Description of Unknown: polypeptide"
DMKKKVDDDLTTIEIFEEMKKKLFKDVEVLTFKLEEKHFTWDKIEKTKTKLHWELDDLLVDLDHH

SEQ ID NO: 437 - protein, 65 aa, Unknown
  source: /note="Description of Unknown: polypeptide"
MLKKKVKKKLTTLTIFHHLKKKLFKKVHVLTFKLHHLIFTWKKIKKTKTKLTTHLKKLWVKLKHM

SEQ ID NO: 438 - protein, 65 aa, Unknown
  source: /note="Description of Unknown: polypeptide"
DIKKKIDDDLGTIENLEEIKKKLLKDIEILSQRLEEIALAYDKLEKTKTRLQQELDDLLIDLDHQ

SEQ ID NO: 439 - protein, 65 aa, Unknown
  source: /note="Description of Unknown: polypeptide"
DVKKKVDDDLGTVENLEEVKKKLLKDVEVLSQRLEEVALAYDKLEKTKTRLQQELDDLLVDLDHQ

SEQ ID NO: 440 - protein, 65 aa, Unknown
  source: /note="Description of Unknown: polypeptide"
DFKKKFDDDLGTFENLEEFKKKLLKDFEFLSQRLEEFALAYDKLEKTKTRLQQELDDLLFDLDHQ

SEQ ID NO: 441 - protein, 65 aa, Unknown
  source: /note="Description of Unknown: polypeptide"
DWKKKWDDDLGTWENLEEWKKKLLKDWEWLSQRLEEWALAYDKLEKTKTRLQQELDDLLWDLDHQ

SEQ ID NO: 442 - protein, 65 aa, Unknown
  source: /note="Description of Unknown: polypeptide"
DTKKKTDDDLGTTENLEETKKKLLKDTETLSQRLEETALAYDKLEKTKTRLQQELDDLLTDLDHQ

SEQ ID NO: 443 - protein, 65 aa, Unknown
  source: /note="Description of Unknown: polypeptide"
DMKKKMDDDLGTMENLEEMKKKLLKDMEMLSQRLEEMALAYDKLEKTKTRLQQELDDLLMDLDHQ

SEQ ID NO: 444 - protein, 65 aa, Unknown
  source: /note="Description of Unknown: polypeptide"
DHKKKHDDDLGTHENLEEHKKKLLKDHEVLSQRLEEHALAYDKLEKTKTRLQQELDDLLHDLDHQ

SEQ ID NO: 445 - protein, 65 aa, Unknown
  source: /note="Description of Unknown: polypeptide"
DQKKKQDDDLGTQENLEEQKKKLLKDQEQLSQRLEEQALAYDKLEKTKTRLQQELDDLLQDLDHQ

SEQ ID NO: 446 - protein, 65 aa, Unknown
  source: /note="Description of Unknown: polypeptide"
DLRRRLDDDLGTLENLEELRRRLLRDLELLSQRLEERALAYDRLERTRTRLQQELDDLLLDLDRQ

SEQ ID NO: 447 - protein, 65 aa, Unknown
  source: /note="Description of Unknown: polypeptide"
DKKKKKDDDLGTKENLEEKKKKLLKDKEKLSQKLEEKALAYDKLEKTKTKLQQELDDLLKDLDKQ

SEQ ID NO: 448 - protein, 65 aa, Unknown
  source: /note="Description of Unknown: polypeptide"
DRRRRRDDDLGTRENLEERRRRLLRDRERLSQRLEERALAYDRLERTRTRLQQELDDLLRDLDRQ

SEQ ID NO: 449 - protein, 65 aa, Unknown
  source: /note="Description of Unknown: polypeptide"
DIKKKIDDDIGTIENIEEIKKKIIKDIEIISQRIEEIAIAYDKIEKTKTRIQQEIDDIIIDIDHQ

SEQ ID NO: 450 - protein, 65 aa, Unknown
  source: /note="Description of Unknown: polypeptide"
DVKKKVDDDVGTVENVEEVKKKVVKDVEVVSQRVEEVAVAYDKVEKTKTRVQQEVDDVVVDVDHQ

SEQ ID NO: 451 - protein, 65 aa, Unknown
  source: /note="Description of Unknown: polypeptide"
DFKKKFDDDFGTFENFEEFKKKFFKDFEFFSQRFEEFAFAYDKFEKTKTRFQQEFDDFFFDFDHQ

SEQ ID NO: 452 - protein, 65 aa, Unknown
  source: /note="Description of Unknown: polypeptide"
DWKKKWDDDWGTWENWEEWKKKWWKDWEWWSQRWEEWAWAYDKWEKTKTRWQQEWDDWWWDWDHQ

SEQ ID NO: 453 - protein, 65 aa, Unknown
  source: /note="Description of Unknown: polypeptide"
DTKKKTDDDTGTTENTEETKKKTTKDTETTSQRTEETATAYDKTEKTKTRTQQETDDTTTDTDHQ

SEQ ID NO: 454 - protein, 60 aa, Unknown
  source: /note="Description of Unknown: polypeptide"
LRKRRLLRKKKLLKKRRLLKRKRLLKRRKLLKRKKLLRRRKLLRRKRLLRKRKLLRKKRL

SEQ ID NO: 455 - protein, 60 aa, Unknown
  source: /note="Description of Unknown: polypeptide"
LRRLKRLLKRRLRLLRLLKLLLLKKLKRKLLLKLKLKKLLRRKKLRLKKKRLRKLLRKLR

SEQ ID NO: 456 - protein, 60 aa, Unknown
  source: /note="Description of Unknown: polypeptide"
LRLLKLKRLLLLKLKLRKLLRLLRLKLRKLKLLRLRLLLRKLLRRLLKLRLRLRKLLKLL

SEQ ID NO: 457 - protein, 60 aa, Unknown
  source: /note="Description of Unknown: polypeptide"
LEDEELLEDDDLLDDEELLDEDELLDEEDLLDEDDLLEEEDLLEEDELLEDEDLLEDDEL

SEQ ID NO: 458 - protein, 60 aa, Unknown
  source: /note="Description of Unknown: polypeptide"
LEELDELLDEELELLELLDLLLLDDLDEDLLLDLDLDDLLEEDDLELDDDELEDLLEDLE

SEQ ID NO: 459 - protein, 60 aa, Unknown
  source: /note="Description of Unknown: polypeptide"
LELLDLDELLLLDLDLEDLLELLELDLEDLDLLELELLLEDLLEELLDLELELEDLLDLL

SEQ ID NO: 460 - protein, 60 aa, Unknown
  source: /note="Description of Unknown: polypeptide"
LDRDDLLDKKRLLRREELLREKDLLREERLLREKRLLDDERLLDDKELLEREKLLERKDL

SEQ ID NO: 461 - protein, 60 aa, Unknown
  source: /note="Description of Unknown: polypeptide"
LEELRDLLREDLELLDLLRLLLLRKLRDKLLLKLRLRKLLDDRRLDLRRRELERLLEKLD

SEQ ID NO: 462 - protein, 60 aa, Unknown
  source: /note="Description of Unknown: polypeptide"
LELLKLRDLLLLRLRLDKLLDLLDLKLERLKLLELDLLLEKLLDELLRLDLELDRLLRLL

SEQ ID NO: 463 - protein, 60 aa, Unknown
  source: /note="Description of Unknown: polypeptide"
KRKLRRLLKLRRKRLKKLKRRLKRRRKKRLRLLKKRKLLKRLKLLRKLLRRRRLLRKKLK

SEQ ID NO: 464 - protein, 60 aa, Unknown
  source: /note="Description of Unknown: polypeptide"
KLKKRRLLKRKRLKLRRRLLLLLRKRRLRKLKLLLRLRLKRRRKKLRKLLLKKLKRLRLL

SEQ ID NO: 465 - protein, 60 aa, Unknown
  source: /note="Description of Unknown: polypeptide"
LLLLRKLRLLKLLRLLRKLRRRKLLRRRLLRKLLLKLLKLKLKLRKLRLLKKLLKLRLKK

SEQ ID NO: 466 - protein, 60 aa, Unknown
  source: /note="Description of Unknown: polypeptide"
DEDLEELLDLEEDELDDLDEELDEEEDDELELLDDEDLLDELDLLEDLLEEEELLEDDLD

SEQ ID NO: 467 - protein, 60 aa, Unknown
  source: /note="Description of Unknown: polypeptide"
DLDDEELLDEDELDLEEELLLLLEDEELEDLDLLLELELDEEEDDLEDLLLDDLDELELL

SEQ ID NO: 468 - protein, 60 aa, Unknown
  source: /note="Description of Unknown: polypeptide"
LLLLEDLELLDLLELLEDLEEEDLLEEELLEDLLLDLLDLDLDLEDLELLDDLLDLELDD

SEQ ID NO: 469 - protein, 60 aa, Unknown
  source: /note="Description of Unknown: polypeptide"
KDRLDDLLKLDERDLRRLREELREDERKDLELLKRDRLLKDLRLLDKLLEDDELLDRRLK

SEQ ID NO: 470 - protein, 60 aa, Unknown
  source: /note="Description of Unknown: polypeptide"
RLRREDLLKDKDLRLDDELLLLLDRDELEKLKLLLDLDLRDDEKRLEKLLLKRLRELDLL

SEQ ID NO: 471 - protein, 60 aa, Unknown
  source: /note="Description of Unknown: polypeptide"
LLLLERLDLLRLLDLLEKLEDDRLLDDDLLDKLLLKLLRLKLRLDKLDLLRRLLRLDLKR

SEQ ID NO: 472 - protein, 60 aa, Unknown
  source: /note="Description of Unknown: polypeptide"
LKKKKKRKLRKRLLLRKKKLLKRRRRLKRRLKKRRRLLLLLLRLRRKRKLLRRKKKRRKR

SEQ ID NO: 473 - protein, 60 aa, Unknown
  source: /note="Description of Unknown: polypeptide"
KKRKRKRRKKKLLLRKLKKLLRLRLKRLLLKKLKKKRKKLLLLKLKLRLLKLLLKRLKLR

SEQ ID NO: 474 - protein, 60 aa, Unknown
  source: /note="Description of Unknown: polypeptide"
RKKRLRKKLRLLLKRLLLKLLLLLLLLLLKLLRLKLLLKRRKKLLRRLLKRLRLLRRRRK

SEQ ID NO: 475 - protein, 60 aa, Unknown
  source: /note="Description of Unknown: polypeptide"
LDDDDDEDLEDELLLEDDDLLDEEEELDEELDDEEELLLLLLELEEDEDLLEEDDDEEDE

SEQ ID NO: 476 - protein, 60 aa, Unknown
  source: /note="Description of Unknown: polypeptide"
DDEDEDEEDDDLLLEDLDDLLELELDELLLDDLDDDEDDLLLLDLDLELLDLLLDELDLE

SEQ ID NO: 477 - protein, 60 aa, Unknown
  source: /note="Description of Unknown: polypeptide"
EDDELEDDLELLLDELLLDLLLLLLLLLLDLLELDLLLDEEDDLLEELLDELELLEEEED

SEQ ID NO: 478 - protein, 60 aa, Unknown
  source: /note="Description of Unknown: polypeptide"
LRKRKRDRLERELLLDRKRLLREDEELREELKKEEDLLLLLLDLDDKDKLLEERRKDDRE

SEQ ID NO: 479 - protein, 60 aa, Unknown
  source: /note="Description of Unknown: polypeptide"
KKDREKEERRKLLLDRLKKLLELDLRELLLRRLRKRDKRLLLLRLRLDLLKLLLRELRLE

SEQ ID NO: 480 - protein, 60 aa, Unknown
  source: /note="Description of Unknown: polypeptide"
ERRDLDKRLELLLKELLLKLLLLLLLLLLKLLELRLLLKEDKKLLEDLLKDLDLLDDDDR

SEQ ID NO: 481 - protein, 252 aa, Agaricus bisporus
  source: /note="var. bisporus"
  source: /note="strain H97 / ATCC MYA-4626 / FGSC 10389"
MATTQHYLWASGHFILLLASFRYYLGWVTFKAVPTWWFKASFTGALISYAIVCFKSFGTPQPNLAYVKRALTDENVQYFLLALYWFSSRTPIAITLLPYMIFSLFHALTFTRTTLFPQFLPPGPPASAGGPPGPHPLAKRLQAWVKANYDTAMKLVAYTELVVFVRVFLGAITFQNAIIAPLLYVHFLRQRYYQSAFTRNAIATTTSLIDKYITKANNPIVSQVYDKIKMLVQRWGGSGIIEPQPTPANARR

SEQ ID NO: 482 - protein, 240 aa, Saccharomyces cerevisiae
  source: /note="strain ATCC 204508 / S288c"
MWSSLFGWTSSNAKNKESPTKAIVRLREHINLLSKKQSHLRTQITNQENEARIFLTKGNKVMAKNALKKKKTIEQLLSKVEGTMESMEQQLFSIESANLNLETMRAMQEGAKAMKTIHSGLDIDKVDETMDEIREQVELGDEISDAISRPLITGANEVDEDELDEELDMLAQENANQETSKIVNNNVNAAPISENKVSLPSVPSNKIKQSENSVKDGEEEEDEEDEDEKALRELQAEMGL

SEQ ID NO: 483 - protein, 234 aa, Bos taurus
MAWSPLLLTLVALCTGSWAQAVLTQPSSVSGSLGQRVSITCSGSSSNIGSYNVGWYQQVPGSGLRTIIYGSSSRPSGVPDRFSGSKSGNTATLTISSLQAEDEADYFCAAYDSSSGAVFGSGTTLTVLGQPKSPPSVTLFPPSTEELNGNKATLVCLISDFYPGSVTVVWKADGSTITRNVETTRASKQSNSKYAASSYLSLTSSDWKSKGSYSCEVTHEGSTVTKTVKPSECS

SEQ ID NO: 484 - protein, 233 aa, Saccharomyces cerevisiae
  source: /note="strain ATCC 204508 / S288c"
MSEKFPPLEDQNIDFTPNDKKDDDTDFLKREAEILGDEFKTEQDDILETEASPAKDDDEIRDFEEQFPDINSANGAVSSDQNGSATVSSGNDNGEADDDFSTFEGANQSTESVKEDRSEVVDQWKQRRAVEIHEKDLKDEELKKELQDEAIKHIDDFYDSYNKKKEQQLEDAAKEAEAFLKKRDEFFGQDNTTWDRALQLINQDDADIIGGRDRSKLKEILLRLKGNAKAPGA

SEQ ID NO: 485 - protein, 228 aa, Cicer arietinum
MTKTGYINAAFRSSRNNEAYLFINDKYVLLDYAPGTSNDKVLYGPSFVRDGYKSLAKTIFGTYGIDCSFDTEYNEAFIFYENFCARIDYAPHSDKDKIISGPKKIADMFPFFKGTVFENGIDAAFRSTKGKEVYLFKGDKYARIDYLTNRLVQNIKSISDGFPCLRGTIFEAGMDSAFASHKTNEAYLFKGEYYARINFTPGSTNDIMGGVKKTLDYWPSLRGIIPLE

SEQ ID NO: 486 - protein, 227 aa, Ovis aries
MAYPMQLGFQDATSPIMEELLHFHDHTLMIVFLISSLVLYIISLMLTTKLTHTSTMDAQEVETIWTILPAIILIMIALPSLRILYMMDEINNPSLTVKTMGHQWYWSYEYTDYEDLSFDSYMIPTSELKPGELRLLEVDNRVVLPMEMTVRMLISSEDVLPSWAVPSLGLKTDAIPGRLNQTTLMSTRPGLFYGQCSEICGSNHSFMPIVLELVPLKYFEKWSASML

SEQ ID NO: 487 - protein, 222 aa, Arthrospira platensis NIES-39
MFSKEITESKTYKWFDERLDVQAISDDITSKYVPPHVNIFYCLGGITLVCFLIQFATGFAMTFYYKPTVAEAFTSVQYIMTEVSFGWLIRSIHRWSASMMVLMMILHVFRVYLTGGFKKPRELTWVTGVVMAVITVSFGVTGYSLPWDQIGYWAVKIVSGVPEAIPIVGSTIVELMRGGAAVGQPTLSRFYSLHTFVLPWLIAVFMLLHFLMIRKQGISGPL

SEQ ID NO: 488 - protein, 213 aa, Agaricus bisporus
  source: /note="var. bisporus"
  source: /note="strain H97 / ATCC MYA-4626 / FGSC 10389"
MTDTIPTFKLVLVGDGGTGKTTFVKRHLTGEFEKKYIATLGVEVHPLHFTTNFGNICFNVWDTAGQEKFGGLRDGYYIQGQCGIIMFDVTSRITYKNVPNWHRDLERVCENIPIVLCGNKIDVKERKVKTGAVTFHRKKNLQYFEISAKSNYNFEKPFLWLAQKLVGNPRLEFVAAPALAPAEVAIDANLMKQYEQELKQAEAVPLPEEEDDL

SEQ ID NO: 489 - protein, 213 aa, Saccharomyces cerevisiae
  source: /note="strain ATCC 204508 / S288c"
MSVEEVSKKFEENVSVDDTTATPKTVLSDSAHFDVKHPLNTKWTLWYTKPAVDKSESWSDLLRPVTSFQTVEEFWAIIQNIPEPHELPLKSDYHVFRNDVRPEWEDEANAKGGKWSFQLRGKGADIDELWLRTLLAVIGETIDEDDSQINGVVLSIRKGGNKFALWTKSEDKEPLLRIGGKFKQVLKLTDDGHLEFFPHSSANGRHPQPSITL

SEQ ID NO: 490 - protein, 206 aa, Arthrospira platensis C1
MNLAEGVQVVSFGLLTIMMIGSALGVVLLKNIVYSAFLLGGVFMSMAGLYLLLNADFVAAAQVLIYVGSVNVLILFGIMLVNKQQDFRVLPNAGLRQIATAVVCVGLFALLSTMVLSTPWSVTTTVVTIESSAIAIGEHFFTDFLLPFELASVFLLMAMVGAIVLARRDFLPDASNAPTTTTPLLMLTERPRELVSVSGSSEDSSE

SEQ ID NO: 491 - protein, 206 aa, Vitis vinifera
MVSLKLQKRLAASVLKCGRGKVWLDPNEVNEISMANSRQNVRKLVKDGFIIRKPTKIHSRSRARRMKEAKRKGRHSGYGKRKGTREARLPTKILWMRRMRVLRRLLRKYRESKKIDKHMYHDMYMKVKGNVFKNKRVLMESIHKSKAEKAREKTLSDQFEAKRAKNKASRERKLARREERLAQGPVERAPPASAPQPAEGTKKAKK

SEQ ID NO: 492 - protein, 206 aa, Vitis vinifera
MFQWAYMYVSELWRKKQSDVMRFLQRVRCWEYRQHPSIVRVTRPTRPDKARRLGYKAKQGYVIYRVRVRRGGRKRPVPKGIVYGKPTNQGVTQLKFQRSKRSVAEERAGRKLGGLKVLNSYWINEDSTYKYYEIILVDAAHNAIRNDPRINWICKPVHKHRELRGLTSAGKKYRGLRGKGHRHHKARPSRRATWKRNNTLSLRRYR

SEQ ID NO: 493 - protein, 201 aa, Bos taurus
MPRSQHRCPDARLSAQERTMGDEEKRHRAITARRQHLKSVMLQIAATELEKEEGRREAEKQNYLSEHCPPLHLPGSMSEVQELCRQLHAKIDAAEEEKYDMEIRVQKSTKELEDMNQKLFDLRGKFKRPPLRRVRMSADAMLKALLGSKHKVCMDLRANLKQVKKEDTEKERDLRDVGDWRKNIEEKSGMEGRKKMFETES

SEQ ID NO: 494 - protein, 199 aa, Ovis aries
MDGQKKNWKDKVVDLLYWRDIKKTGVVFGASLFLLLSLTVFSIVSVTAYIALALLSVTISFRIYKGVIQAIQKSEEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAVAKIQAKIPGLKRKAE

SEQ ID NO: 495 - protein, 196 aa, Vitis vinifera
MEKNVESDPNPPLASGPEFPPATTPADVKNDVALEKSVVPPPEVKADESKALAVVEKTPDSAAKKTSGGSFERDVALANLEKEKQLSFIRAWEESEKSKVDNKAQKKLSDVCAWENSKKAAVEANLKKIEEELEKKKAEYAEKMKNKVALIHKQAEEKKAMIEARRGEEFLKAEEMAAKFRATGQTPKKVLGCFGG

SEQ ID NO: 496 - protein, 194 aa, Saccharomyces cerevisiae
  source: /note="strain ATCC 204508 / S288c"
MVTSNVVLVSGEGERFTVDKKIAERSLLLKNYLNDMHDSNLQNNSDSESDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 497 - protein, 187 aa, Saccharomyces cerevisiae
  source: /note="strain ATCC 204508 / S288c"
MSIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 498 - protein, 182 aa, Arthrospira platensis C1
MSSIVGQLVEPYATALMSVAKSNNVTEDFGNQMRSLIDLLKNSPELQDFLGSPVVKGEDKKAVITRMLGEEVHPYLRNFLMLLVDRGRILFLAEIAQEYLALLRKLNQTVLAEVTSAVELNDGQKHMVVEQIKARTGAQNVELDLKIDREILGGVIIKAGSQLFDASIRGQLRRIGMSLTVG

SEQ ID NO: 499 - protein, 179 aa, Zea mays
MRPSTAGALAAAALVATLLLSVGATPETTCAAAAARDRRVDYGFCVSRLSHHHDSPDADTWGLAKVAADVGVATAGDAVYDIKALLAKPPPDAQARAALEQCQRLYDAAEMAFAEAYDGINRRDYAAGKGKAAEAAALARRCDDAFARAAVRPPPQVARWGEESSKIAVVCTAITDLIG

SEQ ID NO: 500 - protein, 171 aa, Oryza sativa
  source: /note="subsp. japonica"
MAPKIPIFFFLLALAAGVQGETGGVGGGGGNVEYNCVYTVFVRTGSAWKGGTDSTIGVEFAGADGRGVRIADLERWGGLMGAGHDYYERGNLDVFSGRGPCLPAAPCWMNLTSDGAGAHHGWYCNYVEVTATGPHRGCAQRRFDVEQWLATDASPYRLTAVRDQCRGHAAA

SEQ ID NO: 501 - protein, 167 aa, Agaricus bisporus
  source: /note="var. bisporus"
  source: /note="strain H97 / ATCC MYA-4626 / FGSC 10389"
MLKTFSSFGFAALLSQGFFLGANGEVTKVFAPGMYKIVNPESLTWVRGLPGPGQHGPWMSPITMAWDMSSIYQTWEVSAFEEGYKIQNYGSKMFAFSRSHEVDNLVLGFSDGFTKWYIEPTGGSEYRIHYPNRDLVWTVNYDDNFPDTVSLKPFEGGEDQIFRFDKL

SEQ ID NO: 502 - protein, 167 aa, Glycine max
MASQSNTKSVHDFTVKDARGNNVNLADYKGKVLLIVNVASQCGLTNSNYTELNQLYEKYKGKGLEILAFPCNQFGAQEPGTNEEIVEFACTRFKAEFPIFDKVDVNGDNAAPLYKFLKSSKGGLFGDSIKWNFSKFLVDKDGNVVDRYAPTTSPLSIEKDIKKLLDA

SEQ ID NO: 503 - protein, 161 aa, Zea mays
MVLKTELCRFSGQKIYPGKGIRFIRADSQVFLFANSKCKRYFHNRLKPAKLTWTAMYRKQHKKDIHAEAVKKRRRATKKPYSRSIVGASLEVIQKKRAEKPEVRDAAREAALREIKERIKKTKDEKKAKKAEVTKSQKAQTKGAVQKGSKGPKLGGGGGKR

SEQ ID NO: 504 - protein, 159 aa, Agaricus bisporus
  source: /note="var. bisporus"
  source: /note="strain H97 / ATCC MYA-4626 / FGSC 10389"
MTITHTAMAQSQWLTNGTFLIASRTNGNQALAVQDGRLTPGVTIVVTNTQSTQNGAAIWSYHFDNMLINKRSGLALSVRRINVTSGVSPGTKVVQEQINTNPTGMVQEWNYFAATGQIHPSFAGDSCITAGSQLNRGVATIERCVAGRVEQSWTVVALP

SEQ ID NO: 505 - protein, 157 aa, Bos taurus
MKNCLLFWGVLAIFVMAVLVTAQDENERIVVDNKCKCARITSRIIPSAEDPSQDIVERNVRIIVPLNSRENISDPTSPMRTKFVYHLSDLCKKCDTTEVELEDQVVTASQSNICDSDAETCYTYDRNKCYTNRVKLSYRGQTKMVETALTPDSCYPD

SEQ ID NO: 506 - protein, 268 aa, Agaricus bisporus
  source: /note="var. bisporus"
  source: /note="strain H97 / ATCC MYA-4626 / FGSC 10389"
MADTWKDGILLKIVNIIVYLLFLGSNIYTVAAPQGIYYHGKETYITPAPWAFLIWSLIHLLLLGTVIYQFFPQGKRVIIDGISWRFPLLAVLNAIYVNLWASKHYIIAFIFALFVSSAVTHIYYVVKKYHIAESISDELFIHIPFSLYHGWTTVLVVLTAFEAFGVNKFHHHAGIWTKVFVFLALFFLEGTAATYAFSTPEGDLPASIAIAWSLWAIFAQQRKPEFIHWSALAFAILALFWVLKAAWGVYRGHGRIALSDEERAPLVG

SEQ ID NO: 507 - protein, 246 aa, Agaricus bisporus
  source: /note="var. bisporus"
  source: /note="strain H97 / ATCC MYA-4626 / FGSC 10389"
MISFYDLTAKPPFKTVSVNSWKIRYALNFKNLPYKTLYFEFPDMAKEFSKVGIPPSSVSADGPSYTVPSLIDDSTNTRISESFTIALYLDKQYPDAPKLFPAGTEALQAAFHEEFYKVMSPTFPFFFPKAGNVLNKPSDDYFAVTRAKMFGMSMADFEPKGEARVEAWKKVKDAFDTLESWMSKTSGPFFMGETVSFADFVIGGLLNEFSMCMGENSPEWQDVLKWNNGRWATLKKKLEVYANTDQ

SEQ ID NO: 508 - protein, 236 aa, Vitis vinifera
MGTSTFSQYTVVHDVSVAKIDPVAPLEKVCLLGCGVPTGLGAVWNTAKVESGSIVAVFGLGTVGLAVAEGAKSAGASRIIGVDIDSKKFDVAKNFGVTEFVNPKDHEKPIQQVLVDLTDGGVDYSFECIGNVSVMRAALECCHKGWGTSVIVGVAASGQEISTRPFQLVTGRVWKGTAFGGFKSRSQVPWLVEKYMKKEIKVDEYITHNLTLGEINEAFDLMHEGGCLRCVLAMHV

SEQ ID NO: 509 - protein, 229 aa, Gadus morhua
MSDTEDVDQVEDEKPKFKPSAPKIPDGEKVDFDDIQKKRQNKDLSELQGLIDAHFEGRKKEEEELIALKERIEKRRAERAEQQRIRSEKDKERQARREEERLKREEADAKKKMEEDAKKKSALSNMGSNYSSHLQKADQKRGGGKKETEREKKKKILAARRKGLNIDHLNEDKLKDKINELHEWMSTLESEKFDHMERLNRQKYEVTTLRKRVEELSKFSKKGKTVRRK

SEQ ID NO: 510 - protein, 229 aa, Meleagris gallopavo
MVPIAEKMAEKQEEPSNTQNGEPDNAEEGEGKKKKKVKREDLPPFEIVTGERLPAIFFKFQFRNVEYSSGRNKTFLCYVVETQGKESTTSRGYLEDEHAASHAEIAFFNTILPKCESSLRYNITWYVSSSPCVTCADRISETLRKNKNLRLTIMVGRLFMWEEPEMQAALKKMKSAGCKLRIMKPQDFEYVWQNFVEQEEGEEAKAFVPWEDIQENFQYYEEKLAEILQ

SEQ ID NO: 511 - protein, 219 aa, Arthrospira platensis C1
MVLFGFGKKKSLPKPEEALPGRDRVMSVPDRHYINGNPLKPPFPEGMEQAVFGLGCFWGAERKFWQQQGVFSTAVGYAGGYTKNPTYEEVCSGMTGHTEVVLVVFDPKVISYTDLLKLFWESHNPTQGMRQGNDTGTQYRSAIYTYSDEQQRLALASRDRYQQALSAASYGEITTEIAPAQEFYYAEAYHQQYLGKNPNGYCGLGGTGVGCPAMTETSV

SEQ ID NO: 512 - protein, 184 aa, Oryza sativa
  source: /note="subsp. japonica"
MALEHLGRRNVAGSLLLLNLLMYVFLLGFAGWALNSSIKNAGADVGVGWGEQPWSPYYRQSAWFASRFHLATFAALAGALGVAAKASAAYHGGRSGASWRPQGLAAAASLGTAAWAATALAFGVACREIHDAAAAGPAGAARGWRMRALEGLTVTLAFTQLLYVLLLHAAVAGERCGLACAADA

SEQ ID NO: 513 - protein, 180 aa, Zea mays
MKMVIVLVVWLALSAASASAMQMPCPCAGLQGLYGAGAGLTTMMGAGGLYPYAEYLRQPQCSPLAAAPYYAGCGQTSAMYQPLRQQCCQQQMRMMDVQSVAQQLQMMMQLERAATASSSLYEPALMQQQQQLLAAQGLNPMAMMMAQNMPAMGGLYQYQYQLPSYRTNPCGVSAAIPPYY

SEQ ID NO: 514 - protein, 176 aa, Arthrospira platensis NIES-39
MAEQQRRKKNTRTKEKESEWQERVVQIRRVTKVVKGGKKLSFRAIVIVGNEKGQVGVGVGKAADVIGAVKKGVADGRKNVVEIPLTKSNSLPHPANGVGGGAQVIVRPAAPGTGVIAGGAVRTVLELAGVKNVLAKQLGSSNPLNNARATINALSGLRTLSDVAKERGIPIEQLYA

SEQ ID NO: 515 - protein, 168 aa, Saccharomyces cerevisiae
  source: /note="strain ATCC 204508 / S288c"
MSNLLNKFADKLHGNDHDERYEDDNDDQTRQQRHEKHQQREFRNQGSKADPYGEENQGNFPQRQQPQSNLGGNTQFGGNDFQQQTTDYTAGTGGGTYTQTYRETNTQGQLDDDEDDDFLTSGQQQKQGRTRGAQSNRYQSSNIGSGRRDLSGSGNDEYDDDSGNQGVW

SEQ ID NO: 516 - protein, 155 aa, Saccharomyces cerevisiae
  source: /note="strain ATCC 204508 / S288c"
MLSLRQSIRFFKPATRTLCSSRYLLQQKPVVKTAQNLAEVNGPETLIGPGAKEGTVPTDLDQETGLARLELLGKLEGIDVFDTKPLDSSRKGTMKDPIIIESYDDYRYVGCTGSPAGSHTIMWLKPTVNEVARCWECGSVYKLNPVGVPNDDHHH

SEQ ID NO: 517 - protein, 155 aa, Saccharomyces cerevisiae
  source: /note="strain ATCC 204508 / S288c"
MKVEIDSFSGAKIYPGRGTLFVRGDSKIFRFQNSKSASLFKQRKNPRRIAWTVLFRKHHKKGITEEVAKKRSRKTVKAQRPITGASLDLIKERRSLKPEVRKANREEKLKANKEKKKAEKAARKAEKAKSAGTQSSKFSKQQAKGAFQKVAATSR

SEQ ID NO: 518 - protein, 212 aa, Lactobacillus acidophilus
  source: /note="strain 30SC"
MTKGILGRKVGMTQIFTKDGVLVPVTVVEATPNVVMQVKTVESDGYEAVQLGYQDKREVLSNKPEKGHADKAKTSPKRFIREIRGVELKDYEVGSEVTVDTFKEGDVVNVTGTSRGHGYQGNIKRWGQSRGPETHGSRYHRIPGSMGSIINRVPKGKRLPGHMGVKKVTIENLVIEKVVADKNVLMIKGNVPGAKNSLIVVKTASKAVKADK

SEQ ID NO: 519 - protein, 183 aa, Zea mays
MSPWWKPLLVATAAFAALLAADATVETTCKAAAATDDRVDYGFCVSELSKHRDSPGADAWGLAKVAANLGVNNAGGAVRDAEALLAGPPPGAGEGADGAKTKAALGQCRRLYFDMELALAGAYDDIDARDYAAGKEMAVEGIALARRCDAVFAEAGMPSLLARRAEYAQQITVLCIAITDLIE

SEQ ID NO: 520 - protein, 183 aa, Gallus gallus
MSDEEKKRRAATARRQHLKSAMLQLAVTEIEKEAAAKEVEKQNYLAEHCPPLSLPGSMQELQELCKKLHAKIDSVDEERYDTEVKLQKTNKELEDLSQKLFDLRGKFKRPPLRRVRMSADAMLRALLGSKHKVNMDLRANLKQVKKEDTEKEKDLRDVGDWRKNIEEKSGMEGRKKMFEAGES

SEQ ID NO: 521 - protein, 161 aa, Arthrospira platensis
MQDAITSVINSSDVQGKYLDASAIQKLKAYFATGELRVRAATTISANAANIVKEAVAKSLLYSDITRPGGNMYTTRRYAACIRDLDYYLRYATYAMLAGDPSILDERVLNGLKETYNSLGVPIGATVQAIQAMKEVTAGLVGADAGKEMGIYFDYICSGLS

SEQ ID NO: 522 - protein, 155 aa, Cicer arietinum
MTSHDQSYRAGEAKGRTEEKTNQMIGNIEDKAQAAKEKAQQAAQTAKDKTSQTAQAAKEKTQQTAQAAKDKTQQTTQATKEKAQDTTGRAKEKGSEMGQSTKETAQSGKDNSAGFLQQTGEKAKGMAQGATDAVKQTFGMTNDDQDKDHFPTNRH

SEQ ID NO: 523 - protein, 57 aa, Arthrospira platensis C1
MTETPQPTTTPNLQEPKFGFNSYSERLNGRAAMIGFVITLAIEYFTKQGLLAWLGLS

SEQ ID NO: 524 - protein, 69 aa, Ovis aries
MPAWYSIDSRVRGTSLVVKGLKENVEYHFRVSAENQFGISKPMKSEEPVIPKTPLSKASSNHNTVNFLS

SEQ ID NO: 525 - protein, 74 aa, Saccharomyces cerevisiae
  source: /note="strain ATCC 204508 / S288c"
MTKNFIVTLKKNTPDVEAKKFLDSVHHAGGSIVHEFDIIKGYTIKVPDVLHLNKLKEKHNDVIENVEEDKEVHT

SEQ ID NO: 526 - protein, 76 aa, Solanum lycopersicum
MANSMRLFATMLLLAMLVMATGPMRIVEARTCESQSHRFKGPCVSEKNCASVCETEGFSGGDCRGFRRRCFCTRPC

SEQ ID NO: 527 - protein, 81 aa, Arthrospira platensis NIES-39
MSHSVKIYDTCIGCTQCVRACPLDVLEMVPWDGCKAGQIASSPRTEDCIGCKRCETACPTDFLSVRVYLGAETTRSMGLAY

SEQ ID NO: 528 - protein, 82 aa, Saccharomyces cerevisiae
  source: /note="strain ATCC 204508 / S288c"
MVLVQDLLHPTAASEARKHKLKTLVQGPRSYFLDVKCPGCLNITTVFSHAQTAVTCESCSTVLCTPTGGKAKLSEGTSFRRK

SEQ ID NO: 529 - protein, 87 aa, Arthrospira platensis Sp-1
MLGYISAGKMGSSPSGARFFKYEVVGMRQNDETDKTEYQIRSSGSQFVIVPYNRMNQEMRRINRMGGKIVSIEPMTTDNTVSEAEGE

SEQ ID NO: 530 - protein, 96 aa, Oryza sativa
  source: /note="subsp. japonica"
MMRKLAVLVLAVAMVAACGGGVVGVAGAGCNAGQLTVCTGAIAGGARPTAACCSSLRAQQGCFCQFAKDPRYGRYVNSPNARKAVSSCGIALPTCH

SEQ ID NO: 531 - protein, 96 aa, Solanum lycopersicum
MAAKNSEMKFAIFFVVLLTTTLVDMSGISKMQVMALRDIPPQETLLKMKLLPTNILGLCNEPCSSNSDCIGITLCQFCKEKTDQYGLTYRTCNLLP

SEQ ID NO: 532 - protein, 103 aa, Arthrospira platensis NIES-39
MSIAVGMIETIGFPAVVEAADSMVKAARVTLVGYEKIGSGRVTVIVRGDVSEVQASVSAGIESVKRVNGGEVSSTHIIARPHENLEYVLPIRYTDAVEQFRSY

SEQ ID NO: 533 - protein, 103 aa, Arthrospira platensis NIES-39
MVTEFQTRDLADVIRRPIVTEKATIQMELNQFTFDVDPRADKPTIKAAVELLFPVKVLSVNTQNPPRRQRRVGRFVGYKPRYKRAIVTLEDGEALRKVLFPEV

SEQ ID NO: 534 - protein, 103 aa, Arthrospira platensis NIES-39
MSIYVGNLSYEVTEDDLTAVFAEYGSVKRVKLPTDRETGRMRGFGFVEMDTEAEEQSAIDALDGAEWCGRDLRVNKAKPRENSGSFGGGGGGRRGGGGYSRRS

SEQ ID NO: 535 - protein, 108 aa, Bos taurus
MQAVLTQPSSVSGSLGQRVSITCSGSSSNVGRGNYVNWFQQIPGSAPRTLIYGATSRASGVPDRFSGSRSGNTATLTISSLQAEDEADYFCAAYDSSSNNGTVLQARG

SEQ ID NO: 536 - protein, 110 aa, Solanum lycopersicum
MEEEKHHHHHLFHHKDKAEEGPVDYEKEIKHHKHLEQIGKLGTVAAGAYALHEKHEAKKDPEHAHKHKIEEEIAAAAAVGAGGFAFHEHHEKKDAKKEEKKAEGGHHHLF

SEQ ID NO: 537 - protein, 113 aa, Saccharomyces cerevisiae
  source: /note="strain ATCC 204508 / S288c"
MSEIQNKAETAAQDVQQKLEETKESLQNKGQEVKEQAEASIDNLKNEATPEAEQVKKEEQNIADGVEQKKTEAANKVEETKKQASAAVSEKKETKKEGGFLKKLNRKIASIFN

SEQ ID NO: 538 - protein, 115 aa, Gallus gallus
MNETCVVKNSSKIHVFRHNSTLTHEDGQVVSMAELIHSDKDLFILKHFKDNHVGLSLSARTAEVTKEQLEEFEAQLRCHGFKLEEAFITSPKDACPAAGEETGEGSAATAEPQLG

SEQ ID NO: 539 - protein, 122 aa, Ovis aries
MATLKDQLIQNLLKEEHVPQNKITVVGVGAVGMACAISILMKDLADEIALVDVMEDKLKGEMMDLQHGSLFLRTPKIVSGKDYNVTANSRLVIITAGARQQEGESRLNLVQRNVNIFKFIIP

SEQ ID NO: 540 - protein, 127 aa, Arthrospira platensis C1
MARIAGVDLPRDKRVEIGLTYIYGIGLSRSKEILAETGVNPDTRVKDLTDADVAALRSVIQTNYQVEGDLRRLEAMSIKRLMDIGTYRGRRHRMGLPVRGQRTRTNARTRRGVRRTVAGKKKAASKK

SEQ ID NO: 541 - protein, 130 aa, Agaricus bisporus
  source: /note="var. bisporus"
  source: /note="strain H97 / ATCC MYA-4626 / FGSC 10389"
MVRISVLNDCLKSICNASRRGKRQVIVRPSSKVVVKFLSVMQRHGYIGEFEIIDDHRGGKIIVQLNGRLNKTGVISPRFNVQHNRIEQWINYLLPSRGIGIIVLTTSSGILDHEEARRKNVGGKLLGYVY

SEQ ID NO: 542 - protein, 138 aa, Agaricus bisporus
  source: /note="var. bisporus"
  source: /note="strain H97 / ATCC MYA-4626 / FGSC 10389"
MSGKGKSGKSSSGGKAGGEGKSQSRSAKAGLQFPVGRVHRLLKKGNYAQRVGAGAPVYLAAVLEYLAAEILELAGNAARDNKKQRIVPRHLQLAIRNDEELNKLLGDVVISQGGVVPHIAAELLPSKSSKGKKDGEEA

SEQ ID NO: 543 - protein, 142 aa, Agaricus bisporus
  source: /note="var. bisporus"
  source: /note="strain H97 / ATCC MYA-4626 / FGSC 10389"
MSYTITIRVYQTDPNAFFRRVEQTCWKYANGCTWDEAKGEYVLTMGGSGTSGSLRFVSDTGERFVATFGVHNWKRWCDIVTNLTDEQTALVINQEYYGVPYRDAARERQLTSYSVSDREGRKYTINYTVTDGNNLKANLIIG

SEQ ID NO: 544 - protein, 142 aa, Gadus morhua
MGTRLHQTNTMKFAALALALLLAVGSHAAAMQSDAPSQLAHIRSAVGMYLDQVKDSAARSLDHLDGTEYESYKAQLATSLDSLQASIKTAQAGAEPYTDAAVAQVMEATTEVRASIMADIETLRTGPGPKREALKKVVDGHI

SEQ ID NO: 545 - protein, 148 aa, Saccharomyces cerevisiae
  source: /note="strain ATCC 204508 / S288c"
MLSRAIFRNPVINRTLLRARPGAYHATRLTKNTFIQSRKYSDAHDEETFEEFTARYEKEFDEAYDLFEVQRVLNNCFSYDLVPAPAVIEKALRAARRVNDLPTAIRVFEALKYKVENEDQYKAYLDELKDVRQELGVPLKEELFPSSS

SEQ ID NO: 546 - protein, 150 aa, Saccharomyces cerevisiae
  source: /note="strain ATCC 204508 / S288c"
MCSAGGIRRPIQIEEFKTAISGMSDMELAQIKTEIENSINHLQRSNARLGKYIAKLEGADDRLEADDSDDLENIDSGDLALYKDSVRENEIVLNNYNERVDALEQETVYRKTGHGKSKHEVEAKDNTNKGPDVDMDNSNVDVVTPNSIFI

SEQ ID NO: 547 - protein, 152 aa, Cicer arietinum
MEGAKKAGESIKETAANVGASAKSGMEKTKAVVQEKTEKMKTRDPVEKEMATHKKDVKMTQAELDKQAAREHNAAVKQSTTEGQMGHTTGAHPMSALPGHGTGHPMGHTTEGVVGSHPIGTNRGPDGTATAHNTRVGGNPNATGYTTGGSYT

SEQ ID NO: 548 - protein, 40 aa, Ovis aries
MILGQNGISDVVKVTLTHEEEACLKKSADTLWGIQKELQF

SEQ ID NO: 549 - protein, 62 aa, Saccharomyces cerevisiae
  source: /note="strain ATCC 204508 / S288c"
MSAWRKAGISYAAYLNVAAQAIRSSLKTELQTASVLNRSQTDAFYTQYKNGTAASEPTPITK

SEQ ID NO: 550 - protein, 72 aa, Arthrospira platensis NIES-39
MAVEKVNSSSSLAEVIDRILDKGIVIDAWVRVSLVGIELLSVEARVVIASVETYLKYAEAVGLTAQAAVPSV

SEQ ID NO: 551 - protein, 79 aa, Zea mays
MELSRKLFTAVLLVMLLLLSAEVGPVAVAEARTCQSQSHRFRGPCLRRSNCANVCRTEGFPGGRCRGFRRRCFCTTHCH

SEQ ID NO: 552 - protein, 79 aa, Saccharomyces cerevisiae
  source: /note="strain ATCC 204508 / S288c"
MSNMMNKFAEKLQGNDDSHQKGKNAKSSNKERDDMNMDMGMGHDQSEGGMKMGHDQSGTKMNAGRGIANDWKTYENMKK

SEQ ID NO: 553 - protein, 89 aa, Arthrospira platensis
  source: /note="str. Paraca"
MADSSKSKPQDDKTPIEDKKSATKADTTPAKSSTPKDHEPVVEAKPAAKTPEPKPEPKPEPVAAKTPEPKPEPKPEPKPEPVAAKPPEP

SEQ ID NO: 554 - protein, 124 aa, Agaricus bisporus
  source: /note="var. bisporus"
  source: /note="strain H97 / ATCC MYA-4626 / FGSC 10389"
MNGGRNKKGRGHVKFMRCSNCSRCVGKDKAIKRFTVRNMVESAAVRDINEASVYPEYVIPKLYIKIAYCVSCAIHSHVVRVRSREGRRNRAPPPRIRWKDGKKVNPAVAAAEDAKAAAAGGAKA

SEQ ID NO: 555 - protein, 128 aa, Arthrospira platensis NIES-39
MQAQEIIRAIEQEEIESVKTNVQKESIPKIYVGDTVKVGVRITEGGKERIQPYQGTVIAMRNGGINETITVRRIFQGVGVERVFLLHSPRIASIKVIMRGKVRRAKLYYLRDRVGKATRVPQRFDRPL

SEQ ID NO: 556 - protein, 132 aa, Zea mays
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRDDGPRPGQGPPRPGGAAPAAAAAAAPRT

SEQ ID NO: 557 - protein, 140 aa, Bos taurus
MNPLWTLLFVLSAPRGVLSQVQLRESGPSLVKPSQTLSLTCTVSGFSLSSNGVVWVRQAPGKALEWLGGICSGGSTSFNPALKSRLSITKDNSKSQVSLSVSSVTPEDTATYYCARDTEQVQMVIDSWSPLRGLPLLVAV

SEQ ID NO: 558 - protein, 153 aa, Saccharomyces cerevisiae
  source: /note="strain ATCC 204508 / S288c"
MSQKACYVCGKIGHLAEDCDSERLCYNCNKPGHVQTDCTMPRTVEFKQCYNCGETGHVRSECTVQRCFNCNQTGHISRECPEPKKTSRFSKVSCYKCGGPNHMAKDCMKEDGISGLKCYTCGQAGHMSRDCQNDRLCYNCNETGHISKDCPKA

SEQ ID NO: 559 - protein, 153 aa, Oryza sativa
  source: /note="subsp. japonica"
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 560 - protein, 95 aa, Brassica oleracea
MAGIINKIGDALHIGGGNKEDEHKKEEHKKHADEHKSGEHKEGIVDKIKDKIQGGEGHSSGDHKHDGEKKKKKDKKEKKHHHDGHHSSSSDSDSD

SEQ ID NO: 561 - protein, 124 aa, Arthrospira platensis NIES-39
MTLLGNIIWLIFGGFLSGLGYIIGGITICLSIIGIPFGIQAIKLGFATMTPFGKESVVSPDSSNLLTMIFNVVWVIFFGWEIALSHLLHGLILAITIIGIPFAKQHFKLIPMALLPFGREFRDI

SEQ ID NO: 562 - protein, 124 aa, Lactobacillus acidophilus
  source: /note="strain 30SC"
MKKFASFVLGAVAGCAAGFLAGSLLVSDEQVDDVKNKIKDNDKLQDLKKKYDNGTEIVKNQLASFPKNVEDDSELKDFDDIVIDDSNKDDDVTAGDNAQESVDDLNNAEEEHNAEDAEEDKPEA

SEQ ID NO: 563 - protein, 146 aa, Oryza sativa
  source: /note="subsp. japonica"
MPRGGFSGSISSPRIDVAIDMGNPFLNRTVDGFLKIGAVGACKVAAEDTFDCLHRGDVSKHKLEHMLKKMCKEGAYWGTVAGVYVGMEYGVERIRGRHDWKNAMIGGALSGALISAASNNHKDKIIKDAITGGAVATAVEFINYLT

SEQ ID NO: 564 - protein, 152 aa, Zea mays
MAPKAEKKPAAKKPAEEEPAAPAEKAPAGKKPDLIKRLPAGKSAGKEGGVDKKGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 565 - protein, 255 aa, Vitis vinifera
MAEHAEGSGAASESLLEKITDKLQGHDSSSSGSDSDSDKPASPSPIKAKVFRLFGREKPVHTVLGGGKHADVFLWRNKKISAGVLGGATAMWVLFELLEYHLLTLVCHILILSLAILFLWSNATTFINKSPPRIPEVHIPEDPFLQAVNALRIEINCGFAVLRDIASGRDLKKFLIIIAGLWVLSILGSCCNFLTLFYITFVLLHTVPVIYEKYEDRIDPFAEKATIEIKKQYAVFDAKVLSKIPKVPLKYKKMA

SEQ ID NO: 566 - protein, 205 aa, Solanum tuberosum
MAVHKQVSLFAYLLVLGMLLFVSAMEHADAKACTKECGNLGYGICPRSEGSPENPICTNCCAGYKGCNYYSANGTFICEGESDPKKPKVCPLNCDPHIAYSKCPRSGGNTLIYPTGCTTCCTGYKGCYYFGKDGKFVCEGESIEPKACTLECDSRVAYMTCPSSGLAKIYQVCVNCCTAGEGCKLYGHDGSLICTGEPQSYISTT

SEQ ID NO: 567 - protein, 204 aa, Zea mays
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 568 - protein, 152 aa, Zea mays
MSLIAGEDFQHILRLLNTNVDGKQKIMFAMTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 569 - protein, 152 aa, Gallus gallus
MVHATSPLLLLLLLSLALVAPGLSARKCSLTGKWTNDLGSNMTIGAVNSRGEFTGTYITAVTATSNEIKESPLHGTQNTINKRTQPTFGFTVNWKFSESTTVFTGQCFIDRNGKEVLKTMWLLRSSVNDIGDDWKATRVGINIFTRLRTQKE

SEQ ID NO: 570 - protein, 145 aa, Saccharomyces cerevisiae
  source: /note="strain ATCC 204508 / S288c"
MFLRNSVLRTAPVLRRGITTLTPVSTKLAPPAAASYSQAMKANNFVYVSGQIPYTPDNKPVQGSISEKAEQVFQNVKNILAESNSSLDNIVKVNVFLADMKNFAEFNSVYAKHFHTHKPARSCVGVASLPLNVDLEMEVIAVEKN

SEQ ID NO: 571 - protein, 145 aa, Odocoileus virginianus
MLTAEEKAAVTGFWGKVNVDVVGAEALGRLLVVYPWTQRFFEHFGDLSSAGAVMGNPKVKAHGKRVLDAFSEGLKHLDDLKGAFAELSELHCNKLHVDPENFRLLGNVLVVVLARNFGGEFTPLVQADFQKVVAGVANALAHRYH

SEQ ID NO: 572 - protein, 142 aa, Solanum tuberosum
MAPKAAAEKKPAEKKPTEEKKAEKTPKAGKKLPKESGSSGADKKKKRSKKSVETYKIYIFKVLKQVHPDIGISSKSMGIMNSFINDIFEKLAQESSRLARINKKPTITSREIQTAVRLVLPGELAKHAVSEGTKAVTKFTSS

SEQ ID NO: 573 - protein, 139 aa, Cicer arietinum
MAPAKAEKKPAEKKPAAEKAPAEKKPKAEKKISKEGTSDKKKKRVKKSVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 574 - protein, 135 aa, Lactobacillus acidophilus
  source: /note="strain 30SC"
MPTINQLVRKGRHSKVTKSKSPALNYSYNSMKKESVFNPAPQMRGVATRVGTMTPKKPNSALRKYARVRLSNLIEVTAYIPGEGHNLQEHSVVLIRGGRVKDLPGVRYHIVRGALDTAGVDGRKQSRSKYGAKKD

SEQ ID NO: 575 - protein, 135 aa, Zea mays
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRRDRKPPERFRRREDRPAGGQGGPRPGPGAAATAPAPAPVAARP

SEQ ID NO: 576 - protein, 135 aa, Agaricus bisporus
  source: /note="var. bisporus"
  source: /note="strain H97 / ATCC MYA-4626 / FGSC 10389"
MFSKVYLVASTLIAVAVAQAPLQCYQGVPTSAGPATDCSRFVNTFCDAAAAVPAVRIDDSVSRCFNLPDAKVCDFIAWNTFTRNVPPSAANCKSVLNKVISQCVLGGYGQVGPNAYTFTVDVNHGQCGHDVHGGS

SEQ ID NO: 577 - protein, 131 aa, Saccharomyces cerevisiae
  source: /note="strain ATCC 204508 / S288c"
MSSAAEKKPASKAPAEKKPAAKKTSTSVDGKKRSKVRKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 578 - protein, 123 aa, Zea mays
MARIKVHELRGKSKADLQAQLKEFKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 579 - protein, 120 aa, Zea mays
MVQRLTYRKRHSYATKSNQTRVVKTPGGKLVYQYTKKRASGPKCPVTGKKIQGIPHLRPAEYKRSRLSRNRRTVNRPYGGVLSGTAVRERIIRAFLVEEQKIVKKVLKLQKTKDKTSSKK

SEQ ID NO: 580 - protein, 118 aa, Lactobacillus acidophilus
  source: /note="strain 30SC"
MPRVKGGIVTRKRRKKVMKLAKGYRGAKHMQFKAASTQLFVSYKYAFRDRRRRKSEFRKLWIARINAAARQNDISYSKLMHGLKLAGVDMNRKMLADIAYNDSKTFAQLAETAKKALN

SEQ ID NO: 581 - protein, 118 aa, Arthrospira platensis NIES-39
MPKRQRKLAPPRGYKMHVKKGDTVQVIAGRDKGKVGEVISTLPKLSKVVVRDVNVRTKHVKPQQEGEGGRIVNFEAPIHSSNVMLYSTKEKVASRVSYTFTEDGRKVRMLKKTGEVID

SEQ ID NO: 582 - protein, 114 aa, Agaricus bisporus
  source: /note="var. bisporus"
  source: /note="strain H97 / ATCC MYA-4626 / FGSC 10389"
MQPKAAASKTPAVKHKFVIDYSKPAADGVFDGADFEKFLHDRIKVEGKAGQLGDHVKITRDGNTKITVTSNIPFSKRYLKYLTKKFLKKNTLRDWIRVVASSKDNYQLRFYNIA

SEQ ID NO: 583 - protein, 111 aa, Zea mays
MAPPQPKSGLFVGINKGHVVTKRELPLRPSHRKGKATKRVSMVRGLIREVAGFAPYEKRITELLKVGKDKRALKLAKRKLGTHKRAKKKREEMMGVLRKMRSAGTHTDKKK

SEQ ID NO: 584 - protein, 109 aa, Meleagris gallopavo
MGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 585 - protein, 108 aa, Vaccinium corymbosum
MAGIMNKIGETLHMGGGKKEEDKNKVGEQHQQQQYNKPDQHQGQYGQDQQQHKEGGGFMDKVKDKIPGVGGAGGAGHENKGGEKKKKKDKKKHEDGHDHGHSSSSDSD

SEQ ID NO: 586 - protein, 107 aa, Arthrospira platensis C1
MSGFIRGLFGRKSETTKTQGSSFYLDPDSAKSLGDIEYMRKPLEVKKSFPKMSGGKPFEAPKATAKPAMEMTQPKATESPAPEVKSDRRRADSSLDMFRNMARDLKK

SEQ ID NO: 587 - protein, 106 aa, Saccharomyces cerevisiae
  source: /note="strain ATCC 204508 / S288c"
MSTLLKSAKSIVPLMDRVLVQRIKAQAKTASGLYLPEKNVEKLNQAEVVAVGPGFTDANGNKVVPQVKVGDQVLIPQFGGSTIKLGNDDEVILFRDAEILAKIAKD

SEQ ID NO: 588 - protein, 106 aa, Agaricus bisporus
  source: /note="var. bisporus"
  source: /note="strain H97 / ATCC MYA-4626 / FGSC 10389"
MGSTRLYSKGRVLGHKRAKRNSRPNTSLIQIEGVATKEDAQFYLGKRIAYVYKAKREIQGSKVRVIWGRITRPHGSSGVVKSKFRSNLPPRAFGASVRVMLYPSNI

SEQ ID NO: 589 - protein, 93 aa, Saccharomyces cerevisiae
  source: /note="strain ATCC 204508 / S288c"
MLRTTFLRTPRQLMRKSPRASFSIVTRAAFPHLKNNQDEAEKKEQGLFDSNKKRLDTLEHGKNPDYKQPGMEDLKKKGDDARIEQNRPDDGVY

SEQ ID NO: 590 - protein, 91 aa, Lactobacillus acidophilus
  source: /note="strain 30SC"
MANKAELVSEVASKTKLTKKEVAAAVDAIFGSIQDNLAKGEKVQLIGFGTFEVRHRAARKGRNPQTGDEIEIPASEVPAFKPGKALKEAVK

SEQ ID NO: 591 - protein, 86 aa, Saccharomyces cerevisiae
  source: /note="strain ATCC 204508 / S288c"
MLNRCISRNTRLPVNLRIASRFYSDGPLGGAGPGNPQDIFIKRERAKEDYYARQQEREQLAHVKEQLKEHKKKLENLENKINNLSK

SEQ ID NO: 592 - protein, 84 aa, Zea mays
MAQTVVLKVGMSCEGCVGAVKRVLGKMEGVESYDVDIMEQKVTVKGNVTPDAVLQTVSKTGKKTSFWEAEAVTSESATPAGATA

SEQ ID NO: 593 - protein, 82 aa, Arthrospira platensis NIES-39
MAGTTGERPFGDIITSVRYWVIHSLTIPALFIAGWLFVSTGLAYDAFGTPRPNEYFTQERQELPIITERQDSKTQIQQFIAK

SEQ ID NO: 594 - protein, 78 aa, Solanum lycopersicum
MAQSIRFFATLFLLAMLVMATEMGPTRIVEARHCESLSHRFKGPCVSDKNCASVCETERFSGGNCRGFRRRCFCTKPC

SEQ ID NO: 595 - protein, 78 aa, Solanum tuberosum
MALSMRFFATFFLLAMLVMATEMGPMRIAEARNCESLSHRFKGPCTRDSNCASVCETERFSGGNCHGFRRRCFCTKPC

SEQ ID NO: 596 - protein, 74 aa, Cicer arietinum
MDKKSLAGLCFLFLVLFVAQEIAVSEAARCENLADTYRGPCFTTGSCDDHCKNKEHLVSGRCRDDFRCWCTKNC

SEQ ID NO: 597 - protein, 74 aa, Glycine max
MERKTFGFLFLLLLVLASDVTVKRAEAKDCLTRRHGFQGRCLFDRQCAHVCRSDGFIGGQCRGPLRKCFCSRPC

SEQ ID NO: 598 - protein, 70 aa, Linum usitatissimum
MSRRCPGKNAWPELVGKSGNMAAATVERENRNVHAIVLKEGSAMTKDFRCDRVWVIVNDHGVVTSVPHIT

SEQ ID NO: 599 - protein, 314 aa, Agaricus bisporus
  source: /note="var. bisporus"
  source: /note="strain H97 / ATCC MYA-4626 / FGSC 10389"
MSESLRYLGSLEGHKGWVTAIATSSENPDMILTASRDKTIIVWQLTREDDSYGYPKRILHGHNHFVSDVVISSDGQFALSSSWDHTLRLWDLNTGVTTRRFVGHSSDVLSVSFSADNRQIVSGSRDRTIKLWNTLGECKFDIKEDGHSEWVSCVRFSPNVANPVIVSAGWDKVVKVWELSKFKLKTNHYGHTGYINTVSVSPDGSLAASGGKDGITMLWDLNEGKHLYSLEAGDVVNALVFSPNRYWLCAATASCVKIFDLESKSIVDELKPTYTDVGEDARQPECVSIAWSADGQTLFTGYTDNAVRVWIVTS

SEQ ID NO: 600 - protein, 312 aa, Meleagris gallopavo
MAAEYSCEYGSLKFYALCGVGGVLSCGLTHTAVVPLDLVKCRMQVDPQKYKSIFNGFSVTIKEDGFRGLAKGWAPTFIGYSMQGLCKFGFYEVFKILYGNMLGEENAYLWRTSLYLAASASAEFFADIALAPMEAAKVRIQTQPGYANTLRQAVPKMFGEEGIWAFYKGVAPLWMRQIPYTMMKFACFERTVEALYKYVVPKPRSECTKGEQLIVTFIAGYIAGVFCAIVSHPADSVVSVLNKEKGSSASQVLKRLGFRGVWKGLFARIIMIGTLTALQWFIYDSVKVYFRLPRPPPPEMPESLKKKLGLTQ

SEQ ID NO: 601 - protein, 308 aa, Agaricus bisporus
  source: /note="var. bisporus"
  source: /note="strain H97 / ATCC MYA-4626 / FGSC 10389"
MTRSWEPGTQYNLGDVVEYNGDEYKIIQAHSSQSDWAPDRTPALWGKLPHRHHQQGQYQQQQECQPQQPQKTCYDYGKQEQAPQHSDSKEKKNWFGNITESQKQALEVGGGVALGAGLLGGAFAAWKHHQHKEEAHDSFEAWANAARSRAEEFRAKGPQGPATWVYNEGKHIPEQAILVGTEHNWNLYICRAYCDGGVQIGKASDVFKKGAVIGYKEDEHHLDKYEILLGDMRGLKWVQTGNSLDLASLGATPVEGGYENDHTRLYIARAFHKGAKHPGKVSERLDGAYIPYDGKEKCVKEYEVLCYL

SEQ ID NO: 602 - protein, 301 aa, Lactobacillus acidophilus
  source: /note="strain 30SC"
MKSYMKKIAAVVAVAGVALSTAACSNGGSNSTVASYKGGKITQQQYYDEMKKSQAGKSTLANMIINRALEQQYGKYVSSKKVDKQYNNYKKQYGSQFSAVLQQNGMTASSFKENLKTNLLSEQALKHIKKISKKQEQQAWKSYQPKVTVQHILVAKKSTAQSIIKQLKDGKSFKSLAKKYSLDTATKNKAGKLPAFDSTDNTLDSSFKTAAFKLKTGEVTSTPVKSQSGYHVIKMISHPAKGKFADHKKAIDDEIYASMAQDQATMKDVISTVLKRADVSIKDSDLKDVLASYVSTTSATK

SEQ ID NO: 603 - protein, 297 aa, Saccharomyces cerevisiae
  source: /note="strain ATCC 204508 / S288c"
MVVIANAHNELIHDAVLDYYGKRLATCSSDKTIKIFEVEGETHKLIDTLTGHEGPVWRVDWAHPKFGTILASCSYDGKVLIWKEENGRWSQIAVHAVHSASVNSVQWAPHEYGPLLLVASSDGKVSVVEFKENGTTSPIIIDAHAIGVNSASWAPATIEEDGEHNGTKESRKFVTGGADNLVKIWKYNSDAQTYVLESTLEGHSDWVRDVAWSPTVLLRSYLASVSQDRTCIIWTQDNEQGPWKKTLLKEEKFPDVLWRASWSLSGNVLALSGGDNKVTLWKENLEGKWEPAGEVHQ

SEQ ID NO: 604 - protein, 294 aa, Agaricus bisporus
  source: /note="var. bisporus"
  source: /note="strain H97 / ATCC MYA-4626 / FGSC 10389"
MSIPQPVPVSWKDFGKAANDLLGRDYYFQGSSLEVKTKTPSNVAFKVAGSRDAKSDAIAADLEAKWTDKKHGLTVTQAWTTSNILRNLVEVEDQIAKGVKFDLSTSLSPEKGTKTAVLNAALKQPGFHTRASLDVFRGPTFTADAVVGRDNLFLGAEAAYNVTEGNVSRYATAIGYLSHDYSITVHALNNLNTYHASYHQRISDSTEAGAKAVYDTKATHGGVALEVGAKTVLDQSSYLKAKINNTGVLALAYSQALRPGVRATFGLAVDTQKLNDVSPSGPAHKVGVHFVFDS

SEQ ID NO: 605 - protein, 288 aa, Agaricus bisporus
  source: /note="var. bisporus"
  source: /note="strain H97 / ATCC MYA-4626 / FGSC 10389"
MLEFTLNDGNRIPAIAFGTGTALYNQDASAFVRLAIETGITHLDGAQMYENEETLGKGIKSSGKPRSELFITTKLHILKPGQTVRETLVESLGKIGVDYVDLFLIHDPTANRKEATLSEIWSQLEALKNEGLTKSIGVSNFKVEDLNEILPGAKIIPAVNQIEFHPYVLKAASPIIELCKAKGIIVASYGGQTPIVRATDGPLKDLLPKIRERLEQTRGSPVTEGQVLTKWLLQKNVIAISTSSKESRIKEFLSTVDVPDLTKQEIESIDNAGSTIHKRIYMKHIFNE

SEQ ID NO: 606 - protein, 285 aa, Glycine max
MASEGDHHHHHHHHQDHDHHHHDHDHHHHHDGEGETNSWVGKDGKVYHSHDGLAPHSHEPIYSPGYFTRRAPPLLNRNFNERAFTVGIGGPVGTGKTALMLALCELLRENYSLAAVTNDIFTKEDGEFLVKHKALPEERIRAVETGGCPHAAIREDISINLGPLEELSNLFKADILLCESGGDNLAANFSRELADYIIYIIDVSGGDKIPRKGGPGITQADLLVINKTDLAPAIGADLAVMQRDALRMRDGGPFVFAQVKHKIGVEEIGNLVLQAWEAATGNKRH

SEQ ID NO: 607 - protein, 284 aa, Arthrospira platensis C1
MALQDDWQQSHLERRQVLAESQKQIWATIGLWQRERYSQAITQKQDRQAFVSQLKQENQAFLADAHNNHRQQAEQLAEDLKEFVRSLQKETATFLEESAQSRAEKAEELAQELRDFRAELRDTVAQWQQQWQQQDQERAAGRRKLAQQVQGDLQEFNIIRTIMAEKLLQQTQEAKAERLAGIQSMFEDMGKFRMQLQEYRREREKSVWGGERVKSTPATPQKAKASQTLVPQTKPKAVKSAPSTTTAAQSTTPTAVVVAEPTKPAVPPNQPKPTTVVPHPPNPG

SEQ ID NO: 608 - protein, 280 aa, Bos taurus
MSEAFDCAKCSESLYGRKYIQTDDGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSREDDPYCVTCFGELFAPKCSSCKRPITGLGGGKYVSFEDRHWHHSCFSCARCSTSLVGQGFVPDGDQVLCQGCSQAGP

SEQ ID NO: 609 - protein, 273 aa, Saccharomyces cerevisiae
  source: /note="strain ATCC 204508 / S288c"
MSNPFDLLGNDVEDADVVVLPPKEIVKSNTSSKKADVPPPSADPSKARKNRPRPSGNEGAIRDKTAGRRNNRSKDVTDSATTKKSNTRRATDRHSRTGKTDTKKKVNQGWGDDKKELSAEKEAQADAAAEIAEDAAEAEDAGKPKTAQLSLQDYLNQQANNQFNKVPEAKKVELDAERIETAEKEAYVPATKVKNVKSKQLKTKEYLEFDATFVESNTRKNFGDRNNNSRNNFNNRRGGRGARKGNNTANATNSANTVQKNRNIDVSNLPSLA

SEQ ID NO: 610 - protein, 268 aa, Saccharomyces cerevisiae
  source: /note="strain ATCC 204508 / S288c"
MVLEATVLVIDNSEYSRNGDFPRTRFEAQIDSVEFIFQAKRNSNPENTVGLISGAGANPRVLSTFTAEFGKILAGLHDTQIEGKLHMATALQIAQLTLKHRQNKVQHQRIVAFVCSPISDSRDELIRLAKTLKKNNVAVDIINFGEIEQNTELLDEFIAAVNNPQEETSHLLTVTPGPRLLYENIASSPIILEEGSSGMGAFGGSGGDSDANGTFMDFGVDPSMDPELAMALRLSMEEEQQRQERLRQQQQQQDQPEQSEQPEQHQDK

SEQ ID NO: 611 - protein, 264 aa, Oryza sativa
  source: /note="subsp. japonica"
MSTAAARPGRRFTVGRSEDATHPDTIRAAISEFLATAIFVFAAEGSILSLGKLYQDMSTPGGLVAVSLAHALALAVAVAVAVNISGGHVNPAITFGALLGGRLSLIRALFYWLAQLLGAVVATLLLRLTTGGMRPPGFALASGVGDWHAVLLEATMTFGLMYAYYATVIDPKRGHVGTIAPLAVGFLLGANMLAGGPFDGAGMNPARVFGPALVGWRWRHHWVYWLGPFVGAGLAGLLYEYLVIPSADAAPHGGAHQPLAPEDY

SEQ ID NO: 612 - protein, 261 aa, Oryza sativa
  source: /note="subsp. japonica"
MICLRAAFPLTSSPLRRLALKPSSSRAAAAAMSSAIAAPVEHIVLIKVRPEAASSGAAAAMVSSLQALSTAVPGLSYIHVGPVLRLRSPAAEALGPTHVLHSRYATKPDLAAYAAHPAHVAAVQGHVLPNALDSTAIDWVNAALVPSPVNPGSAVRLSLAKLKEGVEAHQLAEKLAAATAAAGEAKGAKVSFGENFSPARAKGYQFGMVAVFDSVEGLDAVDGDGKVEAAKAIVRPLLDDVLELEFVVGPAAAEAPAPANL

SEQ ID NO: 613 - protein, 255 aa, Arthrospira platensis C1
MGLFDRIGRVVRANLNDLVNKAEDPEKILEQAVIEMQEDLIQLRQAVAQTIAQQKRSQQQYNQAQSQANQWQSRAQLALQKGDENLAREALQRKKGYLETANTLEISLRQQTEQVETLKRNLVSLESKISEAKTKKNMLKARAQAAKANEQLNNVLGGINTSSATSVFERMEEKVMIQEAKSQAAAELMGSGLEEQFRALEEGSDVDDELAAMKAQLAGAPANQPQLSPSAPTDSSTSNPEIDNELEELRRELNK

SEQ ID NO: 614 - protein, 250 aa, Agaricus bisporus
  source: /note="var. bisporus"
  source: /note="strain H97 / ATCC MYA-4626 / FGSC 10389"
MARIFCIPAVAIIFAAFVLNLIVSISLPYLPALDFTRTHFQQVASENGQNNISQLRFGIWAPCSYNEAGDRTCVKQGHAYGVTVANQQTDQVTIAPSWTRGLAIHPVAAVVSLLAVLLALSQHLTIALWATLIAWLAGLITFIAFLCDVVLFAHTRTQFKKLNLGTRTIPGPGFWITLVAMILLFLGGITTCLGRIKDRRTGHKDFAAMSSARTQALKADEIHDKKYGHSDDIELTGPKHWASKFKFNKH

SEQ ID NO: 615 - protein, 51 aa, Vitis vinifera
MAGIIHKIEETLHMGGGRKEEEEKRKGEGQGHGGYKGEGQGHGGYKGEGQG

SEQ ID NO: 616 - protein, 100 aa, Saccharomyces cerevisiae
  source: /note="strain ATCC 204508 / S288c"
MTVKTGIAIGLNKGKKVTSMTPAPKISYKKGAASNRTKFVRSLVREIAGLSPYERRLIDLIRNSGEKRARKVAKKRLGSFTRAKAKVEEMNNIIAASRRH

SEQ ID NO: 617 - protein, 98 aa, Arthrospira platensis NIES-39
MNKEQLVQETSIKAGVTKKQADAIISAICECIMDAVADGEKVTLVGFGSFEARHRKAREGRNPSTGQPMTIPATTVPAFSAGKAFKERVANESNENVA

SEQ ID NO: 618 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 619 - protein, 146 aa, Linum usitatissimum
MAPKAAEKKPAEKKPAEEKKAEKAPAEKKPRAEKKLPKEGGAAAADKKKKRNKKNVETYKIYIFKVLKQVHPDIGISSKAMGIMNSFINDIFEKLAAESSRLARYNKKPTITSREIQTAVRLVLPGELAKHAVSEGTKAVTKFTSS

SEQ ID NO: 620 - protein, 143 aa, Saccharomyces cerevisiae
  source: /note="strain ATCC 204508 / S288c"
MSDVEEVVEVQEETVVEQTAEVTIEDALKVVLRTALVHDGLARGLRESTKALTRGEALLVVLVSSVTEANIIKLVEGLANDPENKVPLIKVADAKQLGEWAGLGKIDREGNARKVVGASVVVVKNWGAETDELSMIMEHFSQQ

SEQ ID NO: 621 - protein, 142 aa, Solanum tuberosum
MSSGGGSGKGGAGRGKPKASKSVSRSSKAGLQFPVGRIARFLKNGKYAERVGAGAPVYLSAVLEYLAAEVLELAGNAARDNKKNRIVPRHIQLAVRNDEELSKLLGQVTIANGGVLPNIHQNLLPRKAGSGKGDIGSASQEF

SEQ ID NO: 622 - protein, 139 aa, Oryza sativa
  source: /note="subsp. japonica"
MASEGAVSPAFAYTVVYVKDVAKSAAFYSAAFGYTVRRLDQSHKWAELESGTTTIAFTPLHQRETDALTGAVQLPDSAGERGPVEICFDYADVDAAYRRAVDSGAVPVSPPEQKSWGQKVGYVRDIDGIIVRMGSHVRA

SEQ ID NO: 623 - protein, 138 aa, Solanum lycopersicum
MKPAEKKPAEKTPVAEKAPAEKKPKAGKKLPKDAAAGDKKKKRSKKAVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 624 - protein, 134 aa, Arthrospira platensis NIES-39
MSEKTDQILEQLKSLSLLEASELVKQIEEAFGVDASASAGGGMMMMAAPGMAAPGAEAAAEEEKTEFDVILTEFPADKKIAVLKVVRSITGLGLKEAKDLVESAPKAIKEATTKEDAESIKKQLEESGAKVEVK

SEQ ID NO: 625 - protein, 132 aa, Glycine max
MPFKRYVEIGRVAQINYGKEYGRLVVIVDVIDQNRALVDAPDMVRSQVNFKRLSLTDIKIDIKRVPKKKDLVKAMEDADVKTKWEKSSWGRKLIVRKRRASLNDFDRFKIMLAKIKKAAVVRQELAKLRKSA

SEQ ID NO: 626 - protein, 132 aa, Lactobacillus acidophilus
  source: /note="strain 30SC"
MVMTDPIADYLTRIRNANMAKHDSVEIPASNIKKSISEILKREGFIRDYEVADDNKQGVIKVFLKYGPNGERVISGLKRISKPGLRNYVSAEDLPKVLNGLGIAIVSTSAGVITDKEARQKNVGGEVIAYIW

SEQ ID NO: 627 - protein, 123 aa, Oryza sativa
  source: /note="subsp. japonica"
MSEKKRGAGTRKDEVVTREYTINLHKRLHGCTFKKKAPNAIKEIRKFAQKAMGTTDIRIDVKLNKAIWTNGIRSVPRRVRVRISRKRNDEEDAKEELYSLVTVAEIPAEGLKGLGTKVVEDEE

SEQ ID NO: 628 - protein, 121 aa, Saccharomyces cerevisiae
  source: /note="strain ATCC 204508 / S288c"
MSDFQKEKVEEQEQQQQQIIKIRITLTSTKVKQLENVSSNIVKNAEQHNLVKKGPVRLPTKVLKISTRKTPNGEGSKTWETYEMRIHKRYIDLEAPVQIVKRITQITIEPGVDVEVVVASN

SEQ ID NO: 629 - protein, 119 aa, Saccharomyces cerevisiae
  source: /note="strain ATCC 204508 / S288c"
MPKKRASNGRNKKGRGHVKPVRCVNCSKSIPKDKAIKRMAIRNIVEAAAVRDLSEASVYPEYALPKTYNKLHYCVSCAIHARIVRVRSREDRKNRAPPQRPRFNRDNKVSPAAAAKKAL

SEQ ID NO: 630 - protein, 117 aa, Bos taurus
MQAVLTQPPSVSGSLGQRVTISCTGSSSNIGGGNCVGWYQQIPGSAPKTLIYRSTSRPSGVPDRFSGSRSGNTATLTISSLQAEDEADYYCATYESSSYHGTVLQGKGNLEYSTMFK

SEQ ID NO: 631 - protein, 116 aa, Lactobacillus acidophilus
  source: /note="strain 30SC"
MARIAGVDLPRDKRIVVALTYIYGIGDTTAKKICADAGVSEDVRSKDLTPEDQEKLRAEVDKYRVEGDLRREVSMNIKRLVDIGSYRGIRHRRGLPVRGQNTKNNARTRKGTKRNR

SEQ ID NO: 632 - protein, 111 aa, Saccharomyces cerevisiae
  source: /note="strain ATCC 204508 / S288c"
MSTVTKYFYKGENTDLIVFAASEELVDEYLKNPSIGKLSEVVELFEVFTPQDGRGAEGELGAASKAQVENEFGKGKKIEEVIDLILRNGKPNSTTSSLKTKGGNAGTKAYN

SEQ ID NO: 633 - protein, 109 aa, Saccharomyces cerevisiae
  source: /note="strain ATCC 204508 / S288c"
MSDAGRKGFGEKASEALKPDSQKSYAEQGKEYITDKADKVAGKVQPEDNKGVFQGVHDSAEKGKDNAEGQGESLADQARDYMGAAKSKLNDAVEYVSGRVHGEEDPTKK

SEQ ID NO: 634 - protein, 108 aa, Saccharomyces cerevisiae
  source: /note="strain ATCC 204508 / S288c"
MPPKQQLSKAAKAAAALAGGKKSKKKWSKKSMKDRAQHAVILDQEKYDRILKEVPTYRYVSVSVLVDRLKIGGSLARIALRHLEKEGIIKPISKHSKQAIYTRATASE

SEQ ID NO: 635 - protein, 107 aa, Saccharomyces cerevisiae
  source: /note="strain ATCC 204508 / S288c"
MAESHRLYVKGKHLSYQRSKRVNNPNVSLIKIEGVATPQEAQFYLGKRIAYVYRASKEVRGSKIRVMWGKVTRTHGNSGVVRATFRNNLPAKTFGASVRIFLYPSNI

SEQ ID NO: 636 - protein, 106 aa, Linum usitatissimum
MSGRGKGGKGLGKGGAKRHRKVLRDNIQGITKPAIRRLARRGGVKRISGLIYEETRGVLKIFLENVIRDAVTYTEHARRKTVTAMDVVYALKRQGVPSTVRWLRRP

SEQ ID NO: 637 - protein, 94 aa, Zea mays
MGKGTGSFGKRRNKTHTLCIRCGRRSFHLQKSTCSSCGYPAARIRKYNWSVKAIRRKTTGTGRMRYMRHVPRRFKSNFREGTEAAPKKSAAAAN

SEQ ID NO: 638 - protein, 93 aa, Arthrospira platensis NIES-39
MKTNELVQRVAEKAKLPKKRVRAILDLAFSAISEEIESGQPVVVRGLGKFTLKEQPARTKTNPETGETTEVPARTVVNFRVIKPSKDKEEADS

SEQ ID NO: 639 - protein, 92 aa, Saccharomyces cerevisiae
  source: /note="strain ATCC 204508 / S288c"
MAKRTKKVGITGKYGVRYGSSLRRQVKKLEIQQHARYDCSFCGKKTVKRGAAGIWTCSCCKKTVAGGAYTVSTAAAATVRSTIRRLREMVEA

SEQ ID NO: 640 - protein, 88 aa, Lactobacillus acidophilus
  source: /note="strain 30SC"
MSETNERNYRHVYQGRVVSDKMDKTIVVVVDTYKNHPVYNKRIKYSKKYYAQDENNEAKVGDTVRIMETRPLSRKKRFRLVKIVKKSV

SEQ ID NO: 641 - protein, 85 aa, Saccharomyces cerevisiae
  source: /note="strain ATCC 204508 / S288c"
MLPRSALARSLQLQRGVAARFYSEGSTGTPRGSGSEDSFVKRERATEDFFVRQREKEQLRHLKEQLEKQRKKIDSLENKIDSMTK

SEQ ID NO: 642 - protein, 83 aa, Saccharomyces cerevisiae
  source: /note="strain ATCC 204508 / S288c"
MADQENSPLHTVGFDARFPQQNQTKHCWQSYVDYHKCVNMKGEDFAPCKVFWKTYNALCPLDWIEKWDDQREKGIFAGDINSD

SEQ ID NO: 643 - protein, 81 aa, Linum usitatissimum
MVGCGRIGKLLLQRLKPFGCNLLYHDRLKMEPELETQIGAKFEEDVDAMLPKCDVVVINTPLTEKTKGMFDKDRILKMKKG

SEQ ID NO: 644 - protein, 77 aa, Arthrospira platensis NIES-39
MVQRGSKVRILRQESYWFQEVGTVVSVDKSGIRYPVIVRFDKVNYNAYCGVDGGVNTNNFAEAELIEVEAPAKAAKK

SEQ ID NO: 645 - protein, 77 aa, Saccharomyces cerevisiae
  source: /note="strain ATCC 204508 / S288c"
MAYTSHLSSKTGLHFGRLSLRSLTAYAPNLMLWGGASMLGLFVFTEGWPKFQDTLYKKIPLLGPTLEDHTPPEDKPN

SEQ ID NO: 646 - protein, 72 aa, Zea mays
MAAAGPGLYSEIGKKARDLLYKDYHTDRGVLHQAAVTQLGKWECLLVTMAWGFLFRILFYFSLVLGSKNKRR

SEQ ID NO: 647 - protein, 71 aa, Arthrospira platensis C1
MALSKIEEARQLNDDDLSEQILEIKKQLANLRLLKATGRLEKPHEIRHTRHRLSQLLTVERERQLPNQSPA

SEQ ID NO: 648 - protein, 69 aa, Arthrospira platensis C1
MKRVHLPTDRETGKFRGFAFVEMNTEEEEIHAIEELDGAEWMGREIRVNLARPREDKKPSDRGGRKPRY

SEQ ID NO: 649 - protein, 257 aa, Oryza sativa
  source: /note="subsp. japonica"
MAAAAAAPALSLAEAAPVTAVLAPCPTPSRTFRRRSWVAAICRPALKCHHSRPLTAVVAAAAAAAAAGDSTSAGVFHGECFVVGDNIDTDQIIPAEHLTLVPSKPDEYRKLGSFAFVGLPTAAYPTPFVAPGEETTRYAVIIGGANFGCGSSREHAPVALGAAGARAVVAEGYARIFFRNSVATGEVYPLELADTGAWKECKTGDVVTVELDNCVMINHTSGKQYKLKPIGDAGPVIEAGGIFAYARKTGMIASKSA

SEQ ID NO: 650 - protein, 52 aa, Gallus gallus
MIRGRPAPEVKWGKVDGEIREAAIIDTTSSFTSLVLDSVNRFDTGKYTLTLE

SEQ ID NO: 651 - protein, 226 aa, Zea mays
MVLLSLEALRKRNVAGPLLLFNLALYVSMLGFASWALNAFVDHIGDHQYYDPPAGAAPRSAGDEAMLHFLQFALLAAVLGSAAKAAAAFHARALWRPQGLAAAAALGTVAWAATALALGLACKEMRAAAAAARGWQMRTLEAVTAVLAVTQLAYVLMLHRAAAAAYADDEADATAYADAGGDQCEPGCSIGTEDDADADCQRAQQQQHGRHHHQPRQGGGPSCSVM

SEQ ID NO: 652 - protein, 83 aa, Glycine max
MCILSFLKSDQSSSYDDDEYSKPCCDLCMCTRSMPPQCSCEDIRLNSCHSDCKSCMCTRSQPGQCRCLDTNDFCYKPCKSRDD

SEQ ID NO: 653 - protein, 141 aa, Bacillus amyloliquefaciens
  source: /note="strain ATCC 23350 / DSM 7 / BCRC 11601 / NBRC 15535 / NRRL B-14393"
MAKKVVKVVKLQIPAGKANPAPPVGPALGQAGVNIMGFCKEFNARTADQAGLIIPVEISVYEDRSFTFITKTPPAAVLLKKAAGIESGSGEPNRNKVATVKRDKVREIAETKMPDLNAADVEAAMRMVEGTARSMGIVIED

SEQ ID NO: 654 - protein, 212 aa, Bacillus amyloliquefaciens
  source: /note="strain ATCC 23350 / DSM 7 / BCRC 11601 / NBRC 15535 / NRRL B-14393"
MLFFIDTANIDEIKEAYELGVLAGVTTNPSLVAKEADVSFHDRLREITEVVKGSVSAEVISLNAEEMIEEGKELAKIAPNITVKIPMTSEGLKAVKALSDLNIKTNVTLIFSANQALLAARAGATYVSPFLGRLDDIGHNGLELISEIRQIFDLHDIDTQIIAASIRHAQHVTEAALRGAHIGTMPLKVIHQLTKHPLTDKGIEQFLADWNK

SEQ ID NO: 655 - protein, 293 aa, Bacillus amyloliquefaciens
  source: /note="strain ATCC 23350 / DSM 7 / BCRC 11601 / NBRC 15535 / NRRL B-14393"
MAITAQQVKELRQKTGAGMMDCKKALTETDGDMDKAIDLLREKGIAKAAKKADRIAAEGSTLIKTDGNKGVILEVNSETDFVAKNEGFKELLNTLADHLLANAPADLEEAMGQKMENGSTVEEYITSNVAKIGEKITLRRFAVITKEDSEAFGAYLHMGGRIGVLSVLSGTTDEDLAKDIAMHVAAVNPRYISRDQVSEEEANHERQILTQQALQEGKPENIVAKMVEGRLNKFFEEICLLDQAFVKNPDEKVKQVVAAKNASVKTYVRYEVGEGIEKRQENFAEEVMNQVKK

SEQ ID NO: 656 - protein, 265 aa, Bacillus amyloliquefaciens
  source: /note="strain ATCC 23350 / DSM 7 / BCRC 11601 / NBRC 15535 / NRRL B-14393"
KEITVQKGDTLWGISQKNGVNLKDLKEWNQLSSDLIIEGEKLTISSVETTTSGQYTVKQGDSLWKIAQKFGTSVNNLKSLNNLQSDIIYAGTTLKVKGQAQAAQPAQEASQPQTEQKPAAETAQPKQEAVQKEQPKQEPVQEQQQPKQEAKAVEAKQQPVQSNTNQQEPKKQLTMTATAYSANDGGISGVTATGVDLNKNPDAKVIAVDPSVIPLGSKVYVEGYGVATAADTGGAIKGNKIDVFVAKKSDANNWGVRTVNVKVLD

SEQ ID NO: 657 - protein, 517 aa, Bacillus amyloliquefaciens
  source: /note="strain ATCC 23350 / DSM 7 / BCRC 11601 / NBRC 15535 / NRRL B-14393"
SGDGKKDTKGQTSLNINIKTEPFSLHPGLANDSVSGGVIRQTFEGLTRVNSKGEPEEGTASKIETSKDGKTYTFTIRDGAKWSNGDPVTAQDFEYAWKWALDPNNESQYAYQLYYIKGAEAANTGKGKLDDVGVKAVNDKTLKVELNNPTPYFLQLTSFYTYMPINKKIAEKHKNWNTNAGDNYVSNGPFKMTAWKHSGSITLEKNDQYWDKDSVKLKKINMVMINNNNTELKKFQAGELNWAGMPLGQLPTESLPTLKKDGSLHVEPIAGVYWYKFNTEAKPLNNVNIRKALAYAIDRSSIVKNVTQGEQIPAMAAVPPSMKGFKDNTKGYFKDNDVKTAKEFLNKGLKELGVKSASDLPAIKLSFNTDDAHAKIAQAVQEMWKKNLGVKVELDNSEWNVYIDKLHSQDYQIGRMGWLGDFNDAINFLELFRDKEGGNNDTGWEDPEFKKLLNQSQLETDPDKRIAELKKAEKIFIDAMPVAPVYFYTDTWVQDKNLKNVIITGTGEVYFRNASFE

SEQ ID NO: 658 - protein, 441 aa, Bacillus amyloliquefaciens
  source: /note="strain ATCC 23350 / DSM 7 / BCRC 11601 / NBRC 15535 / NRRL B-14393"
ETLDSKKAKIESKQSEVASSLEAKEKELSKLQDKQAKIEKELKDINAKALDTSNKIEDKKAENEKTKKQIADLKKEIKETEARIEKRNEILKKRVRSLQENGGSQGYIDVLLGATSFGDFISRATAVSSIVDADKDLIKQQEQDKAKLEDAEAELNVKLKKVQDDLAKLESMQKDLNKQLDQKDKLFDEAKNGQKKAASAISDLKKEASQLANEKADTEKEQKRIKEEQAAAAALIKKQEEAQKASEDQNQKDDSQPAPAVKTVKKAAVSTETSDSSDSSSKPSNSGGSSHNSGGSDDSDGGSVISNSGGIEGAISVGSSLVGQSPYKFGGGRTQSDINNRIFDCSSFVRWAYANAGVNLGPVSGTSTDTLIGRGEAVSASDMKRGDLVFFDTYKTNGHVGIYLGNGTFLNDNTSHGVSIDSMSNPYWKKVFNGNVRRVVQ

SEQ ID NO: 659 - protein, 394 aa, Bacillus amyloliquefaciens
  source: /note="strain ATCC 23350 / DSM 7 / BCRC 11601 / NBRC 15535 / NRRL B-14393"
EVLAASDVTVNVSAEKQVIRGFGGMNHPAWVGDLTAAQRETAFGNGQNQLGFSILRIHVDENRNNWYKEVETAKSAIKHGAIVFASPWNPPNDMVETFNHNGDTSAKRLRYDKYAAYAQHLNDFVTFMKNNGVNLYAISMQNEPDYAHEWTWWTPQEILRFMRENASSINARVIAPESFQYLKNISDPILNDPQALRNMDILGTHLYGTQVSQFPYPLFKQKGAGKDLWMTEVYYPNSDNNSADRWPEALDVSQHIHNSMTEGDFQAYVWWYIRRSYGPMKEDGTISKRGYNMAHFSKFVRPGYVRIDATKNPNPNVYVSAYKGDNKVVIVAINKTNTGVNQNFVLQNGSASQVSRWVTSSSSNLQPGTDLNVTDNHFWAHLPAQSVTTFVVKR

SEQ ID NO: 660 - protein, 234 aa, Bacillus amyloliquefaciens
  source: /note="strain ATCC 23350 / DSM 7 / BCRC 11601 / NBRC 15535 / NRRL B-14393"
AFNDVKSTDATFASGTLDLSAKEQSANVNLSNLKPGDKLTKDFEFRNNGSLAIKEVLMALNFTDFKGAKKGNESAEDFLSQFEITVLTVGKEGGNGYPKNIILKAASLKDLYLMSAKQDKAAAEAISKHIDPKFLSESGKVNVATINGKTAPEYDGVPKTPVDYDQVRMEIRFKNDTAKDANGLSVQNKFQGNAISLQFSFEATQWNGLTITKDHTDKDGYVKENEKAHSEDKN

SEQ ID NO: 661 - protein, 350 aa, Bacillus licheniformis
AQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGTYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 662 - protein, 291 aa, Bacillus amyloliquefaciens
  source: /note="strain ATCC 23350 / DSM 7 / BCRC 11601 / NBRC 15535 / NRRL B-14393"
AFWGASNELLHDPTMAKEGNTWYAFGTGLEGERGLRVLKEGSGGVWTVQKSIFTSPLSWWSNYVPNYGLNQWAPDVQYYNGKYWLYYAVSSFGKNTSAIGLASSTSLSSGNWKDEGLVIRSTSANDYNAIDPELTIDKDGNPWLAFGSFWSGIKLTRLDKNTMKPTGSLYSIAARPNNGGALEAPAITYQNGYYYLMVSFDKCCSGVNSTYKIAYGRSKSITGPYLDKSGKSMSEGGGTILDSGNDRWKGPGGQDIVNGNILVRHAYDAEDSGIPKMLINDINWSSGWPSY

SEQ ID NO: 663 - protein, 314 aa, Bacillus licheniformis
ASALNSGKVNPLADFSLKGFAALNGGTTGGEGGQTVTVTTGDQLIAALKNKNANTPLKIYVNGTITTSNTSASKIDVKDVSNVSIVGSGTKGELKGIGIKIWRANNIIIRNLKIHEVASGDKDAIGIEGPSKNIWVDHNELYHSLNVDKDYYDGLFDVKRDAEYITFSWNYVHDGWKSMLMGSSDSDNYNRTITFHHNWFENLNSRVPSFRFGEGHIYNNYFNKIIDSGINSRMGARIRIENNLFENAKDPIVSWYSSSPGYWHVSNNKFVNSRGSMPTTSTTTYNPPYSYSLDNVDNVKSIVKQNAGVGKINP

SEQ ID NO: 664 - protein, 193 aa, Bacillus licheniformis
  source: /note="strain DSM 13 / ATCC 14580"
AEVVHKTIVVEKGQTYDGKGKRLIAGPELGDGSQREDQKPIFKVEDGATLKNVVLGAPAADGVHTYGNASINNVVWEDVGEDALTVKSEGSVTINGGSARLAADKIFQINKASTFTVKNFTADQGGKFIRQLGGSTFKAVVNIDNCTITNMKEAIFRTDSSTSSVTMTNTRYSKVGQKWIGVKHATERNNHEF

SEQ ID NO: 665 - protein, 538 aa, Bacillus megaterium
  source: /note="strain DSM 319"
HTSSAAPNNVLSTEKYNKEIKSPEFISGKLSGPSSQKAQDVVFHYMNTNKDKYKLGNENAQNSFKVTEVVKDPVEQATVVRLQQVYNNIPVWGSTQLAHVAKDGTLKVVSGTVAPDLDKKEKLKGQKQVDSKKAIQAAEKDLGFKPTYEKSPSSELYVYQNGSDTTYAYVVNLNFLSPEPGNYYYFVDAISGKVLDKYNTIDSVAGPKADVKQAAKPAAKPVTGTNAIGSGKGVLGDTKSLKTTLSSSTYYLQDNTRGATIYTYDAKNRTSLPGTLWTDTDNTYNATRDAAAVDAHYYAGVTYDYYKNKFNRNSYDNAGAPLKSTVHYSSGYNNAFWNGSQMVYGDGDGTTFVPLSGGLDVIGHELTHAVTERSSNLIYQYESGALNEAISDIFGTLVEYYDNRNPDWEIGEDIYTPGTSGDALRSMSNPAKYGDPDHYSKRYTGSSDNGGVHTNSGIINKAAYLLANGGTHYGVTVTGIGGDKLGKIYYRANTLYFTQSTTFSQARAGLVQAAADLYGSGSQEVISVGKSFDAVGVQ

SEQ ID NO: 666 - protein, 431 aa, Bacillus megaterium WSH-002
MPAILDIYAREVLDSRGNPTVEVEVYTESGAFGRALVPSGASTGEYEAVELRDGDKSRYLGKGVLKAVENVNEIIAPELVGMDVTDQIGIDRLMIELDGTENKGKLGANAILGVSMAVAHAAADFVGLPLYRYLGGFNAKQLPTPMMNIINGGSHADNNVDFQEFMILPVGAPTFKEAIRMGAEVFHALKSVLASKGLNTAVGDEGGFAPNLGSNREALEVIVEAITKAGYEAGKDIQLGMDVASSEFFNKETGKYDLAGEGRTGVTSAEMVDFYEQLVNEFPIVSIEDGLDENDWDGHKLLTERIGGKVQLVGDDLFVTNTKKLAQGIEQGVGNSILIKVNQIGTLTETFEAIEMAKRAGYTAVVSHRSGETEDATIADIAVATNAGQIKTGSMSRTDRIAKYNQLLRIEDELGVLAVYDGAKSFYNLKK

SEQ ID NO: 667 - protein, 242 aa, Bacillus amyloliquefaciens
  source: /note="strain ATCC 23350 / DSM 7 / BCRC 11601 / NBRC 15535 / NRRL B-14393"
AGLNKDQKRRAEQLTSIFENGKTEIQYGYVEELDDGRGYTCGRAGFTTATGDALEVVEVYTKAVPNNKLKKYLPELRRLAKDESDDTSNLKGFASAWRSLGNDKAFRAAQDEVNDRLYYQPAMKRSDQAGLKTALAKAVMYDTVIQHGDGDDPDSFYALIKRTNKKMGGSPKDGTDEKKWLNKFLDVRYDDLMNPSDEDTQDEWRESVARVDVFRDIVKAKNYNLDGPIHVRSSEYGNFTIQ

SEQ ID NO: 668 - protein, 256 aa, Bacillus amyloliquefaciens
  source: /note="strain ATCC 23350 / DSM 7 / BCRC 11601 / NBRC 15535 / NRRL B-14393"
KTDAGNVTKGELYTNMKKTAGASVLTQLVQEKVLAKKYKVSDKEIDNKLKEYKTQLGDQYSALKQQYGEDYLKDQVKYELLAQKAAKDNIKVTDSDTKEYYDGLKGKIRASHILVADKKTADEVEKKLKKGEKFETLAKEYSTDSSKDNGGDLGWFDKKSMDETFSKAAFGLKVGQVSDPVKTKFGYHIIKKTEERGKYDDMKKELKEEVLKQKLNDNSAVQAAIQKVMKKADVKVEDKDLKDTFNTSASTSSESK

SEQ ID NO: 669 - protein, 222 aa, Saccharomyces cerevisiae
  source: /note="strain ATCC 204508 / S288c"
MSSSESIRMVLIGPPGAGKGTQAPNLQERFHAAHLATGDMLRSQIAKGTQLGLEAKKIMDQGGLVSDDIMVNMIKDELTNNPACKNGFILFGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 670 - protein, 222 aa, Saccharomyces cerevisiae
  source: /note="strain ATCC 204508 / S288c"
MSSSESIRMVLIGPPGAGKGTQAPNLQERFHAAHLATGDMLRSQIAKGTQLGLEAKKIMDQGGLVSDDIMVNMIKDELTNNPACKNGFILIGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 671 - protein, 222 aa, Saccharomyces cerevisiae
  source: /note="strain ATCC 204508 / S288c"
MSSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGMLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 672 - protein, 222 aa, Saccharomyces cerevisiae; identical to SEQ ID NO: 338
  source: /note="strain ATCC 204508 / S288c"

SEQ ID NO: 673 - protein, 222 aa, Saccharomyces cerevisiae
  source: /note="strain ATCC 204508 / S288c"
MSSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGYLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 674 - protein, 222 aa, Saccharomyces cerevisiae
  source: /note="strain ATCC 204508 / S288c"
MSSSESIRMVLIGPPGAGKGTQAPNLQERFHAAHLATGDMLASQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 675 - protein, 222 aa, Saccharomyces cerevisiae
  source: /note="strain ATCC 204508 / S288c"
MSSSESIRMVLIGPPGAGKGTQAPNLQERFHAAHLATGDMLCSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 676 - protein, 222 aa, Saccharomyces cerevisiae
  source: /note="strain ATCC 204508 / S288c"
MSSSESIRMVLIGPPGAGKGTQAPNLQERFHAAHLATGDMLGSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 677 - protein, 222 aa, Saccharomyces cerevisiae
  source: /note="strain ATCC 204508 / S288c"
MSSSESIRMVLIGPPGAGKGTQAPNLQERFHAAHLATGDMLISQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 678 - protein, 222 aa, Saccharomyces cerevisiae
  source: /note="strain ATCC 204508 / S288c"
MSSSESIRMVLIGPPGAGKGTQAPNLQERFHAAHLATGDMLKSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 679 - protein, 222 aa, Saccharomyces cerevisiae
  source: /note="strain ATCC 204508 / S288c"
MSSSESIRMVLIGPPGAGKGTQAPNLQERFHAAHLATGDMLLSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 680 - protein, 222 aa, Saccharomyces cerevisiae
  source: /note="strain ATCC 204508 / S288c"
MSSSESIRMVLIGPPGAGKGTQAPNLQERFHAAHLATGDMLQSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 681 - protein, 222 aa, Saccharomyces cerevisiae
  source: /note="strain ATCC 204508 / S288c"
MSSSESIRMVLIGPPGAGKGTQAPNLQERFHAAHLATGDMLTSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 682 - protein, 222 aa, Saccharomyces cerevisiae
  source: /note="strain ATCC 204508 / S288c"
MSSSESIRMVLIGPPGAGKGTQAPNLQERFHAAHLATGDMLVSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKTGIWAGVDASQPPATVWADILNKLGKD

SEQ ID NO: 683 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTFAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGLPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 684 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVVGIMSNEVKSIPNWTHGNTQIKNWFDRWDVTQNSLLGLYDWNTQNTQVQSYLKRFLDRALNDGADGFRFDAAKHIELPDDGSYGSQFWPNITKILTEFQYGEILQDSASRDAAYANYMDVTASNYGHSIRSALKNRNLGVSNIMTYVLTVSADKLVTWVESHDTYANDDEESTWMSDDDIRLGWAVIASRSGSTPLFFSRPEGGGNGVRFPGKSQIGDRGSALFEDQAITAVNRFHNVMAGVPETLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 685 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVVGFMSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 686 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDMVGVMSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYAFDVSADKLVTWVESHDTYANDDEESTWMSDDDIRLGWAVIASRSGSTPLFFSRPEGGGNGVRFPGKSQIGDRGSALFEDQAITAVNRFHNVMAGQPVELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 687 - protein, 626 aa, Bacillus subtilis
  source: /note="strain 168"
  MOD_RES (209)..(209): Any amino acid
  MOD_RES (262)..(262): Any amino acid
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAVISNEVKSIPNWTHGNTQIKNWSDRWDVTQNSLLGLYDWNTQNTQVQSYLKRFLDRALNDGADGFRFDAAKHIELPDDGSYGSQFWPNITNTXAEFQYGEILQDSASRDAAYANYMDVTASNYGHSIRSALKNRNLGVSNISQYAXEVSADKLVTWVESHDTYANDDEESTWMSDDDIRLGWAVIASRSGSTPLFFSRPEGGGNGVRFPGKSQIGDRGSALFEDQAITAVNRFHNVMAGLPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 688 - protein, 621 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVMGFVSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNIVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 689 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDLLGVLSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 690 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDLVGVLSNEVKSIPNWTHGNTQIKNWSDRWDVTQNSLLGLYDWNTQNTQVQSYLKRFLDRALNDGADGFRFDAAKHIELPDDGSYGSQFWPNITRVVMEFQYGEILQDSASRDAAYANYMDVTASNYGHSIRSALKNRNLGVSNIVMYILRVSADKLVTWVESHDTYANDDEESTWMSDDDIRLGWAVIASRSGSTPLFFSRPEGGGNGVRFPGKSQIGDRGSALFEDQAITAVNRFHNVMAGLPKRLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 691 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVIGMVSNEVKSIPNWTHGNTQIKNWSDRWDVTQNSLLGLYDWNTQNTQVQSYLKRFLDRALNDGADGFRFDAAKHIELPDDGSYGSQFWPNITRLVMEFQYGEILQDSASRDAAYANYMDVTASNYGHSIRSALKNRNLGVSNIMRYLLKVSADKLVTWVESHDTYANDDEESTWMSDDDIRLGWAVIASRSGSTPLFFSRPEGGGNGVRFPGKSQIGDRGSALFEDQAITAVNRFHNVMAGIPKRLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 692 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDLLGVLSNEVKSIPNWTHGNTQIKNWSDRWDVTQNSLLGLYDWNTQNTQVQSYLKRFLDRALNDGADGFRFDAAKHIELPDDGSYGSQFWPNITTFLTEFQYGEILQDSASRDAAYANYMDVTASNYGHSIRSALKNRNLGVSNIIRYLLRVSADKLVTWVESHDTYANDDEESTWMSDDDIRLGWAVIASRSGSTPLFFSRPEGGGNGVRFPGKSQIGDRGSALFEDQAITAVNRFHNVMAGLPTKLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 693 - protein, 617 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDNEVKSIPNWTHGNTQIKNWSDRWDVTQNSLLGLYDWNTQNTQVQSYLKRFLDRALNDGADGFRFDAAKHIELPDDGSYGSQFWPNITEFQYGEILQDSASRDAAYANYMDVTASNYGHSIRSALKNRNLGVSNIFRYVFKVSADKLVTWVESHDTYANDDEESTWMSDDDIRLGWAVIASRSGSTPLFFSRPEGGGNGVRFPGKSQIGDRGSALFEDQAITAVNRFHNVMAGLPMKLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 694 - protein, 626 aa, Bacillus subtilis
  source: /note="strain 168"
  MOD_RES (95)..(95): Any amino acid
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAXEEYGIKVIVDAVINHTTSDLFGVVSNEVKSIPNWTHGNTQIKNWCDRWDVTQNSLLGVYDWNTQNTQAQSYLKRFLDRALNDGADGFRFDAAKHIELPDDGSYGSQFWPNITGDNEFQYGEILQDSASRDAAYANYMDVTASNYGHSIRSALKNRNLGVSNIVKYLVRVSADKLVTWVESHDTYANDDEESTWMSDDDIRLGWAVIASRSGSTPLFFSRPEGGGNGVRFPGKSQIGDRGSALFEDQAITAVNRFHNVMAGFPKILSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 695 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVLGVVSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 696 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDLLGLVSNEVKSIPNWTHGNTQIKNWSDRWDVTQNSLLGLYDWNTQNTQVQSYLKRFLDRALNDGADGFRFDAAKHIELPDDGSYGSQFWPNITTVFREFQYGEILQDSASRDAAYANYMDVTASNYGHSIRSALKNRNLGVSNILRYLVKVSADKLVTWVESHDTYANDDEESTWMSDDDIRLGWAVIASRSGSTPLFFSRPEGGGNGVRFPGKSQIGDRGSALFEDQAITAVNRFHNVMAGIPIILSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 697 - protein, 627 aa, Bacillus subtilis
  source: /note="strain 168"
  MOD_RES (210)..(210): Any amino acid
  MOD_RES (359)..(359): Any amino acid
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVIGLLSNEVKSIPNWTHGNTQIKNWSDRWDVTQNSLLGLYDWNTQNTQVQSYLKRFLDRALNDGADGFRFDAAKHIELPDDGSYGSQFWPNITNTXREFQYGEILQDSASRDAAYANYMDVTASNYGHSIRSALKNRNLGVSNISLSAFGVSADKLVTWVESHDTYANDDEESTWMSDDDIRLGWAVIASRSGSTPLFFSRPEGGGNGVRFPGKSQIGDRGSALFEDQAITAVNRFHNVMAGLPXELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 698 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSVLGVLSNEVKSIPNWTHGNTQIKNWSDRWDVTQNSLLGLYDWNTQNTQVQSYLKRFLDRALNDGADGFRFDAAKHIELPDDGSYGSQFWPNITKMIMEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGVPMMLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 699 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSLFGLVSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 700 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSLIGVFSNEVKSIPNWTHGNTQIKNWSDRWDVTQNSLLGLYDWNTQNTQVQSYLKRFLDRALNDGADGFRFDAAKHIELPDDGSYGSQFWPNITRVLREFQYGEILQDSASRDAAYANYMDVTASNYGHSIRSALKNRNLGVSNIFIYVITVSADKLVTWVESHDTYANDDEESTWMSDDDIRLGWAVIASRSGSTPLFFSRPEGGGNGVRFPGKSQIGDRGSALFEDQAITAVNRFHNVMAGVPMKLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 701 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDLFGMVSNEVKSIPNWTHGNTQIKNWFDRWDVTQNSLLGLYDWNTQNTQVQSYLKRFLDRALNDGADGFRFDAAKHIELPDDGSYGSQFWPNITIVITEFQYGEILQDSASRDAAYANYMDVTASNYGHSIRSALKNRNLGVSNILRYVLRVSADKLVTWVESHDTYANDDEESTWMSDDDIRLGWAVIASRSGSTPLFFSRPEGGGNGVRFPGKSQIGDRGSALFEDQAITAVNRFHNVMAGLPMKLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 702 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVLGLLSNEVKSIPNWTHGNTQIKNWSDRWDVTQNSLLGLYDWNTQNTQVQSYLKRFLDRALNDGADGFRFDAAKHIELPDDGSYGSQFWPNITIIMREFQYGEILQDSASRDAAYANYMDVTASNYGHSIRSALKNRNLGVSNILRYMMTVSADKLVTWVESHDTYANDDEESTWMSDDDIRLGWAVIASRSGSTPLFFSRPEGGGNGVRFPGKSQIGDRGSALFEDQAITAVNRFHNVMAGVPKTLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 703 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDIVGFVSNEVKSIPNWTHGNTQIKNWSDRWDVTQNSLLGLYDWNTQNTQVQSYLKRFLDRALNDGADGFRFDAAKHIELPDDGSYGSQFWPNITKVLMEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 704 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVIGFFSNEVKSIPNWTHGNTQIKNWSDRWDVTQNSLLGLYDWNTQNTQVQSYLKRFLDRALNDGADGFRFDAAKHIELPDDGSYGSQFWPNITKVLREFQYGEILQDSASRDAAYANYMDVTASNYGHSIRSALKNRNLGVSNIMRYIVRVSADKLVTWVESHDTYANDDEESTWMSDDDIRLGWAVIASRSGSTPLFFSRPEGGGNGVRFPGKSQIGDRGSALFEDQAITAVNRFHNVMAGLPRRLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 705 - protein, 627 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDVLGVVSNEVKSIPNWTHGNTQIKNWSDRWDVTQNSLLGLYDWNTQNTQVQSYLKRFLDRALNDGADGFRFDAAKHIELPDDGSYGSQFWPNITTVVMEFQYGEILQDSASRDAAYANYMDVTASNYGHSIRSALKNRNLGVSNILRYVVRVSADKLVTWVESHDTYANDDEESTWMSDDDIRLGWAVIASRSGSTPLFFSRPEGGGNGVRFPGKSQIGDRGSALFEDQAITAVNRFHNVMAGVPTKLSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 706 - protein, 591 aa, Bacillus subtilis
  source: /note="strain 168"
IHDAGYTAIQTSPINQVKEGNQGDKSMSNWYWLYQPTSYQIGNRYLGTEQEFKEMCAAAEEYGIKVIVDAVINHTTSDMVGVMSNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGEILQDSASRDAAYANYMDVTASNYGHSIRSALKNRNLGVSNISHYAFDVSADKLVTWVESHDTYANDDEESTWMSDDDIRLGWAVIASRSGSTPLFFSRPEGGGNGVRFPGKSQIGDRGSALFEDQAITAVNRFHNVMAGQPVELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITMRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 707 - protein, 591 aa, Bacillus subtilis; identical to SEQ ID NO: 706
  source: /note="strain 168"

SEQ ID NO: 708 - protein, 591 aa, Bacillus subtilis; identical to SEQ ID NO: 706
  source: /note="strain 168"

SEQ ID NO: 709 - protein, 591 aa, Bacillus subtilis; identical to SEQ ID NO: 706
  source: /note="strain 168"

SEQ ID NO: 710 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFAAAKHIELPDDGSYGSQFWPNITNTSAEFQYGEILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 711 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGHILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 712 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGQILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 713 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGPILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 714 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGFILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 715 - protein, 626 aa, Bacillus subtilis
  source: /note="strain 168"
ETANKSNELTAPSIKSGTILHAWNWSFNTLKHNMKDIHDAGYTAIQTSPINQVKEGNQGDKSMSNWYWLYQPTSYQIGNRYLGTEQEFKEMCAAAEEYGIKVIVDAVINHTTSDYAAISNEVKSIPNWTHGNTQIKNWSDRWDVTQNSLLGLYDWNTQNTQVQSYLKRFLDRALNDGADGFRFDAAKHIELPDDGSYGSQFWPNITNTSAEFQYGKILQDSASRDAAYANYMDVTASNYGHSIRSALKNRNLGVSNISHYASDVSADKLVTWVESHDTYANDDEESTWMSDDDIRLGWAVIASRSGSTPLFFSRPEGGGNGVRFPGKSQIGDRGSALFEDQAITAVNRFHNVMAGQPEELSNPNGNNQIFMNQRGSHGVVLANAGSSSVSINTATKLPDGRYDNKAGAGSFQVNDGKLTGTINARSVAVLYPDDIAKAPHVFLENYKTGVTHSFNDQLTITLRADANTTKAVYQINNGPETAFKDGDQFTIGKGDPFGKTYTIMLKGTNSDGVTRTEKYSFVKRDPASAKTIGYQNPNHWSQVNAYIYKHDGSRVIELTGSWPGKPMTKNADGIYTLTLPADTDTTNAKVIFNNGSAQVPGQNQPGFDYVLNGLYNDSGLSGSLPH

SEQ ID NO: 716 - protein, 202 aa, Saccharomyces cerevisiae
  source: /note="strain FostersB"
MSSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGRLIHPASGRSYHKIFNPPKEDMKDDVTGEALVQRSDDNADALKKRLAAYHAQTEPIVDFYKKDRYLGWC

SEQ ID NO: 717 - protein, 2889 aa, Bos taurus
MSCNGGSHPRINTLGRMTRAESGPDLRYEMTCGGVGGGGGGGGGGGTSRMYYSRRCTVTDQNSDGYGQTGTMSRHQNQNTIQELLQNCSDCLMRAELIVQPELKYGDGIQLARSRELDECFAQANDQMEITDSLIREMRQMGQPCDAYQKRLLQLQEQMRALYKAISGPRVRRASSKGGGGYTCQSGSGWDEFTKRLTSECLGWMRQQRAEMDMMTWGVDLASVEQHISSHRSIHNTIGDYRWQLDKIKADLREKSAIYQLEEEYENLLKASFERMDHLRQLQNIIQATSREIMWINDCEEEELLYDWSDRNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNTPLQRLLEQIKELEKEREKILEYKRQVQSLVNKSKKIVQLKPRNPDYRSNKPIILRALCDYKQDQKIVHKGDECILKDNNERSKWYVTGPGGVDMLVPSVGLIIPPPNPLAVDLSSKIEQYYEAILALWNQLYINMKSLVSWHYCMIDIEKIKAMTIAKLKTMRQEDYMKTISDLELHYQEFIRNSQGSEMFGDDDKRKMQTQFTDAQKHYQTLVIQLPGHPQHQTVTTTEITHLGTCQDVNHNKVIETNRENDKQEAWMLIELQKIRRQMELCESRMALKNILLADQGSSHHITVKINELKSVQNDAQAIAQVLNQLKDMLANFRGSEKYCYLQNEVFGLFQKLENINGVTDGYLNSLCAVRALLQAILQTEDMLKVYEARLTEEETVCLDLDKVEAYRCGLKKIKNDLNLKKSLLATMKTELQKAQQIHSQTSQQYPLYDLDLGKFSEKVTQLTDRWQRIDKQIDYRLWDLEKQIKQLRNYRDNYQTFCKWLYDAKRRQDSLESMKFGDSNTVMRFLNEQKNLHSEISGKRDKSEEVQKIAELCANSIKDYELQLASYTSGLETLLSIPIKRTVIQSPSGVILQEAADMHARYIELLTRSGDYYRFLSEMLKSLEDLKLKNTKIEVLEEELRLARDANSENCNKNKFLDQNLQKYQAECSQFKAKLVSLEELKRQAELDGKSAKQNLDKCYGQIKELNEKITRLTYEIEDEKRRRKAVEDRFDQQKSDYDQLQKARQNEKESLGWQKMESEKAIKEKEFEIERLRVLLQEEGARKREYENELAKVRNHYNEEMSNLRNKYETEINITKTTIKEISMQKEDDSKNLRNQLDRLSRENRDLKEEIVRLNDSILQTTEQRRRAEEDALQQKACGSEVLQKKQYLEIELKQVIQQRSEDNARHKQSLEEAAKTIQDKNKEIERLKTEFQEEAKRRWEYENELAKVRANYDEEIISLKNQFETEINITKTTIHQLTLQKEEDTSGYRAQIDTLTRENRSLSEEVKRLKNTLAQNTETLRRVEENVQQQKATGLEMSQRKQQLEVELRQVTQMRTEESARYKQSLDDAAKTIQDKNKEIDRLKQLIETEASQRKCLEDENARLQRAQGELQKAHSSATETISKLKVQEQELLRLRLDYERVSQERTVRDQDIARFQTSLKELQLQKQKAEEELARLKRAASEDSSKRKKLEEELEGMRRTLKEQAIKVTSLTQQLEQASIVKKRSEDELRQQRDTLDGHLREKQRTQDELRRLASEVEALRRQLLQEQESVRQAQTRNEHFQKAIEDKSRSLNESKIEIERLQSLTESLTKEHLMLEEELRQLRLEYDDLQRGRSEADHDKNATIAELRNQLQISNNRTLELQGLINDLQRERENLRQEIERFQKQALEASNRIQESKNQCTQVVQERESLLVKIKVLEQDKARLQRLEEELSRAKTTLEAESRLKQRLECEKQQIQNDLNQWKTQYSRKEEAIRKIESEREKSEREKNSLRSEIERLQAEIKRIEERCRRKLEDSSRETQSQLETERCRLQREIDRLKQRPYGSHRETQTEYEWSVDSSKLVFDGLRKKVTAMQLYECQLIDKATLDKLLKGKKSVEEVASEIQPFLRGAGAIAGASASPKEKYSLVEAKRKKLITPESTVMLLEAQAATGGIIDPHRNEKLTVDSAIARDLIDFDDRQQIYTAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYMQLRERCRIEPHTGLLLLSVQKRSMSFQGIRQPVTVSELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYDTFKELCEQECEWEEITITGSDGSTRVVLVDRKTGSQYDIQDTIDKGLIDRKFFEQYRSGSLSLTQFADMISLKNGVGGGVGGIVGGGSSTGGGLSDDVFGSSRHETVSKISTISSIKNLTIRSSSLSEPLEESSPIAAIFDTENLEKISISEGIERGIVDSISGQRLLEAQACTGGIIHPTTGQKLSLQDAVSQGLIDQDMATRLKPAQKAFIGFEGVKGKKKMSAAEAVKEKWLPYEAGQRFLEFQYLTGGLVDPEVQGRISTEEAIRKGYIDGRAAQRLQDTSTYGKILTCPKTKLKISYKDAINRSMVEDVTGLRLLEAASVSSKGLPSPYNMSSAPGSRSGSRSGSRSGSRSGSRSGSRRGSFDATGNSSYSYCYSFSSSSIGH

SEQ ID NO: 718 - protein, 2748 aa, Ovis aries
FSQTGTMSRHQNQNTIQELLQNCSDCLMRAELIVQPELKYGDGIQLARSRELDECFAQANDQMEITDSLIREMRQMGQPCDAYQKRLLQLQEQMRALYKAISAPRVRRASSKGGGGYTCQSGSGWDEFTKRLTSECLGWMRQQRSEIEVMEMQIRKIISAQPILRWGQKCHHQASEICLQTDWEKSLWREKSAIYQLEEEYENLLKASFERMDHLRQLQNIIQATSREIMWINDCEEEELLYDWSDRNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNTPLQRLLEQIKELEREREKILEYKRQVQSLVNKSKKIVQLKPRNPDYRSNKPIILRALCDYKQDQKIVHKGDECILKDNNERSKWYVTGPGGVDMLVPSVGLIIPPPNPLAVDLSSKIEQYYEAILALWNQLYINMKSLVSWHYCMIDIEKIKAMTIAKLKTMRQEDYMKTISDLELHYQEFIRNSQGSEMFGDDDKRKMQTQFTDAQKHYQTLVIQLPGHPQHQTVTTTEITHLGTCQDVNHNKVIETNRENDKQETWMLIELQKIRRQMELCESRMALKNLLLADQGSSHHITVKINELKESVDQPSAGKASLMKDRKGQLSPNFRGSEKYCYLQNEVFGLFQKLENINGVTDGYLNSLCAVRALLQAILQTEDMLKVYEARLTEEETVCLDLDKVEAYRCGLKKIKNDLNLKKSLLATMKTELQKAQQIHSQTSQQYPLYDLDLGKFSEKVTQLTDRWQRIDKQIDYRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLSIPIKRTVIQSPSGVILQEAADMHARYIELLTRSGDYYRFLSEMLKSLEDLKLKNTKIEVLEEELRLARDANSENCNKNKFLDQNLQKYQAECSQFKAKLVSLEELKRQAELDGKSAKQNLDKCYGQIKDLNEKITRLTYEIEDEKRRRKAVEDRFDQQKSDYDQLQKARQNEKESLGWQKMESEKAIKEKEFEIERLRVLLQEEGARKREYESELAKVRNHYNEEMSNLRNKYETEINITKTTIKEISMQKEDDSKNLRNQLDRLSRENRDLKEEIVRLNDSILQTTEQRRRAEEDALQQKACGSEMLQKKQHLEIELKQVIQQRSEDNARHKQSLEEAAKTIQDKNKEIERLKAEFQEEAKRRWEYENELAKVRANYDEEIISLKNQFETEINITKTTIHQLTLQKEEDTSGYRAQIDTLTRENRSLSEEVKRLKNTLAQTTETLRRVEENVQQQKTTGLEMSQRKQQLEIELRQVTQMRTEESARYKQSLDDAAKTIQDKNKEIDRLKQLIETEASQRKCLEDENARLQRAQGELQKAHSSATETISKLKVQEQELLRLRLDYERVSQERTVRDQDIARFQTSLKELQLQKQKAEEELARLKRAASEDSSKRKKLEEELEGLRRTLKEQAIKVTSLTQQLEQASIVKKRSEDELRQQRDVLDGHLREKQRTQDELRRLASEAEALRRQLLQEQESVRQAQARNEHFQKAIEDKSRSLNESKIEIERLQSLTESLTKEHLMLEEELRQLRLEYDDLRRGRSEADHDKNATIAELRSQLQISNNRTLELQGLINDLQRERENLRQEIERFQKQALEASNRIQESKNQCTQVVQERESLLVKIKVLEQDKARLQRLEEELSRAKTALEAESRVKQRLECEKQQIQNDLNQWKTQYSRKEEAIRKIESEREKSEREKNSLRSEIERLQAEIKRIEERCRRKLEDSSRETQSQLETERCRLQREIDRLKQRPYGSHRETQTEYEWSVDSSKLVFDGLRKKVTAVQLHECQLIDKATLDKLLKGKKSVEEVASELQPFLRGAGAIAGASASPKEKYSLVEAKRKKLITPESTVMLLEAQAATGGIIDPHRNEKLTVDNAIARDLIDFDDRQQIYTAEKAVTGFDDPFSGKTVSVSEAIKKNLIDRETGMRLLEAQIASGGVVDPVNSVFLPKDVALARGLIDRDLYRSLNDPRDSQKNFVDPVTKKKVSYMQLRERCRIEPHTGLLLLSVQKRSMSFQGIRQPVTVSELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYDTFKELCEQECEWEEITITGSDGSTRVVLVDRKTGSQYDIQDTIDKGLIDRKFFEQYRSGSLSLTQFADMISLKNGVGSGVGGGMGGGVGGSSSTGGGLSDDVFGGSRHETVSKISTISSIRNLTIRSSSLSEPLEESSPIAAIFDTENLEKISISEGIERGIVDSISGQRLLEAQACTGGIIHPTTGQKLSLQDAVSQGLIDQDMATRLKPAQKAFIGFEGVKGKKKMSAAEAVKEKWLPYEAGQRFLEFQYLTGGLVDPEVQGRISMEEAIRKGYIDGRAAQRLQDTSTYGKILTCPKTKLKISYKDA

SEQ ID NO: 719 - protein, 2677 aa, Sus scrofa
MRQQRVEMDTVAWGVDMASVEQHINSHRSLHNAIGDYRWQLDKIKADLREKSAIYQLEEEYENLLKASFERMDHLRQLQSIIQAASREIMWINDCEEEELLYDWSDRNTNIAQKQEAFSIRMSQLEVKEKELNKLKQESDQLVLSQHPASDKIEAYMDTLQTQWSWILQITKCIDVHLKENAAYFQFFEEAQSTEAYLKGLQDSIRKKYPCDKNTPLQRLLEQIKELEKEREKILEYKRQVQNLVNKSKKIVQLKPRNPDYRSNKPIILRALCDYKQDQKIIHKGDECILKDNNERSKWYVTGPGGVDMLVPSVGLIIPPPNPLAVDLSSKIEQYYEAILALWNQLYINMKSLVSWHYCMIDIEKIRAMTIAKLKTMRQEDYMKTISDLELHYQEFIRNSQGSEMFGDDDKRKMQTQFTDAQKHYQTLVIQLPGHPQHQTVTTTEITHVGSCQDVNHHQVIELNRETDKQETWILMELQKVRRQMEHCEGRMTLKNILLADQGSSHHITVKINELKSIQNDSQAIAEVLNQLKDMLANFRGSEKYCYLQNEIFGLFQKLENINGVTDGYLNSLCTVRSLLQAILQTEDMLKVYEARLTEEETVCLDLDKVEAYRCGLKKIKNDLNLKKSLLATMKTELQKAQQIHSQTSQQYPLYDLDLGKFSEKVTQLTDRWQRIDKQIDYRLWDLEKQIKQLRNYRDNYQAFCKWLYDAKRRQDNLESMKFGDSSTVLRFLNEQKNLHSEISGKRDKSEEVQKIAELCANSIKDYELQLASYSSGLETLLNIPIKRTMVQSPSGVILQEAADIHARYIELLTRSGDYYRFLSEMLKSLEDLKLKNTKIEVLEEELRLARDANSENCNKNKFLDQNLQKYQAECSQFKAKLVSLEELKRQAELDGKAAKQNLDKCYGQIKELNEKITRLTYEIEDEKRRRKAVEDRFDQQKNDYDQLQKARQCEKESLGWQKIESEKAIQEKEYEIERLRVLLQEEGARKREYENELAKVRNHYNEEMSNLRNKYETEINVTKTTIKELSLQREDDAKSLRGQLDRLSRENRDLKDEIVRLNDSLLQTTEQRRRAQEDALQQKACGSEMLQKKQQLEVELKQVIQQRSEDNARHKQSLEEAARTIQDKNKEIERLKAEFQEEAKRRREYESELAKVRSSYDEEIISLKNQFETEINITKTTIHQLTLQKEEDTSGYRAQIDGLTRENRSLSEEVKRLKNSLAQTTESLRRVEENVQQQKATGEMSQRKQQLEVELRQVTQMRMEESARYKQSLEEAAKTIRAKQGLRVKAAGGDGTQGAQCLEEENAQLQRAHGDLQKAHGSATETISKLKVQEQELLRLRMDYERVSQERAARDQDIARFQSSLKELQVQKQKAEEELARLKRAASEDSSKRKKLEEELEAMRRSLKEQAVKVTSLTQQLEQASISKKRSEDELRQQRDVLEGQLREKQRTQDELRRLASEVEALRRQLLQEQENLKQAHMRSEHFQKAIEDKSRSLNESKIEIERLQSLTENLTKEHLMLEEELRNLRLEYDDFRRGHSEVDHGKNATISELRSQLQISNNRTLELQGLINDLQRERENLRQEIEKFQKQALEASNRIQESKSQCTQVVQERESLLVKIKVLEQDKARLQRLEEELNRAKATLEAESRLKQRLECEKQQIQNDLNQWKTQYSRKEEAIRKIESEREKSEREKNTLRSEIERLQAEIRRIEERCRRKLEDSSRETQSQLETERCRLQREIDKLKQRPYGSHRETQTECEWAVDSSKLVFDGLRKKVTAMQLFECQLIDKTTLDKLLKGKKSVEEVASEIQPFLRGAGAIAGASASPKDKYSLVEAKRKKLITPESTVMLLEAQAATGGIIDPHRNEKLTVDSAIARDLIDFDDRQQIYTAEKAVTGFDDPFSGKTVSVSEAIKKNLIDRETGLRLLEAQIASGGVVDPVNSVFLPKDVALARGLIDRDLYRSLNDPRDGQKNFVDPVTKKKVSYMQLRERCRIEPHTGLLLLSVQKRSMSFQGIRQPVTVSELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEATGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGFIDRKFFDQYRSGSLSLTQFADMISWKNGVTSTGGGGGTGGSVSDDVFSTSRHEAVSKIATIASARNLTIRSSSLSDPLEEWSPIAAIFDTENLEKISVTEGIERGIVDSITGQRLLEAQACTGGIIHPTTGQKLSLQDAVAQGVIDQDMATRLKPAQKAFIGFEGVKGKKKMSAAEAVKEKWLPYEAGQRFLEFQYLTGGLVDPEVNGRISTEEAIRKGFIDGRAAQRLQDTSSYAKILTCPKTKLKISYKDAINRSMVEDITGLRLLEAASVSSKGLPSPYNVSSAPGSRSGSRSGSRSGSRSGSRSGSRRGSFDATSNSSYSYSYSFSSSSIGH

SEQ ID NO: 720 - protein, 745 aa, Bos taurus
MEVMNLIEQPIKVTEWQQTYTYDSGIHSGANTCVPSLSSKGLIEEDEACGRQYTLKKTTTYTQSVPPGQGDLEYQMSTTARAKRVREAMCPGVTGEDSSLLLTTQVEGQTTNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPMNEPYADDMDATYRPMYSSDVPMDPLEMHMDMDGDYPIDTYSDGLRPPYATADHMLA

SEQ ID NO: 721 - protein, 599 aa, Gallus gallus
MSRISYRSSTGGGMRGFSSGSAIVGGSGGGTRSSFSSVSVSRVGGGRAGGGGGFGAGGGFGSRSLYNLGGSKRISLGGLRSGAGVGYGFGGGAGFGLGYGGGAGAALGLGGAGGGGGYGLGGFGMGGPGFGGRGGPGFPVCPPGGIHEVTVNQSLLAPLKLDIDPEIQKVRTQEREQIKTLNNKFASFIDKVRFLEQQNKVLETKWSLLQEQGHTVTRKSLEPLFETYINNLRRQLDSLMGERGRLDSELRSMQDMVEDFKNKYEDEINRRTGAENEFVVLKKDVDGAYMNKVELQAKADGLADEINFLRALYEAELSQMQQQVSDTSVVLSMDNNRSLDLNSIIAEVKAQYEDIANRSRAEAEAWYQNKYEELQVSAGRHGDDLRNTKMEISEINRMVQRLRNEIESVKKQCANLQAAIAEAEERGEMALKDAKSKLAELEDALQKAKADLARQLREYQELMNVKLALDIEIATYRKLLEGEESRLAGEGVGAVSVSVVSSSSGMGYGGGMGGGLSTGGGLCMGGGLSMGSGLGMGGGGGSYTMSSSVGGGGFGGGSGSYSYGGGSNFSSSSSRGVSSSTGGSVRIVSKTTTSKKTIR

SEQ ID NO: 722 - protein, 248 aa, Saccharomyces cerevisiae
  source: /note="strain FostersB"
  MOD_RES (49)..(49): Any amino acid
MQIFVKTLTGKTITLEVESSDTIDNVKSKIQDKEGIPPDQQRLIFAGKXLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESS

SEQ ID NO: 723 - protein, 908 aa, Saccharomyces cerevisiae
  source: /note="strain FostersB"
  MOD_RES (288)..(288): Any amino acid
  MOD_RES (303)..(303): Any amino acid
MNDQTQFTERALTILTLAQKLASDHQHPQLQPIHILAAFIETPEDGSVPYLQNLIEKGRYDYDLFKKVVNRNLVRIPQQQPAPAEITPSYALGKVLQDAAKIQKQQKDSFIAQDHILFALFNDSSIQQIFKEAQVDIEAIKQQALELRGNTRIDSRGADTNTPLEYLSKYAIDMTEQARQGKLDPVIGREEEIRSTIRVLARRIKSNPCLIGEPGIGKTAIIEGVAQRIIDDDVPTILQGAKLFSLDLAALTAGAKYKGDFEERFKGVLKEIEESKTLIVLFIDEIHXLMGNGKDDAANILKXALSRGQLKVIGATTNNEYRSIVEKDGAFERRFQKIEVAEPSVRQTVAILRGLQPKYEIHHGVRILDSALVTAAQLAKRYLPYRRLPDSALDLVDISCAGVAVARDSKPEELDSKERQLQLIQVEIKALERDEDADSTTKDRLKLARQKEASLQEELEPLRQRYNEEKHGHEELTQAKKKLDELENKALDAERRYDTATAADLRYFAIPDIKKQIEKLEDQVAEEERRAGANSMIQNVVDSDTISETAARLTGIPVKKLSESENEKLIHMERDLSSEVVGQMDAIKAVSNAVRLSRSGLANPRQPASFLFLGLSGSGKTELAKKVAGFLFNDEDMMIRVDCSELSEKYAVSKLLGTTAGYVGYDEGGFLTNQLQYKPYSVLLFDEVEKAHPDVLTVMLQMLDDGRITSGQGKTIDCSNCIVIMTSNLGAEFINSQQGSKIQESTKNLVMGAVRQHFRPEFLNRISSIVIFNKLSRKAIHKIVDIRLKEIEERFEQNDKHYKLNLTQEAKDFLAKYGYSDDMGARPLNRLIQNEILNKLALRILKNEIKDKETVNVVLKKGKSRDENVPEEAEECLEVLPNHEATIGADTLGDDDNEDSMEIDDDLD

SEQ ID NO: 724 - protein, 554 aa, Saccharomyces cerevisiae
  source: /note="strain FostersB"
MSNNSFTNFKLATELPAWSKLQKIYESQGKTLSVKQEFQKDAKRFEKLNKTFTNYDGSKILFDYSKNLVNDEIIAALIELAKEANVTGLRDAMFKGEHINSTEDRAVYHVALRNRANKPMYVDGVNVAPEVDSVLKHMKEFSEQVRSGEWKGYTGKKITDVVNIGIGGSDLGPVMVTEALKHYAGVLDVHFVSNIDGTHIAETLKVVDPETTLFLIASKTFTTAETITNANTAKNWFLSKTGNDPSHIAKHFAALSTNETEVAKFGIDTKNMFGFESWVGGRYSVWSAIGLSVALYIGYDNFEAFLKGAEAVDNHFTQTPLEDNIPLLGGLLSVWYNNFFGAQTHLVAPFDQYLHRFPAYLQQLSMESNGKSVTRGNVFTDYSTGSILFGEPATNAQHSFFQLVHQGTKLIPSDFILAAQSHNPIENKLHQKMLASNFFAQAEALMVGKDEEQVKAEGATGGLVPHKVFSGNRPTTSILAQKITPATLGALIAYYEHVTFTEGAIWNINSFDQWGVELGKVLAKVIGKELDNSSTISTHDASTNGLINQFKEWM

SEQ ID NO: 725 - protein, 727 aa, Bos taurus
MNHSPLKTALAYECFQDQDNSTLALPSDQKMKTGTSGRQRVQEQVMMTVKRQKSKSSQSSTLSHSNRGSMYDGLADSYNNYGTSSRSSFYSKFQAGSGSWGYPIYNGTLKREADNRRFSSYSQMESWGRQYPRGGCTAAGAGSDICFMQKIKASRSEPDLYCDPRGTLRKGTLGGKGHKTTQNRYSFYSTCSGQKAVKKYPGRPPSCTSRQDPVCVPPTSCTKDLSFSHSRASSKICSEDIECSGLTIPKAVQYLSSQDEKCQAIGAYYIQHTCFQDESAKQQVYQLGGICKLVDLLRSPNQNVQQAAAGALRNLVFRSTTNKLETRRQNGIREAVSLLRRTGSTEIQKQLTGLLWNLSSTDELKEELIAEALPVLADRVIIPFSGWCDGNSNLSREPVDPEVFFNATGCLRNLSSADVGRQTMRNYTGLIDSLMAYVQNCVAANRCDDKSVENCMCVLHNLSYRLDAEVPTRYRQLEYNARNAYTDKSSTGCFSNKSDRMTNNNYDCPLPEEEPNPKGSSWLYHSDAVRTYLNLMGKSKKDATLEACAGALQNLTASKGLMSSGMSQLIGLKEKGLPHIARLLQSGNSDVVRSGASLLSNMSRHPALHRVMGTQVFPEVTRLLTSHTGNTSNSEDILASACYTVRNLMASLPGMAKQHFSSSMVNNIINLCRSSTSPKAAEAARLLLSDMWSSRELQGLLRQQGFDRSMLGTLAGANSLRNFTSRF

SEQ ID NO: 726 - protein, 376 aa, Gallus gallus
MADEEIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEAIFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 727 - protein, 339 aa, Ovis aries
MSTVHEILCKLSLEGDHSTPPSAYGSVKAYTNFDAERDALNIETAIKTKGVDEVTIVNILTNRSNEQRQDIAFAYQRRTKKELASALKSALSGHLETVILGLLKTPAQYDASELKASMKGLGTDEDSLIEIICSRTNQELQEINRVYKEMYKTDLEKDIVSDTSGDFRKLMVALAKGRRAEDGSVIDYELIDQDARDLYDAGVKRKGTDVPKWISIMTERSVCHLQKVFERYKSYSPYDMLESIKKEVKGDLENAFLNLVQCIQNKPLYFADRLYDSMKGKGTRDKVLIRIMVSRSEVDMLKIRSEFKKKYGKSLYYYIQQDTKGDYQKALLYLCGGDD

SEQ ID NO: 728 - protein, 197 aa, Sus scrofa
MSSGNAKIGHRAPHFKATAVMPDGQFKDISLSDYKGKYVVFFFYPLDFTFVCPTEIIAFSERAEEFKKLNCQVIGASVDLTSVIWINTPKKQGGLGPMNIPLISDPKRTIAQDYGVLKADEGISFRGLFIIDDKGILRQITINDLPVGRSVDETLRLVQAFQFTDKHGEVCPAGWKPGSDTIKPDVQKSKEYFSKQK

SEQ ID NO: 729 - protein, 657 aa, Saccharomyces cerevisiae
  source: /note="strain FostersB"
  MOD_RES (340)..(340): Any amino acid
  MOD_RES (437)..(437): Any amino acid
  MOD_RES (462)..(462): Any amino acid
  MOD_RES (481)..(481): Any amino acid
  MOD_RES (488)..(488): Any amino acid
  MOD_RES (490)..(490): Any amino acid
  MOD_RES (495)..(495): Any amino acid
  MOD_RES (497)..(497): Any amino acid
  MOD_RES (509)..(511): Any amino acid
  MOD_RES (523)..(523): Any amino acid
  MOD_RES (551)..(551): Any amino acid
  MOD_RES (640)..(640): Any amino acid
MSSVDVLLTVGKLDASLALLTTQDHHVIEFPTVLLPENVKAGSIIKMQVSQNLEEEKKQRNHFKSIQAKILEKYGTHKPESPVLKIVNVTQTSCVLAWDPLKLGSAKLKSLILYRKGIRSMVIPNPFKVTTTKISGLSVDTPYEFQLKLITTSGTLWSEKVILRTHKMTDMSGITVCLGPLDPLKEISDLQISQCLSHIGARPLQRHVAIDTTHFVCNDLDNEESNEELIRAKHNNIPIVRPEWVRACEVEKRIVGVRGFYLDADQSILKNYTFPPVNEEELSYSKENEPVAEVADENKMPEDTTDVEQVASHNDNEGNPSEAKEQGEKSGHEAAPVSPXEDPLHASTALENETTIETVNPSVRSLKSEPVGTPNIEENKADSSAEAVVEEPNEAVAESSPNEEATGQKSEDTDTHSNEQADNGFVQTEEVAENNIXTESARENNEPADDAAMEFGRPEAEXETPEVNESIEDANEPVEDXNEPVEDXNXPVEDXNXPVEDSNKPVEDXXXPVEDTSEPAKNXGEPVQETNEFTTDIASPRHQEEDIELEXEPKDATESVAVEPSNEDVKPEEKGSEAEDDINNVSKEAASGESTTHQKTEASASLESSAVTEEQETTEAEVNTDDVLSTKEAKKNSGNXNSNKKKNKKNKKKGKKK

SEQ ID NO: 730 - protein, 700 aa, Saccharomyces cerevisiae
  source: /note="strain FostersB"
  MOD_RES (451)..(451): Any amino acid
  MOD_RES (695)..(695): Any amino acid
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICXMLIGYGLTETCASTTILDPANFELGVAGDLTGCVTVKLVDVEELDYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDXVYSSS

SEQ ID NO: 731 - protein, 441 aa, Sus scrofa
YSPGHLSSQVSLPVCPLLFSLAGSSLRINRSLQSKQHRQRPGLPGMELSYAGAGGSGSRISASRSSSVRGGSGWGAGMAGGLVGVGGIQGEKETMQDLNDRLASYLERVRSLEADNRRLEIKIREHLEKKGPQVRDWSHYLKTIEELRAQIFASSVDNARIVLQIDNARLAADDFRVKYETELAMRQSVESDIHGLRKVIDDTNVTRLQLETEIEALKEELLFMKKNHEEEVKGLQNQIANSGLTVELDAPKPQDLSKIMADIRAQYDELAQKNREELDKYWSQQIEESTSVVTSQSAEIGAAEMTLTELRRTVQSLEIDLDSMRNLKATLENSLREVEARYALQMEQLNGVLLHLESELAQTRAEGQRQTQEYEALLNIKVKLEAEINTYRRLLEDGEDFNLGDALDSSNSRQTIQKTTTLRLVDGKVVSETSDTKVLRH

SEQ ID NO: 732 - protein, 1043 aa, Bos taurus
MNWPFFRAAVVLFIFLVVLEVNSDFRIQVRDYNTKNGTIKWHSLRRQKREWIKFAAACREGEDNSKRNPIAKIHSDCAANQQVTYRISGVGIDQPPYGIFVINQKTGEINITSIVDREVTPFFIIYCRALNSLGQDLEKPLELRVRVLDINDNPPVFSMSTFVGEIEENSNANTLVMVLNATDADEPNNLNSKIAFKIIRQEPSDSPMFIINRYTGEIRTMNNFLDREQYGQYSLAVRGSDRDGGADGMSAECECNIKILDVNDNIPYMELPTQSISIEENSLNSNLLQIRVIDLDEEFSANWMAVIFFISGNEGNWFEIEMNERTNVGTLKVVKPLDFEAMNNLQLSLGVRNKAEFHQSIMSQYKLTATAISVTVLNVVEGSVFRPGSKTFVVNSNMGQNYKIGEYVAWDLDANRPSTTVRYVMGRNPTDLLAIDSKTAIITLRNKVTMEQYKILGGKYQGTILSIDDALQRTCTGTIVINLENGGWKTERPNVNGSTTSAYGLTSGGVTTNGYTTGGGVGTVTFAVGTNGYGVGTGVYQPLRDNVHFGPAGIGLLIMGFLVLGLVPFLLMCCDCGGAPGGGAAFEPVPECSDGAIHSWAVEGAQADPGVLANSAVPCIPVTNANVIEYVDNSGVYTNEYGAREMQDLGGGERTTGFELTDGVKMSGGPEICQEYPGTLRRNSMRECREGGLNMNFMESYFCQKAYAYADEDEGRPSNDCLLIYDIEGAGSPAGSVGCCSFIGEDLDDSFLDTLGPKFKKLADISLGKDVEPFPDSDPSWPPKSTEPVCPPQGTEPTGGGHPPISPRFGTTTVISENTYPSGPGVQHPTPIPDPLGYGNVTVTESYTSSGTLKPSVHIHDNRHASNVVVTERVVGPISGADLQGMLEMPDLRDGSNVIVTERVIAPSSSLPTTLTIPDPRQSSNVVVTERVIQPTSGIVGNLSMHPELSNTHNVIVTERVVSGSGITGSSSLLGSAGGGSGGGIGLGSLGGGGGLSSSLGGAATIGHLRGSAEHHFSNTLGSASPTTTRSRITKYSTVQYTK

SEQ ID NO: 733 - protein, 461 aa, Sus scrofa
MGKEKTHINIVVIGHVDSGKSTTTGHLIYKCGGIDKRTIEKFEKEAAEMGKGSFKYAWVLDKLKAERERGITIDISLWKFETSKYYITIIDAPGHRDFIKNMITGTSQADCAVLIVAAGVGEFEAGISKNGQTREHALLAFTLGVKQLIVAVNKMDSTEPAFSAARFQEITKEVSNYIKKIGYNPASVAFVPISGWHGDNMLEPSTNMPWFKGWKVERKEGNATGVTLLEALDSILPPTRPVNKPLRLPLQDVYKIGGIGTVPVGRVETGFLKAGMVVTFAPNNVTTEVKSVEMHHEALAEALPGDNVGFNVKNVSVKDIRRGNVAGDSKNDPPMEASSFVAQVIVLNHPGQIHAGYSPVLDCHTAHISCKFAELREKMDRRSGKKLEDNPKALKSGDAAMVQMVPSKAMCVETFSQYPPLGRFAVRDMRQTVAVGVIKAVEKKTATTAKVTKAAVKASKK

SEQ ID NO: 734 - protein, 360 aa, Saccharomyces cerevisiae
  source: /note="strain FostersB"
MRTLLEKEKSEFQTEKKALQEATVDQVTTLETKLEQLRIELDSSTQNLDAKSNRDFVDDQQSYEEKQHASFQYNRLKEQLESSKANWDSIEYALNTKIVNLENRFESIMKEKNDIEEKYQTALRSSETLGKQLEKEKENHSKAVLEVKDLERRVETLKSSLQSISDDYNLLKKKYEIQRSQLEQKENELKPHQENSNEKIIDKIPVELTDSLNSMEGNIEDEWTLPQENSMLSLSMSKLGELGSDPSLKPIYNESHETICSEESQHFDRKNVDFSIDDIPEEAAALQAIREGESMKSLNNTSIPYRRASVQLSNSNGHISAHLVNKLSTELKRLEGELSASKELYDNLLKEKTKANDEIS

SEQ ID NO: 735 - protein, 968 aa, Saccharomyces cerevisiae
  source: /note="strain FostersB"
  MOD_RES (368)..(368): Any amino acid
  MOD_RES (444)..(444): Any amino acid
  MOD_RES (948)..(948): Any amino acid
MSRIDSDLQKALKKACSVEETAPKRKHVRACIVYTWDHQSSKAVFTTLKTLPLANDEVQLFKMLIVLHKIIQEGHPSALAEAIRDRDWIRSLGRVHSGGSSYSKLIREYVRYLVLKLDFHAHHRGFNNGTFEYEEYVSLVSVSDPDEGYETILDLMSLQDSLDEFSQIIFASIQSERRNTECKISALIPLIAESYGIYKFITSMLRAMHRQLNDAEGDAALQPLKERYELQHARLFEFYADCSSVKYLTTLVTIPKLPVDAPDVFLINDVDESKEIKFKKREPSVTPARTPARTPTPTPPVVAEPAISPRPVSQRTTSTPTGYLQTMPTGATTGMMIPTATGAANAIFPQATAQMQPDFWANQQAQFXNEQNRLEQERVQQLQQQQAQQELFQQQLQKAQQDMMNMQLQQQNQHQNDLIALTNQYEKDQALLQQYDQRVQQLEXEITTMDSTASKQLANKDEQLTALQDQLDVWERKYESLAKLYSQLRQEHLNLLPRFKKLQLKVNSAQESIQKKEQLEHKLKQKDLQMAELVKDRDRARLELERSINNAEADSAAATAAAETMTQDKMNPILDAILESGINTIQESVYNLDSPLSWSGPLTPPTFLLSLLESTSENATEFATSFNNLIVDGLAHGDQTEVIHCVSDFSTSMATLVTNSKAYAVTTLPQEQSDQILTLVKRCAREAQYFFEDLMSENLNQVGDEEKTDIVINANVDMQEKLQELSLAIEPLLNIQSVKSNKETNPHSELVATADKIVKSSEHLRVDVPKPLLSLALMIIDAVVALVKAAIQCQNEIATTTSIPLNQFYLKNSRWTEGLISAAKAVAGATNVLITTASKLITSEDNENTSPEQFIVASKEVAASTIQLVAASRVKTSIHSKAQDKLEHCSKDVTDACRSLGNHVMGMIEDDHSTSQQQQPLDFTSEHTLKTAEMEQQVEILKLEQSLXNARKRLGEIRRHAYYNQDDD

SEQ ID NO: 736 - protein, 545 aa, Solanum lycopersicum
MPMDTETNQSGDFIFRSKLPDIYIPKHLPLHSYCFENLSEFSSRPCLIDGSNDRIYTYAEVELTSRKVAVGLSKLGIQQKDTIMILLPNCPEFVFAFIGASYLGAISTMANPLFTPAEVVKQAKASSAKIVITQACFAGKVKDYAIENDLKVICVDSAPEGCVHFSELIQSDEHEIPEVNIQPNDVVALPYSSGTTGLPKGVMLTHKGLVTSVAQQVDGENANLYMHSDDVLMCVLPLFHIYSLNSVLLCALRVGAAILIMQKFDIAQFLELIQKHKVTIGPFVPPIVLAIAKSPLVDNYDLSSVRTVMSGAAPLGKELEDAVRAKFPNAKLGQGYGMTEAGPVLAMCLAFAKEPFDIKSGACGTVVRNAEMKIVDPDTGCSLPRNQPGEICIRGDQIMKGYLNDPEATARTIEKEGWLHTGDIGYIDDDDELFIVDRLKELIKYKGFQVAPAELEALLVNHPNISDAAVVPMKDEQAGEVPVAFVVRSNGSTITEDEVKDFISKQVIFYKRIKRVFFVETVPKSPSGKILRKDLRARLAAGISN

SEQ ID NO: 737 - protein, 247 aa, Sus scrofa
MCDQQKQTQFPSSCVKGSGLGAGQSIKGTSVKCPPPCPTQTYVKCQVPCQTQTYVKCPTPCQTTTYVKCPPPCQTTYVKCPPPCQTTYVKCPPPCQTTYVKCPTPCQTYVKCPPPCQTTYVKCPAPCQTQTCYVQSPSPCQTYYVQAPASGSAASCSVPNPCSAPCSTSYCCLAPRTFGVSPLRRWVQRPQDCNSGSSGCCDNSGGCGSDCCGCGCGCCGSGCCCLGIIPMRSRGPACCDNEDDCCC

SEQ ID NO: 738 - protein, 459 aa, Sus scrofa
SSCLSSRSGVCKSSSCVTTQRFSCTSASGPRPGRCCITAAPYRGVSCYRGLTGGFGSRSVSGGFGAGSSGRSFGYRSGGVVRPSPPCITTVSINESLLAPLNLEIDHNAQSVKQEEKEQIKILNSRFAAFIDKVRFLEQQNKLLETKLQFFQNRKCCESNLEPLFNGYIETLRREAERVEADRGRLASELNHVHEVLEGYKKKYEEEVALRTTAENEFVRIKQEVNSLSVQKADLKANAQSLAEEVGFLKTLYEEEIRVLQAHISDTLVIVKMDNSRDLNMDSIIAEIKAHYDDIASRSRAEAESWYRTKYEEIKATVVQHGETLRRTKEEINELNRVIQRLTAEIENAKRQNSKLEAAVSQAEQQGQAALNDARYKLTELEAALQKAKQDMAFLLKEYQEVMSSKLALDIEIATYRRLLEGEEQSIRLCEGVGAVNISVSSSRGGVVCEDLSATRTCG

SEQ ID NO: 739 - protein, 531 aa, Bos taurus
MSKHHSDAGTAFIQTQQLHAAMADTFLEHMCRLDIDSPPITARNTGIICTIGPASRAVETLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVDVGSKIYVDDGLISLLVKQKGPDFLVTEVENGGSLGSKKGVNLPGAAVDLPAVSEKDIQDLKFGVEQNVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLSPITSDPTEAAAVGAVEASFKCCSGAIIVLTKSGRSAHQVARYRPRAPIIAVTRNHQTARQAHLYRGIFPVVCKDPVQEAWAEDVDLRVNLAMNVGKARGFFKKGDVVIVLTGWRPGSGFTNTMRVVPVP

SEQ ID NO: 740 - protein, 437 aa, Saccharomyces cerevisiae
  source: /note="strain FostersB"
MGQGVSSGQDKKKKKGSNQKPKYEPPVQSKFGRKKRKGGPATAEKLPNIYPSTRCKLKLLRMERIKDHLLLEEEFVSNSEILKPFEKKQEEEKKQLEEIRGNPLSIGTLEEIIDDDHAIVTSPTMPDYYVSILSFVDKELLEPGCSVLLHHKTMSIVGVLQDDADPMVSVMKMDKSPTESYSDIGGLESQIQEIKESVELPLTHPELYEEMGIKPPKGVILYGAPGTGKTLLAKAVANQTSATFLRIVGSELIQKYLGDGPRLCRQIFKVAGENAPSIVFIDEIDAIGTKRYDSNSGGEREIQRTMLELLNQLDGFDDRGDVKVIMATNKIETLDPALIRPGRIDRKILFENPDLSTKKKILGIHTSKMNLSEDVNLETLVTTKDDLSGADIQAMCTEAGLLALRERRMQVTAEDFKQAKERVMKNKVEENLEGLYL

SEQ ID NO: 741 - protein, 455 aa, Saccharomyces cerevisiae
  source: /note="strain FostersB"
MDIFRHTFGNNDDSFIRIPGAFREEPPADLNGRTEDQNSNTNEPTQSRDGRLKSILHFLFQAPLIVLYYLLNFIVRSSRLLKPLLRLHGFYQRKHNRLLDHSSQLHRLLENLENEAQAVTCSEGNGNNDDGSNTDSTSNNESSGVQFSFGSLYNPENGTFSKSIMQNSYTELLDACSEQVKFGVIYLHDPLLDNHMDYVNKILCSEAFVNMIRKYQVLLWYGDVTTSEGLQVSNALKIRQYPLLGIISLKAEKKIELIARVEGSISNYKAQDLEAIFSKNYSRLIQLRQQRQNIEMQRLIRQQQDSRYQDSLRRDQQRESERLEQTQREQMEREHQRIENQWLLWRKSQLKPEPSSDKDASKVAIRLENGQRLVRKFDASLPTEEIYAFVELQLHDMLNSENDTLPVYQPANYQHQYSFKLITPVPRRELDLSTKISDVSGIYPSGNIVMERLDE

SEQ ID NO: 742 - protein, 978 aa, Glycine max
MASATSFSGPTLRPSVPICAHRNNDTRFSQLRVSFNFPANPTSLKGLNSTPLKKREAFSNGSSRTRRNPLFFVRCTVSSSGKITQQEFTEMAWQAIISAPEVAKENKHQIVETEHLMKALLEQKNGLARRIFSKVGVDNTRLLETTDKHIQRQPKVVGESTGSMLGRDLEALIQRARDFKKEYGDSFVSVEHFVLGFAQDKRFGKILFRDFQISQQALKSAIESIRGRQLVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKAIDLVDEAAAKLKMEITSKPTALDEINRSVLKLEMERLSLMNDTDKASKDRLNRLETELSLLKEKQDELTGQWEHEKSVMTNLQSIKEEIDRVNLEIQQAEREYDLNRAAELKYGSLNSLQRQLESAEKELHEYMNSGKSMLREEVTGNDIAEIVSKWTGIPISKLQQSDREKLLYLEEELHKRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNTDDDTVPKESTYEAIKQRVMDAARSIFRPEFMNRVDEYIVFQPLDRDQISSIVRLQLERVQKRIVDRKMKIQVTEAAIQLLGSLGYDPNYGARPVKRVIQQNVENELAKGILRGEFKEEDTILVDTEVTVLANGQIPQQKLVFRRVEADSSSAAEDRREGFPQIL

SEQ ID NO: 743 - protein, 97 aa, Sus scrofa
MSSQQQKQPCTPPPQPQQQQVKQPCQPPPQEPCVPKTKEPCHPKVPEPCQPKVPEPCQPKVPEPCHPKVPEPCQPKVPEPCPSPVIPAPAQQKTKQK

SEQ ID NO: 744 - protein, 898 aa, Sus scrofa
LMAVASAAPGSDFCKQLLFSLLVLILFCDACQKISLQVPSHLPAEALVGKVNLKECLQSASLIQSSDPDFRIQEDGSIYTTHDLMLSSEKKSFSILLSDTQREEQKKIAIVLEAGGQKGPERHLEDTVLKRSKRRWAPIPCSLMENSLGPFPQHVQQVQSDAAQNYTIFYSISGPGVDKEPFNLFFINKDTGDIFCTRSIDREQYEQFPLYAYATTADGYAPEYPLPLLFKVEDDNDNAPYFENKVTIFSVPENCRTGTSVGKVTAIDHDEPDTLHTRLKYKILQQIPDHPKHFSIHPDTGVITTTTPLLDREKCDTYKLIMEVRDMGGQPFGLFNTGTITISLEDENDNSPYFTETSYFTEVEENRIDVEILRMAVRDQDLPNTPHSKAIYKILQGNENGNFKISTDPNTNEGVLCVVKPLNYELNRQIVLQIGVLNEAQFSKAANAQTPTMCTTTVTVKIKDLDEGPECQPSVKVIQSKDGLPAGKELLGYKAVDPEKGSSEGLRYKKIGDEDNWFEINEHTGNLKTVKVLDRESKFVKNNQYNVSVIAMDADGRSCTGTLVVFLEDDNDHPPDIREKEVTICRHDKDFAVLEPVDLDGPDNGPPFQFFLDNAASKLWTIETKDGKTAILRERQNLDYDTYTVPIQVKDRHGFAARHILAVRVCDCTTPSDCKMTPKGVRDIKPSNVILGRWAILAMVLGSALLLCILFTCFCVTAKKTVKKCFPEDVAQQNLIVSNTEGPGEEVMEANMRLPTQTCNICDTSVSVGTLGGQGVKTQQSFEMVKGGYTLDSSKGGGHQTLESVKGLGQGGMDTGRYGYTEWHSFTQPRLGEKVYLCGQDEEHKHSEDYVRSYNYEGKGSVAGSVGCCSDRQEEEGLEFLDHLEPKFRMLAKTCVKK

SEQ ID NO: 745 - protein, 527 aa, Sus scrofa
MADNRDPASDQMKHWKEQRAAQKPDILTTGSGNPIGDKLNILTAGPRGPLLVQDVVFTDEMAHFDRERIPERVVHAKGAGAFGYFEVTHDITRFSKAKVFEHVGKRTPIAVRFSTVAGESGSADTVRDPRGFAVKFYTEDGNWDLVGNNTPIFFIRDAILFPSFIHSQKRNPQTHLKDPDMVWDFWSLRPESLHQVSFLFSDRGIPDGHRHMNGYGSHTFKLVNEKGEAVYCKFHYKTDQGIKNLSVEDAARLSQEDPDYGIRDLFNAIATGNYPSWTFYIQVMTFQEAEAFPFNPFDLTKVWPHSEYPLIPVGKLVLNRNPVNYFAEVEQMAFDPSNMPPGIEPSPDKMLQGRLFAYPDTHRHRLGPNYLQIPVNCPFRARVANYQRDGPMCFQDNQGGAPNYYPNSFSAPEQTHSALEHCTRYSGDVQRFNSANEDNVTQVRTFYLNVLNEEERKRLCENIAGHLKDAQLFIQKKAVKNFSDVHPDYGARIQALLDKYNAEKPKNAVHTYVQAGSHLAAREKANL

SEQ ID NO: 746 - protein, 264 aa, Sus scrofa
MEEVRDPQALGGGMEADEPASPQEPPSPPPPPSPLAPAAPETPGLPTLEQPTEAYARQLLLQEWAPPGGSLELPPRLTWKLLFLRRPLYRNLLRSPNPEGINIYEPAPPTGPTQQPLETLGNFRGWHIRTEKLQQNLSWTVKQQCVDLLAEGLWEELLDDEQPHITVMDWCVYEDSQLDTCVYELHVWLLAADRRTVIAQHHVAPRTSGRGPPGRWVQVSHVFRHYGPGVRFVHFLHKTKNRMERGGLRRTRATDSSVSVQFRE

SEQ ID NO: 747 - protein, 509 aa, Oryza sativa
  source: /note="subsp. japonica"
MEFSPRAAELTTLLESRMTNFYTNFQVDEIGRVVSVGDGIARVYGLNEIQAGEMVEFASGVKGIALNLENENVGIVVFGSDTAIKEGDLVKRTGSIVDVPAGKAMLGRVVDALGVPIDGKGALSDHERRRVEVKAPGIIERKSVHEPMQTGLKAVDSLVPIGRGQRELIIGDRQTGKTAIAIDTILNQKQMNSRGTNESETLYCVYVAIGQKRSTVAQLVQILSEANALEYSILVAATASDPAPLQFLAPYSGCAMGEYFRDNGMHALIIYDDLSKQAVAYRQMSLLLRRPPGREAFPGDVFYLHSRLLERAAKRSDQTGAGSLTALPVIETQAGDVSAYIPTNVISITDGQICLETELFYRGIRPAINVGLSVSRVGSAAQLKAMKQVCGSLKLELAQYREVAAFAQFGSDLDAATQALLNRGARLTEVSKQPQYEPLPIEKQIVVIYAAVNGFCDRMPLDRISQYEKAILSTINPELLKSFNEKGGLTNERKIELDAFLKQTAKEIN

SEQ ID NO: 748 - protein, 961 aa, Oryza sativa
  source: /note="subsp. japonica"
MAALVRPAVLPVCAMTGGGGNDKRSPPQQRSWWGGNKQRLPHQPRRQPGGNGGRGGGGGALDQVLGVLRRDGEFLQAAAGAPLRDIFWLRFLEKKKQQRRRKQPKPKPKPPEQQQQQEEAAAAIQAPSFPPPSYQPGLSCLDLMTADFEALKLYIGYSKHAIEQQFLKGKRQPQHQQTPKPKLQQQQQQQKKKQQQQEQQNQTLQPPAFPPPSYPPGLSCMELMMADIEALKLYINYYVAILTTPLPQHYDPEILSRYFTSRPHILAFRTIQIIFAFVSAAVKMQISKRTNLITDATYSCNSTGSKGFNASQYMVGQLLKETFLDLGPTFVKVGQSLSTRPDITGSEISEALAELHEKVPPFPRKDAMKIIEGEFELPVSHIFSYISDEPVAAASFGQVYQGRTVDGALVAIKVQRPNLLPSVLRDIYILRLGLSFVRKVAKRKSNIALYADELGKGLVGELDYNIEAANATKFLEYHSRYSFMLVPKVLKQLTRRRVLTMEWVSGENPTDLLSLSKGISSEIAESSEKQKIEATARLLDLVNKGVEASLVQLLETGLLHADPHPGNLRYTPEGRVGFLDFGLLCMMEKKHQHAMLASIVHIVNGDWASLVYDLTAMDVVPPRTNLRRVTMDLEDALGEVTFEDGIPDIKFSRVLGKIWSVAFKYHFRMPPYYTLVLRSLASLEGLAIAADGTFKTFQAAYPYVVRKLLSDNSVATRRLLHQAIFNKRKEFQWNKITVFLKLASARGNFRYNTGVLPERKGLDVAKLVEISDASSSLHLNRATPERALHTANLCLRLLLSKESIVIRRLVMTANAKSLARDLISKDASIYRVLLSRVLADVIFQWMVKATGFKRAGQLEPHPRVTAGKNDEDLGLSKEAPALVTFQTAVRDRRLKVIFSKFVRDIREDPILMVRVSWNMFAISVVSAAIGVHRFIVVLSEEFLSTLPPPVPPPRLVQIQSI

SEQ ID NO: 749 - protein, 322 aa, Bos taurus
MSSKPQSIGVIGAPFSKGQPRGGVEEGPTVLRKAGLLEKLKELECDVKDYGDLSFADNLDDSPFQIVKNPRCVGKASEKLADVVAEVKKTGRISLVLGGDHSLAIGSISGHARVHPDLCVIWVDAHTDINTPLTTKTGNLHGQPVSFLLKELKEKMPEVPGFYWVAPCISAKDIVYIGLRDVDPGEHYILKTLGIKYFSMTEVDKLGIGKVMEETFSYLLGRKKRPIHLSFDVDGLDPSFTPATGTPVQGGLTYREGLYITEEIYKTGLLSGLDIMEVNPSLGKTPEEVTRTVNTTVAITMACFGVAREGNHKPIDYLSPPK

SEQ ID NO: 750 - protein, 446 aa, Bos taurus
MTMFENVTRALTRQLNPRGDLTPLDSLIDFKRFHPFCLVLRKRKSTLFWGARYVCTDYTFLDILEPGSSPSDPTDSGNFGFKNMLDARVEGEVDVPKTVKVKGTAGLSRNSTLEVQTLSVAPKALETLHQERKLMAEHPFLEEMRRRGENLYVVMEVVEAVQEVTLERAGRAEGCFSLPFFASLGLQGSVNHKEAVTIPKGCVLAFRVRQLMVKGKDEWDIPHIYNDNMHTFPPGEKPEDEKFTLIQASDVGAVHEDFRTLKEEVQRETQEVEKLSPEGKSSLLSSLSKLLGKKKELQDLELTLEEALGKGHEETLEALPKNVLLSKGAMDAILYFLGALAELSEAQQKLLVKSMEKKILPVQLKLVESTMEQNFLQDKEGVFPLRPELLSSLGEEELTLTEALVGLSGLEVQRSGPQYTWDPDTLPRLCALYAGLSLLQLLTKAS

SEQ ID NO: 751 - protein, 563 aa, Bos taurus
MCDQQQIQCYQPHPQYCVTCSPCYISQTPCANSQVVVQAPCEMQIVECPAPCPVQVSQVKCQAPCQSKTTEVKGKAPCESKTTQVKGKASCESKTTQVKGQAPSQPQFTCVQCQVPCQSEVSYVQCEGPCPVQTCYVECAPVCYTETCYVECPGQSYVPCPAPQPVQTYVTGPLVCQPQGRFSTQCQYQGSYSGCDPQLQSRASFSTWAPQCQTRGSYGSFPAQSRSRSTSRCLPPRQLQPSYRSCSPPRRSEPYYSSSCLPSRCSLGSYNYCTPPRRSEPIYNSDCSRRPTLGCSQRCGPKCRIEISSPRCPRQVPPQKCPVQIPPIRRCSESCAPRPSWGTSCPDLRSRAEPCPLPSFHPPRRLDQCPEPSLRRSPPPAPCPRPLPAPRTCSRPERCVSPEFRPCSPPRRLSEPCLYPEPRPVPYPAPRHPRPVQCDLSAPRPYPQPYERQESFPLLEPIPLPEPIPLPSPCPSPEPCVEPRPNPCTGDLGCHESSPHRLDTEAPICGPAGYNWWQDSEPGCRPCDVGLPESQGLGGCGDQGGVSVGMKGGTRGGVKGAYF

SEQ ID NO: 752 - protein, 463 aa, Saccharomyces cerevisiae
  source: /note="strain FostersB"
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQAEPSQGVAARENSSEETASKKEAAPKKEAAPKKEVTEPKKADQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGREAVTFLKTVKELIEDPRKMLLW

SEQ ID NO: 753 - protein, 832 aa, Saccharomyces cerevisiae
  source: /note="strain FostersB"
MGSSLRSFIKDVRGAKTLADERAIITKQSAKIRTKLRDDHLPHEKRRVNIQKLLYLYILGEKTHFGQVESINLIASDDFVDKRLGYLAATLLLDESEDLLTLLTNMLNNDLHHPNKYAVSLALTSLGFLSSPELARDLYPDVENIIKNSRDPFLLKKALQCAAKLIFKDVSLLEIFNIEDITKILSSHSICTHGVLLGVTKIIQSILLIGLNRKKDEDEDEDGIDYSNDILSPLSLLLRDFFIRLENMNSKNIEPGYDVQGICDPFLQCEIIYTLKLYFQVGELLNSNNVLDYKDNFCDLLTRIATNTDSTKNSGQAILYETVKTIFSLDLNQPLRVLGINILAKFLAGKDNNTKYVSLNTLLKVVPQEPTAVQRHRKFISHCLQDTDVSIRMRALELSFAILDDSNLVELVNELMKFLAKQDEDSKDLIIYTIDHLIDTFDTRVVKDESWKLEVFFNILKLVGSFINYEKINDILIIINNTSQLSDKSEFLRKMLTISLNGTSAEISEENIGWQLVLIWCIGEYGDLVLNEGNKNGADIINESSITDYLLTLQKLYTATNLKIINYILTAALKLSVRFHDAKNIEKLRQLILSYTDSTDLSLQMKSNQYEIFFNQSISVKKIILETMPKFEKITEEQDNGKALSKNLISNEPVDLLSDLLGEDSKAESKASTGDNVKPIDILEEIFGEKNDIAQLPKNANKEESINHSSAVEANSGVTLPLDANKIYDSSSLNVYASLLSANSGLAHLDLYFQAKSLISDLKTFCAVPKAQKLTLGQLYPSSTINASQICKQSLKISGSGKLKLRVKLDFHLNGSSSITNEQFDHKFDETL

SEQ ID NO: 754 - protein, 437 aa, Vitis vinifera
MAPKRPPPAEDPPAPSSTSEEEEENEENEENEEEEEEEEESSPEESSEEEEEGEENKSTVLTPPPAVDKKASSNKLVATTPAKSTPQSSSEDEEDGSESESESDSPPKSRRSSRGADPTIKPIATKPMEETPKSKKARSKPGVSVTPSPVKSSPVKPSNSKRPGEIGLERKESKRAKKKEPEAEAEEEEDGKKTGDDSKKQMFQRIWSEEDELGILKGMIDYSAKNGSVPYPNGDMNEFYDFVKNTLHGDFSRVQLTDKARRLKKKYSNNVSRAKLGEDPTFQKPHEQRAFELSKKIWGGEGNSVGVQQSNKANGKARKNQKPNKAVKVEDVEVLSVINGDDKEAVKLENEPKSEPPKKYSLVVSDFTRINESVGMSSSMDRAIEIGLGLLSEPLKAELKEKWKELEDEEFQLYMKKLDLIQMEARVSMQAYRAKHQ

SEQ ID NO: 755 - protein, 229 aa, Glycine max
MEEKAKAEQKKIGMTETWLKKHRLLYNGATRHPLIISIRDGTINTASFKTWLAQDYLFVRAFVPFVASVLIKAWKESDCSGDMEVILGGMASLEDEISWFKTEANKWGISLSDVVPQQANKNYCGLLESLMSPDAEYTVAITAFWAIETVYQESFAHCIEEGSKTPPELKETCVRWGNEAFGKYCQSLQNIANRCLQKASDEELKKAEVMLLSVLEHEVEFWNMSRGNV

SEQ ID NO: 756 - protein, 1474 aa, Ovis aries
MFSFVDLRLLLLLAATALLTHGQEEGQEEGQEEDIPPVTCVQNGLRYHDRDVWKPVPCQICVCDNGNVLCDDVICDELKDCPNAKVPTPPRPVSPHPPPPPPPPTTTKQRGGRGGPCPRPGAHRPSHSPPQGPAGPPGRDGIPGQPGLPGPPGPPGPPGPPGLGGNFAPQLSYGYDEKSTGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPSGPPGPKGNSGEPGAPGSKGDTGAKGEPGPTGIQGPPGPAGEEGKRGARGEPGPAGLPGPPGERGGPGSRGFPGSDGVAGPKGPAGERGAPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGAPGKDGVRGLTGPIGPPGPAGAPGDKGETGPSGPAGPTGARGAPGDRGEPGPPGPAGFAGPPGADGQPGAKGEPGDAGAKGDAGPPGPAGPAGPPGPIGNVGAPGPKGARGSAGPPGATGFPGAAGRVGPPGPSGNAGPPGPPGPAGKEGSKGPRGETGPAGRAGEVGPPGPPGPAGEKGAPGADGPAGAPGTPGPQGIAGQRGVVGLPGQRGERGFPGLPGPSGEPGKQGPSGASGERGPPGPMGPPGLAGPPGESGREGAPGAEGSPGRDGAPGAKGDRGETGPAGPPGAPGAPGAPGPVGPAGKSGDRGETGPAGPAGPIGPVGARGPAGPQGPRGDKGETGEQGDRGIKGHRGFSGLQGPPGPPVSMLSPSPAPSPASSLQGPPGSAGTPGKDGLNGLPGPIGPPGPRGRTGDAGPAVSPPTLSAHGPPALKAPSPRSRYDLSFLPQPPQEKAHDGGRYYRADDANVVRDRDLEVDTTLKSLSQQIENIRSPEGSRKNPARTCRDLKMCHPDWKSGEYWIDPNQGCNLDAIKVFCNMETGETCVYPTQPSVPQKNWYISKNPKDKRHVWYGESMTGGFQVREGGQGSDPADVAIQLTFLRLMSTEASQNITYHCKNSVAYMDQQTGNLKKALLLQGSNEIEIRAEGNSRFTYSVTYDGCTSHTGAWGKTVIEYKTTKTSRLPIIDVAPLDVGAPDQEFGFDIGSVCFL

SEQ ID NO: 757 - protein, 1462 aa, Ovis aries
MPKNAAVSNLDVESKLSVYYRAPWHQQRNIFLPATRPPCVEELHRQARQSLQALRREHRSRSDRREQRAAAPIPAAAPPLPAYPPAHSQRRREAKDRHFLTFNSTRSPSPTECCHMTPWSRKSHPPEDEDTDVMLGQRPKNPVHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRRSGTRDSECQTEDILIAAPSRRRIRAQRGQSIAASLSHSAGNISALADKGDTVFTTAVSSRTRSRSLPREGNRAGDAEPKVGAKPSAYEEGEPFVGDQERTLTDCSEAPSSPGAQEHQPALSLACSQHLHSPQHKLNERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDTSVFVTEQYNDQLEKVRGHRTNSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGSKNYVCHYAALGPENGQGIGVPPALSDCAWQDYLDHRRQGRPSISFRKPKAKPTPPKRSSSLRKSDGNADTSEKKEPKTSSGQLLPHSSREMKLPLDFSNTPSRMENANLPTKPEPSWMNQNEHGIKEPQLDTPDVPPFKDEGAESTHYADLWLLNDLKTNDPYRSLSNSSTATGTTIIECIKSPESSESQTSQSESRATTPSLPSVDNEFKLASPEKLAGLASPSSGYSSQSETPTSSFPTAFFSGPLSPGGSKRKPKVPERKSSLQQPSLKDGALSLSKDLELPIIPPTHLDLSALHNVLNKPFHHRHPLHVFSHNKQNTVGETLRSNPPPSLAITPTVLKSVSLRSISKSEEVKQKEGNNTDLPYLEESTLTTGKIRPHVIKKSLPCQYATEDTILSFLDSSAVEMGPDKLQLEKKHTFDVKHHCDPETVTSAGSNLLDSSVTRDQMHMESEPVSENKPSKSCDFLMEGFQRVSVARPNDSDGKTLQYGAGPDGALAQVQKLSFVDREEAAPPESVDVLTPQSDSPTRVTDIGYQLKPQLGMSHHHDKVPGNISSEAEISTINPCPEKCSEQENIASGISAKSASDNSGAEETQGSVDEVSLKESSPSDDSVISPLSEDSQAEAESVFVSPNKPRTTEDLFAVIHRSKRKVLGRKDSGDMSVRSKSRASLGSSSSNSAGSVTSPNSNVTTPNSQRSPGLIYRNAKKSNTSNEEFKLLLLKKGSRSDSSYRMSATEILKSPILPKPPGDLTAESPQSPHEAHQGSPGTEALSPLSPCSPRVNAEGFSSKNFVTSASARVGRSRAPPAASRYSVRCRLYNAPMQAISEGETENSDGSPHDDRSSQSST

SEQ ID NO: 758 - protein, 828 aa, Sus scrofa
MPSPTPPSGTTDGARSDVGRWGGNPWQPPTTPSPEPEPEPDRRSRRDGRSFWARCCGCCSCRNTDDDWGPRGDRGAGSRDRGSGSGSRRPDSRGSDSRRPGSRGSGVNAAGDGTIREGMLVVKGVDLLSSRSDQNRREHHTDEFEYDELIIRRGQPFYMVLLLSRPYESSDYVALELLIGNNPEVGKGTHIIIPVGKGGSGGWKAQVTKSSGQNLNLRVHTSPNAIIGKFQFTVRTRSEAGEFQLPFNPRNEIYILFNPWCPDTEDIVYVDHEDWRQEYVLNESGRIYYGTEAQIGERTWNYGQFDHGVLDACLYILDRRGMPYAGRGDPVSVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFNGWQVVDATPQETSSGIFCCGPCSVESIKNGLVYMKYDTPFIFAEVNSDKVYWQRQNDGSFKIVYVEEKAIGTLIVTKAIGSHMREDVTHIYKHPEGSEAERKAVETAAAHGSKPNVYATRDSAEDVAVQVEAQDAVMGQDLTVCVVLTNRGGSRRTVKLHLYLSVTFYTGVTGSVFKESKKEVVLEPGASERVTMPVAYKEYQPHLVDQGAMLLNVSGHVKENGQVLAKQHTFRLRTPDLSLTLLGAAVVGQECEVQIVFKNPLPVTLTNVVFRLEGSGLQRPKILNVGDIGGNETVTLRQTFVPVRPGPRQLIASLDSPQLSQVHGVIQVDVAPAAGGGVFSDARGNSRSGETIPMASRGEA

SEQ ID NO: 759 - protein, 143 aa, Sus scrofa
LEDFKLDFGNSQGKTSETWHGGIATFESPGDEVWGVVWKMNKSNLSSLDEQEGVKSGMYVPIEVNVSAQKGKEITCRSYQMTNYESAPPSPQYKKVIICTGAKENGLPLEYQKKLNAIEPNDYKGKVSEEIEDIIKRGETKAH

SEQ ID NO: 760 - protein, 858 aa, Bos taurus
MVNFTVDQIRAIMDKKANIRNMSVIAHVDHGKSTLTDSLVCKAGIIASARAGETRFTDTRKDEQERCITIKSTAISLFYELSENDLNFIKQSKDGSGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPATGKFSKSANSPDGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEETQVAGTPMFVVKAYLPVNESFGFTADLRSNTGGQAFPQCVFDHWQILPGDPFDNTSRPSQVVAETRKRKGLKEGIPALDNFLDKL

SEQ ID NO: 761 - protein, 559 aa, Bos taurus
MGSSRASQIGCVGGRGVLALLLAGLLLQGTLAKSIGTFLDPCKDPTRITSPNDPCLLGKGGSSSSSGGSSGSSGGGSSGSSSGSSGSSSSSSGVSSGLSGHPSGGSSGSSSGSNVSSGPSGSSSGSSGVSSGLSGRPSGGYSGSSSGVSSSASGSGSTGSIVAHGGSSGSSLFKPGTGYSQISYSSGSGSSLQGASSSLPSGSISSPSGGGLSSSGSQTSWLSSSGGQKVSSKLRPCGPDIPDSPCSGGPIVSHSGPYISSSHSVSGGQRPVVVVVEQHGSGGPGGPGVGQRVPCLNGGPPGKPCPPITSVDQYGSYEVVGGSSNSYLVPGMTYSGGKIYPVGYFTKEGPIKGSPGVPSFAAGPPISEGKYFSGNPIIPSHSSSSSNIYQSGASSTVVFQPVGSGGVQPCVVGSSGSKGPCSLSSSGVSSSSSISSSSSSSFHPCGGVSQGPCSPPGTGSLSGSSSSLSGGKIILQPCGSKSSAPGHPCISVSSSTLSGGPNGSPQPDPSAGAKPCGPGNSGKTPCRSIRDILAQVKPLGPQLADPEVFLPQGDLPNSS

SEQ ID NO: 762 - protein, 145 aa, Ovis aries
MLTAEEKAAVTGFWGKVKVDEVGAEALGRLLVVYPWTQRFFEHFGDLSNADAVMNNPKVKAHGKKVLDSFSNGMKHLDDLKGTFAQLSELHCDKLHVDPENFRLLGNVLVVVLARHHGNEFTPVLQADFQKVVAGVANALAHKYH

SEQ ID NO: 763 - protein, 375 aa, Gallus gallus
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 764 - protein, 142 aa, Bos taurus
MVLSAADKGNVKAAWGKVGGHAAEYGAEALERMFLSFPTTKTYFPHFDLSHGSAQVKGHGAKVAAALTKAVEHLDDLPGALSELSDLHAHKLRVDPVNFKLLSHSLLVTLASHLPSDFTPAVHASLDKFLANVSTVLTSKYR

SEQ ID NO: 765 - protein, 2335 aa, Bos taurus
QPADMTSATEFENVGNQPPYSRINARWDGPDDELDNDNSSARLFERSRIKALADEREVVQKKTFTKWANSHLVHVSCRITDLYKDLRDGRMLIKLLEVLSGEMLPKPTKGKMRIHCLENVDKALQFLREQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFEVAERELGIIPLLDPEDVFTENPDEKSIITYVVAFYHYFSKMKVLAVEGKRVGKVIDHAIETEKMIEKYSGLASDLLTWIEQTITILNSRKFANSLAGVQQQLQAFSTYRTVEKPPKFQEKGNLEVLLFTIQSRMRANNQKVYTPHDGKLVSDINRAWESLEEAEYRRELALRDELIRQEKLEQLARRFDRKAAMRETWLNENQRLVAQDNFGYDLAAVEAAKKKHEAIETDTAAYEERVRALEDLAQELERENYHDQKRIMARKDNILRLWDYLQELLQARRQRLEKTLDLQKLFQDMLHSIDWMDGIKAHLLSAEFGKHLLEVEDLLQKHKLMEADIAIQGDKVKAITTATLQFTEGPGYQPCDPQVIQDRVSHLEQCFEELSNTAAGRKAQLEQSKQLCKFFWEMDEAESWIKEKEQIYSSLDYGKDLTSVLILQRKHKAFEDELRGLDAHLDQIFREAEGMVARKQFGHERIEVRIKKVSDQWNELKDLAAFCKKNLQDTENFFQFQGDADDLKAWLQDAHRLLSGEDVGHDEGATRALGKKHKDFLEELEESRGVMEHLEQQAQAFPQGFQDSPDVTNRLQALRDLYQQVVAQADMRQQRLQDALDLYTVFGETDACELWMGEKGKWLAQMEIPDTLEDLEVVQHRFDILDQEMKTLMTQIDGVNLAANSLVESNHPRSAEVKKYQDRLNTRWQDFQTMVSERREAVDSALRVHNYCVDCEETGKWIADKTKVVESTKDLGRDLAGVIAIQRKLSGLERDVAAIQARLGTLERESQQLMASHPELKEDIEQRQAYVEELWQGLMQALKSQEASLGEASQLQAFLQDLDAFQAWLSTTQKDVASKDMPESLPEAEQLLQQHAAIKDDIDRHQESYQKVRVSGEKVTHGQTDPEYLLLGQRLDGLEKGWDALSRMWESRSQALTQCLGFQEFQKDAKQAEAILSNQEYTLAHLEPPDSLEAAEAGIRKFEDFLLSMENNRDKVLSPVDSGNKLVAEGNLYSDKIKEKVQLIEDRHRKNNEKAQEASDLLKDNLELQNFLQNCQELTLWINDKLLTSQDVSYDEARNLHNKWLKHQAFVAELASHQGWLENIDAEGKQLMEEKPQFAVLVSQKLEALHQLWDELQANTQEMAQHLSAARSSDLRSQTQADLNKWIRAMEDQLQSDDLGKDLTSVNRMLAKLKRVEDQVNVRKEELQELFAQMPSLGEEAGDEALSIEKRFLDLLEPLGRRKKQLESSRAKLQISRDLEDETLWVEERLPLAQSTDYGTNLQTVQLFMKKNQTLQNEILGHTPRVEDVLHRGQQLVAAAEIDCQDVEERLGKLQGSWDTLQEAAASRLQHLREASEAQQYYLDAGEAEAWIGEQEFYVFSDENPQDEESAIVMLKRHLRQQRAVDEYGRNIKQLAGRAQGLLSAGHPEGEQIIRLQGQVDKQYAGLKDMAEERRRKLENMYHLFQLKREVDDLEQWITEKDTVASSSEMGQDFDHVTVLRDKFRDFARETGAIGQERVDNVNAIIERLIDAGHSEAATIAEWKDGLNEMWADLLELIDTRMQLLAASYDLQRYFYTSSEILGLIGEKHRELPEDVGLDASTAESFHRTHTAFERELHLLGEQVQQFQDVAARLQTAYAGEKADIIQNKEQEVSAAWQALLDACAGRRTQLVDTADKFRFFSMARDLLSWMESIVRQIETQEKPRDVSSVELLMKYHQGIQAEIETRSKNFSTCLELGESLLQRQHQASEEIREKREQVVSRREEMQEKWEARWERLRMLLEVCQFFRDASVAEAWLIAQEPYLASRDYGHTVDSVEKLIKRHEAFEKSAASWEGRFAALEKPTTLELKERQTPERTEEEPGLQEEEGETAGEAPRGPHQATTERTSPGEEERPWPQDLQPPPPPGPHEDGQEEKSSTDERPATEPLFKVLDTPLSEGDEPTTLPAQRDRGHSVQMEGFLGRKHDLEGPNKKASNRSWNNLYCVLRNSELAFYKDAKNLALGVPYHGEEPLALRHAICEIAANYKKKKHVFKLRLSNGSEWLFHGKDEEEMLSWLQGVSTAINESQSIRVKAQSLPLPPITGPEASLGKKDKEKRFSFFPKKK

SEQ ID NO: 766 - protein, 447 aa, Oryza sativa
  source: /note="subsp. japonica"
MREILHIQGGQCGNQIGAKFWEVVCAEHGIDATGRYDGDSDLQLERVNVYYNEASCGRFVPRAVLMDLEPGTMDSVRSGPYGHIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADDEGEYEDEEEEADLQD

SEQ ID NO: 767 - protein, 447 aa, Oryza sativa
  source: /note="subsp. japonica"
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIPFVPISGFEGDNMIERSTNLDWYKGPTLLEALDQINEPKRPSDKPLRLPLQDVYKIGGIGTVPVGRVETGVLKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMIPTKPMVVETFSEYPPLGRFAVRDMRQTVAVGVIKNVEKKDPTGAKVTKAAAKKK

SEQ ID NO: 768 - protein, 632 aa, Glycine max
MAGKGEGPAIGIDLGTTYSCVGVWQHDRVEIIANDQGNRTTPSYVGFTDTERLIGDAAKNQVAMNPINTVFDAKRLIGRRFSDASVQSDIKLWPFKVLSGPAEKPMIQVSYKGEDKQFAAEEISSMVLMKMREIAEAYLGSSIKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKNKKDISGNPRALRRLRTACERAKRTLSSTAQTTIEIDSLYEGIDFYSTITRARFEELNMDLFRKCMEPVEKCLRDAKMDKRTVHDVVLVGGSTRIPKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVEAKNALENYSYNMRNTIKDEKIGGKLDPADKKKIEDAIEQAIQWLDSNQLGEADEFEDKMKELESICNPIIAKMYQGGAGPDVGGAMDDDVPAAGSGAGPKIEEVD

SEQ ID NO: 769 - protein, 248 aa, Ovis aries
MERASLIQKAKLAEQAERYEDMAAFMKSAVEKGEELSCEERNLLSVAYKNVVGGQRAAWRVLSSIEQKSNEESSEEKGPEVQEYREKVETELRGVCDTVLGLLDTHLIKEAGDAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPEEPQS

SEQ ID NO: 770 - protein, 450 aa, Oryza sativa
  source: /note="subsp. japonica"
MREIISIHIGQAGIQVGNACWELYCLEHGIEPDGTMPSDTTVGVAHDAFNTFFSETGAGKHVPRAIFVDLEPTVIDEVRTGSYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDVTEFQTNLVPYPRIHFMLSSYAPVISAEKAYHEQLSVPEITNAVFEPSSMMAKCDPRHGKYMACCLMYRGDVVPKDVNAAVATIKTKRTVQFVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGADDENDDGEDY

SEQ ID NO: 771 - protein, 563 aa, Vitis vinifera
MIRSRGIFLGVVLWVFFAMEGNQSVATLIDSTTCKIQQLQKAFAELESHRALTLNLKWKQLEEHFHGLEKSLKRRFNELEDQEKEFEMKTMEAQQLLEKREAAVVAKEQDSLRRLQEKRDAAVFAIVNALGKHDKLSSSGHAVVASENRAGVPIMEEKPLDAMAAESNLEDVKGSSEIENVELKSYPQLIKLCEDMDSEGLHKFISDNRKNLAAMREEIPQALKAAMDPARFVLDSLEDFYRIEIPNLDGKKDANLLGLRRTCIMLMECLSILLTNPDLGPVSEVSDDVKEIAKAIAEEWKPKLDALDIDASNGNSLEAHAFLQLLATFGIASDFDQEEISRLIPMVSRRRQTADLCRSLGLSEKMPGVIEILINSGRQIDAVNLAFAFELTEQFSPVPLLKSYLKEARKASSPLKPGNASPTAQNEVNERELTALKAVIKCIEDHKLEEEYPLDPLQKRVVQLEKAKADKKRATEAAKPQPKRPRANGVGYGPRATNVAADKTFYARVTDRYPQYIYDRPYVYPVSTDNHGPSLLGSATYNLSPSHGNYFGNGYQYQAPYLH

SEQ ID NO: 772 - protein, 703 aa, Vitis vinifera
MSSHLSAEVKRPVVSFRSSIWGNRFINYTPDDEITRAYNQQRVEDLKEEVKRELMVAAGKPSQHLNFIDAVQRLGMAYHFEEEIEEAIGHIYDNYHHSDDKYDDLCNVSLRFRLLRQQGYNISCDIFERFKDENGSFKECLNNDVEGMLGLYEAAHLRVQEEDILDEALAFTTAHLESLVEDLDYPLAAQATQALYRPIRKGLERLEARPHISIYQDEASHSKALLELAKLDFNLLQSLYKKELSYITRWWKDLDFSSKLPFVRDRVVETYLWIVAECFEPQYSYARRIQTKLLVLITVIDDVYDAYGTLEELELFTEAIERWDNNSIDSLPEYMKPCYQAVLDVYKEIEEKENEERPYCVHYAKKAVRSVRAYFNEGKWLHAEYVPTMEEYMGVALVSSDVPMFTIISFVGMGMMATKEAFDWVLNGPKIVRACSTIITLAYNQQRIEDLKEEVRRELMAAAGKPSQQLNFIDAVQRLGVAYHFEEEIEEALGHTFKRFTDENGSFKECLIKDVEGMLGLYEAAHLRVQEEDILDEAIAFTTTHLRSLVEHLDCPLAAPVNRALYRPIRKCLERLEARPYITMYQDEASHSKDLLELAKLDFNQLQSLYKKELSHITRWWKDLDFSSKLPFFRDRAVETYLWIAVACFEPQYSYARRIQAKLLAIATVIDDMYDAYGTPEELELFTEAIERYDIKILHLRGG

SEQ ID NO: 773 - protein, 2408 aa, Ovis aries
MESDGPKVLETAEEIQERRQEVLTRYQRFKERVAERGQKLEDSYHYQVFIRDADDHEKWISEKIKIATDKSYEDPTNIQGKYQKHEAFEAEVQAKSSILPDLEETRETRFPEGHFAHEDTKGLLEELNRLWDLLLELTRKKGALLLRALKLQQYFQECADILEWIGDKEALVTSVELGDDWERTEVLHKKFEEFLADLAVRKERVNEVNRYANECAEEKHPELPSIESKQKEVNAAWERLHGLALQRRKMLSSAADLQRFKRDVTEAIQWIKEKEAQVTSEDYGKDLVSSEALFHSHKTLERNLAVMNDKVKELCAKADKLKLSHPSDAAEIQQMKEDLVSNWEHIRNLATSRYEKLQASYGYQRFLSDYDELLGWMEEKTALINADELPKDVTGGEALLDRHQQHKHEIDSYDDRFQSADETGQALLDANHEASDEVLEKMSVLSNNRAALLELWEKRQQQYEQCLNLHLFYRDSEQVDSWMSRQEAFLENEDLGNSLGSVEALRQKHDDFEEAFTAQEEKITTIDKTATKLIDDKHYDSENIAAIRDQLLARRDDLRKRAATRRRLLEDSFLLQQLYQDSDDLKNWINKKKKLADDEDYKEILNLKSQVQKQKVFEEELAANKIRLNNIQKTGQEMIDSNHYASDKVADRLREVDSLWTELQEATEQKGIQLYEANRQLQFENNAEDLIQWLDEVEWQARSQDYGKGLADVQNLLRKHGLLESAVATRQDQVDTLTDLVTYFEEIIHPDAGNIRERQEYLVSQFEALKERLAYRKNKLIDLFHLYQIQRDIEDEEAWIQETEPSVASTYLGKDLIASKNLLNRHHVIQANIASHEPRIQMITEKGNKMIEEGHFAAEDVASRVKSLNENMESLQARATRRQNDLEANVQFQQYLVDLHEAEAWIREKEPIVDNTNYGADEEAAGALLKKHEAFLVDLKAFGNSIQALRDQAEACQEQQAAPVEVAAPEERVVALYDFQARYSREVTMKKDDVLTLLSSISKDWWKVETDDHQGFVPAVYVRKLARDEFPMLPQRKREEPGNIIQRQEQIENQYHSLLLRADERRRRLLQRYNEFLLAYEAGDMLDWIQEKKAENTGVELDDVWELQKKFDEFQMDLKTNEPRLRDINKVADDLQFEGLLTPEGAQIQQELNARWGSLQRLAEEQRQLLGSAHAVEMFHREADDTKEQIEKKCQALNTADPGSDLFSVQALQRQHENFERDLVPLGEKVEVLRDTADRLSESHPDATDDLQSKRLELKDAWDDLQELTKDRKENLQEALKFYQFLSQARDLQNWISGIGGMVSSKELAEDLTGTEIMIERHQEHRADMEAQDPAFQAFEDFGTDLTISGHRASPEIEEKLQAVRLERDELESAWEQRKKMLDQCLELQLFRGNCDQAESWMAARENYLRSDDKGSLDSLEALMKKRDDLDKAITDQENRITELDLFAEQLIAEDHYAKEEIAARNQRILDRWNILKEQLIAERMKLGDYADLKQFYHDLKDQEEWISEMLPIACDESYKDPTNIQRKYLKHKTFEDEVNSRAEQVEGVIFLGYALVERRACDGNEESVKDQIEELEKNWNYLLIRTTDKGQKLDEASRQQRFNTGIRDFEFWLSEAETLLTMKDQARDLASAGNLLKKHQLLEREMLARQDALQDLNTLAKNLISSGTFNTDQIMEKMDNVNERFLNVKELAAEHHEKLKEAYALFQFFQDLDDEEFWIEEKLVRVRSQDYGRDLQGVQNLLKKHRRLEGELVAHEPAIQNVLDMAETLGDKAAVGREEIQDRLDLLVQHWDQLQELTKARGIQLGESLEYLEFMENAEEEEAWISEKEALVAQGDSGDTLAATQSLQKKLEALENDFVVHEIRVQNVCAQGEDILSKGESQHKEKISNKIQALNEKIPSLAKSLAVWKSQLEDDYDFQQFNWKADVVEAWIAEKEANLKTNSDDADLAALSILLAKQDTLHASLQSFQQERLSEITDLKDQLVAAEHSQTKAIEERHAALLRRWEQLLQASEVHRQELLEKRRPLLEAEVLFMEFAHKASAFNNWCEKAEEDLSEPVRCVSLDAIRKLRKDHEAFLASLTKARADFNDLRELDKQIKALNVLSSPYTWLTVEVLERVWNHLFDIIKEREQELENEEARQINNFEMCQEFEQNASAFLNWILETRDYFLDGSLLKETGTLESQLEANKRKQKEIQAKKHQLTKIEDLGESLEEALVLDLKYSTIGLAQQWDQLYQLGMRRQHSLEQQIQARDITGLSEETRQEFETTFRHFDENLTGRLSHKDFRSCLRGLNYYLPMVEEGEPEPKFEKFLDAVDPGRKGYISKDEYIDFLTDKESENIRSSDELEDSFQALAEGKAYITKEDMKQALTPEQVSFCASRMQQYVDPRGRSQPAGYDYVGFISSYFGN

SEQ ID NO: 774 - protein, 181 aa, Oryza sativa
  source: /note="subsp. japonica"
SSQPKRRLRRRGRRRRFSPVTTTTEAHACRCSAVLHPTAVSRTLSLVDPSTGDPHPSGPKNFGGIRGAVVLAERSCLQKYQFSHGDVVLFKCPSDHRELFVKRLIALPGEWMQLPGTPDIIKIPEGHCWVEGDNAACSWDSRSFGPIPLGLIKGRVAHVIWPPSKIGRVDTKMPENRISPL

SEQ ID NO: 775 - protein, 786 aa, Gallus gallus
MSQQDVVAVLSERLLIAAYKGQVDNVVQLINKGAKVAVTKHGRTPLHLAAHKGHLHVVQILLKAGCDLDIQDDGDQTALHRAAVVGNTDVIASLIQEGCALDRQDKDGNTALHEACWHGFSQSAKVLVKAGANVLAKNKAGNTPLHLACQNSHSQSTRVLLLGGSRADLKNNAGDTCLHVAARYNHLPIVRVLLSAFCSVHEKNQAGDTALHVAAALNHRKVVKLLLEAGADTSVVNNAGQTPLEVARQHNNPEVALLLTKASQVSRFNRGRSLRKKRERLKEERRAQSVPRDEVVQSKGSVSAADDTQSSDQPAQGKTELKDEPRSTSPDPKGKKSKKKKPKEKVSALSDPISPADQQTLPRPQQNVPKRRSRHHCSSPPAPHEVRAYQLYTLYRGKDGKVMQAPINGCRCEPLINKLENQLEATVEEIKAEFGTVQDKMNIKLGQMESKTQHQLRVLDKLMAERLSAERTECLHRLQQHSELEKTEGEKRQISLVDELKTWCMLKIQNLELKLSGDSRSSRPKSTLSTCESLTETLDTENNPHSAKDCRATQPLLPAEGSHQHSYMALPNSLLEDGGRSRVPVSEQSFGQQFCSAEQQLIVAGAVQSSAPAQDVRPKDKAVSASTFHRFQQELPSSELLGSKSRHVRVQAALQPLTEPAKTEPQSCYFLNKGTQTKKSSKSGQSRHKALHHAGAPQSQEQQHSTLPVGQSPGPALRDTSQALEITQYFFEAVSTQMEKWYERKIEEARCQANQKAQQDKAALKEHIKSLEEELSKLRTKVQKES

SEQ ID NO: 776 - protein, 616 aa, Bos taurus
LRFSESDTSRMSCVARSGGGGGGAFGFRSGAGGFGSRSLYNLGGNKSISISVAGSRAGGFGGGRSSCVSGFGSGYGGGYGGGFGGGRGMGGGFGGAGGFGGAGGFGGAGGFGGLGGFGGPGGFGPGGFGPGGFPGGIQEVTVNQSLLQPLNVEIDPQIGQVKTQEREQIKTLNNKFASFIDKVRFLEQQNKVLETKWSLLQQQGTHPITGTNNLEPLFENYINSLRSYLDSILGERGRLDSELRNMQDLVEDFKKKYEDEINKRTAAENEFVTLKKDVDAAYMNKVELQAKVDALTDEINFLTTLYDMELSQMQSHVSDTSVVLSMDNNRSLDLDSIIAEVKAQYEEIAQRSKAEAEALYQTKLGELQTTAGRHGDDLKSTKSEISELNRVIQRLRAEIENVKKQIAKLQSAIAEAEQRGELALKDANAKLQELQAALQQAKDDLARLLRDYQELMNVKLALDVEIATYRKLLEGEECRMSGECPSAVSISVVSSSSTTSASAGGFGGGYGGGVGVGGGARSGFGGGSGFGGGSGFGGGSGFGGGSGISGSSGFGGGSGSGFGGGSGFSGSSGFGGGSSGFGSGSGGRSGVSGGGLSSGSSRGGSVRFSQSSQRTS

SEQ ID NO: 777 - protein, 1958 aa, Sus scrofa
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAHVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEDQIIMEDQNCKLAKEKKLLEDRIAEFTTNLMEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERAARNKAEKQKRDLGEELEALKTELEDTLDSTAAQQELRSKREQEVNILKKTLEEEAKTHEAQIQEMRQKHSQAVEELAEQLEQTKRVWGPGTGSGRLYHRGREGVARGAQAPALSNSHSVHQPARPESFMDLEFSEAQPLSRPPLTVLESGWRIKGEVPGDSSEPWPSTLGPVAISSSPPGTLCSAKVTGGQNPYKISKTSRFWILSSDLNGLEDLRQLRRGSESPPHLGRDLPAGPAQVTDMRKKMEDGVGCLELAEEAKRKLQKDLEGLGQRFEEKVAAYDKLEKTKTRLQQELDDLLVDLDHQRQSVSNLEKKQKKFDQLLAEEKTISAKYAEERDRAEAEAREKETKALSVARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDYMRELEDTRASREEILAQAKENEKKLKSMEAEMIQLQEELAAAERAKRQAQQERDELADEIANSSGKGALALEEKRRLEARIAQLEEELEEEQGNTELVNDRLKKANLQIDQINTDLNLERSHAQKNENARQQLERQNKELKVKLQEMEGTVKSKYKASIAALEAKIAQLEEQLDNETKERQAACKQVRRAEKKLKDVLLQVDDERRNAEQYKDQADKASTRLKQLKRQLEEAEEEAQRANASRRKLQRELEDATETADAMNREVSSLKNKLRRGDLPFVVPRRMGRKGAGDCSDEEVDGKADGAEAKAAE

SEQ ID NO: 778 - protein, 1864 aa, Sus scrofa
TYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHVQRKAMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMAETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKIQVAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHAAALEELSEQLEQAKRFKANLEKNKQGLETDNKELACEVKVLQQVKAESEHKRKKLDAQVQELHAKVSEGDRLRVELAEKANKLQNELDNVSTLLEEAEKKGIKFAKDAASLESQLQDTQNKQELLQEETRQKLNLSSRIRQLEEEKNSLQEQQEEEEEARKNLEKQVLALQAQLTDTKKKVDDDVGTIEGLEEAKKKLLKDAEALSQRLEEKALAYDKLEKTKNRLQQELDDLLVDLDHQRQIVSNLEKKQKKFDQLLAEEKNISARYAEERDRAEAEAREKETKALSLARALEEALEAKDEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEIANSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 779 - protein, 1458 aa, Sus scrofa
AQTAHIVLEDGTKMKGYSFGHPSSVAGEVVFNTGLAGYPEALTDPAYKGQILTMANPIVGNGGAPDTTALDELGLSKYMESDGIKVAGLLVLNYSDDYHHWLATKSLGQWLQEEKVPAVYGVDTRMLTKIIRDKGTMLGKIEFEGQSVDFVDPNKQNLIAEVSTKDVKVYGKGNPTKVVAVDCGIKNNVIRLLVKRGAEVHVVPWNHDFTNMEYDGLLIAGGPGNPALAEPLIQNVKKILESDRKEPLFGISTGNLITGLAAGAKAYKMAMANRGQNQPVLNITNRQAFITAQNHGYALDSTLPAGWKPLFVNVNDQTNEGIMHESKPFFGVQFHPEVSPGPLDTEYLFDSFFSLIKKGKGTTITSVLPKPALVASRVEVSKVLILGSGGLSIGQAGEFDYSGSQAVKAMKEENVKTVLMNPNIASVQTNEVGLKQADTVYFLPITPQFVTEVIKAERPDGLILGMGGQTALNCGVELFRRGVLKEYGVKVLGTSVESIMATEDRQLFSDKLNEINEKIAPSFAVESIEDALKAADTIGYPVMIRSAYALGGLGSGICPNKETLLDLSTKAFAMTNQILVERSVTGWKEIEFEVVRDADDNCVTVCSMENVDAMGVHTGDSVVVAPAQTLSNVEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIDGFTSRLPMNKEWPSNIDLRRELADPSSTRIYAIAKALEDNMSLDEIMKLTSIDKWFLYKMRDILNMEKTLKGLNSESITEETLKKAKEIGFSDKQISKCLRLTEAQTRELRLKKNIHPWVKQIDTLAAEYPSVTNYLYVTYNGQEHDINFDEHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVGYPCLLRPSYVLSGSAMNVVFSEDEMKKFLEEATRVSQEHPVVLTKFIEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENIDEKPLPTLEHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIALLTNFQVTKLFAEAVKKSRNVDAKSLFHYRQYGAGKAA

SEQ ID NO: 780 - protein, 222 aa, Bos taurus
MKFFIFTCLLAVALAKNTMEHVSSSEESIISQETYKQEKNMAINPSKENLCSTFCKEVVRNANEEEYSIGSSSEESAEVATEEVKITVDDKHYQKALNEINQFYQKFPQYLQYLYQGPIVLNPWDQVKRNAVPITPTLNREQLSTSEENSKKTVDMESTEVFTKKTKLTEEEKNRLNFLKKISQRYQKFALPQYLKTVYQHQKAMKPWIQPKTKVIPYVRYL

SEQ ID NO: 781 - protein, 591 aa, Meleagris gallopavo
MSRISYRSSTGGGMRGFSSGSAIVGGGSGTRSSFSSVSVSRVGGGRAGGGGGFGAGGGFGSRSLYNLGGSKRISLGGGLRSGAGAGYGFGGGAGFGLGYGGGAGAALGLGGAGGGGGYGLGGFGMGGPGFGGRGGPGFPCPPGGIHEVTVNQSLLAPLKLDIDPEIQKVRTHEREQIKTLNNKFASFIDKVRFLEQQNKVLETKWSLLQEQGHTVTRKSLEPLFESYINNLRRQLDSLMGERGRLDSELRSMQDMVEDFKNKYEDEINRRTGAENEFVVLKKDVDGAYMNKVELQAKADGLADEINFLRALYEAELSQMQQQVSDTSVVLSMDNNRSLDLNSIIAEVKAQYEDIANRSRAEAEAWYQNKYEELQVSAGRHGDDLRNTKMEISEINRMVQRLRNEIESVKKQCASLQAAIAEAEERGEMALKDAKSKLAELEDALQKAKADLARQLREYQELMNVKLALDIEIATYRKLLEGEESRLAGEGVGAVSVSVVSSSSGMGYGGGMGGGLGMGGGLGMGSGLGMGGGGSYTMSSSGGGGGFGGGSASYSYGGGSNFSSSSSRGVSSSTGGSVRIVSKTTTSKKTIR

SEQ ID NO: 782 - protein, 466 aa, Sus scrofa
MSTRTVSSSSYRRMFGGPGTASRPSSSRSYVTTSTRTYSLGSALRPSTSRSLYTSSPGGVYATRSSAVRLRSSVPGVRLLQDAVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEETLQREEAESTLQSFRQDVDNASLARLDLERKVESLQEEIAFLKKLHDEEIQELQAQIQEQHVQIDMDVSKPDLTAALRDVRQQYESVAAKNLQEAEEWYKSKFADLSEAANRNNDALRQAKQESNEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLESLPLVDTHSKRTLLIKTVETRDGQVINETSQHHDDLE

SEQ ID NO: 783 - protein, 369 aa, Solanum lycopersicum
MLCRGTFQAGNVAIGDHNECYKRFFNSVSIGCRKSFVSSCSVGARSGPVLAVATNETTKTKQMAYEPSLADRLRLGTMSEDGMSYKEKFIVRCYEVGINKTVTVETIANLLQEVGCNHAQSVGFSTDGFATTHSMRKLHLIWVTARMYIEIYKYPAWSDVVEIETWCQSEGRIGTRRDWILKDCATGEVIGRATSKWLMMNQDTRRLQKVTDEVRDELELYFPKELRLAFPEENNGSLKKIAKLEDPAEYSKLGMVPRRADLDMNQHVNNVTYIGWVLESIPQEIIDTHELETITIDYRRECQHDDVVDSLTSVEPIEDADALESHGSNGSATAPKDVNKSFLHLLRLSSDGLEINRCRTEWRKKSART

SEQ ID NO: 784 - protein, 811 aa, Saccharomyces cerevisiae
  source: /note="strain FostersB"
MLRQATKAPIQKYLQRTQLLRRSTPRIYTIVQCKRSICSFNARPRVANKLLSDIKTNALNEVAISTCALKSSYGLPNFKRTYVQMRMDPNQQPEMPALEQFGTNLTKLARDGKLDPVIGRDEEIARAIQILSRRTKNNPCLIGRAGVGKTALIDGLAQRIVAGEVPDSLKDKDLVALDLGSLIAGAKYRGEFEERLKKVLEEIDKANGKVIVFIDEVHMLLGLGKTDGSMDASNILKPKLARGLRCISATTLDEFKIIEKDPALSRRFQPILLNEPSVSDTISILRGLKERYEVHHGVRITDTALVSAAVLSNRYITDRFLPDKAIDLVDEACAVLRLQHESKPDEIQKLDRAIMKIQIELESLKKETDPVSVERREALEKDLEMKNDELNRLTKIWDAERAEIESIKNAKANLEQARIELEKCQREGDYTKASELRYSRIPDLEKKVALSEKSKDGDKVNLLHDSVTSDDISKVVAKMTGIPTETVMKGDKDRLLYMENSLKERVVGQDEAIAAISDAVRLQRAGLTSEKRPIASFMFLGPTGTGKTELTKALAEFLFDDESNVIRFDMSEFQEKHTVSRLIGAPPGYVLSESGGQLTEAVRRKPYAVVLFDEFEKAHPDVSKLLLQVLDEGKLTDSLGHHVDFRNTIIVMTSNIGQDILLNDTKLGDDGKIDTATKNKVIEAMKRSYPPEFINRIDDILVFNRLSKKVLRSIVDIRIAEIQDRLAEKRMKIDLTDEAKDWLTDKGYDQLYGARPLNRLIHRQILNSMATFLLKGQIRNGETVRVVVKDAKLVVLPNHEEGEVVEEEAEK

SEQ ID NO: 785 - protein, 462 aa, Bos taurus
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVPVGRVETGVLKPGMVVTFAPVNVTTEVKSVEMHHEALSEALPGDNVGFNVKNVSVKDVRRGNVAGDSKNDPPMEAAGFTAQVIILNHPGQISAGYAPVLDCHTAHIACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 786 - protein, 725 aa, Gallus gallus
MPEQVQHGEDEVETFAFQAEIAQLMSLIINTFYSNKEIFLRELISNASDALDKIRYESLTDPSKLDTGKDLKIDIVPNPRDPTLTLLDTGIGMTKADLVNNLGTIAKSGTKAFMEALQAGADISMIGQFGVGFYSAYLVAEKVVVITKHNDDEQYAWESSAGGSFTVRTDHGEPIGRGTKVILYLKEDQTEYLEERRVKEVVKKHSQFIGYPITLYVEKEREKEVSDDEAEEEKVEKEEEESKDEEKPKIEDVGSDEEEEEGEKSKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFTELAEDKENYKKFYEAFSKNLKLGIHEDSTNRKRLSELLRYHTSQSGDEMTSLSEYVSRMKESQKSIYYITGESKEQVANSAFVERVRKRGFEVVYMTEPIDEYCVQQLKEFDGKTLVSVTKEGLELPEDEEEKKNMEESKAKFETLCKLMKEILDKKVEKVTISNRLVSSPCCIVTSTYGWTANMERIMKAQALRDNSTMGYMMAKKHLEINPDHPIVETLRQKADANKNDKAVKDLVVLLFETALLSSGFSLEDPQTHSNRIYRMIKLGLGIDEDEVIAEESSIAPPDEIPPLEGDEDTSRMEEVD

SEQ ID NO: 787 - protein, 382 aa, Oryza sativa
  source: /note="subsp. japonica"
MAEQANQPTVLQKFGGQFHLGSSFSEGVRARNICPSVSSYDRRFTTRSYMTQGLVNGGINVPMMSSSPIFANAPAEKGGKNFMIDFLMGGVSAAVSKTAAAPIERVKLLIQNQDEMIKAGRLSEPYKGIGDCFGRTIKDEGFASLWRGNTANVIRYFPTQALNFAFKDYFKRLFNFKKDKDGYWKWFGGNLASGGAAGASSLFFVYSLDYARTRLANDAKAAKGGGERQFNGLVDVYRKTLKSDGIAGLYRGFNISCVGIIVYRGLYFGMYDSLKPVVLTGSLQDNFFASFALGWLITNGAGLASYPIDTVRRRMMMTSGEAVKYKSSMDAFSQILKNEGAKSLFKGAGANILRAIAGAGVLSGYDQLQILFFGKKYGSGGA

SEQ ID NO: 788 - protein, 528 aa, Bos taurus
MLGLVGRVVAASASGALRGLSPSAPLPQAQLLLRAAPAALQPARDYAAQASPSPKAGATTGRIVAVIGAVVDVQFDEGLPPILNALEVQGRETRLVLEVAQHLGESTVRTIAMDGTEGLVRGQKVLDSGAPIRIPVGPETLGRIMNVIGEPIDERGPIKTKQFAAIHAEAPEFVEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHLGKLVPLKETIKGFQQILAGEYDHLPEQAFYMVGPIEEAVAKADKLAEEHS

SEQ ID NO: 789 - protein, 428 aa, Oryza sativa
  source: /note="subsp. japonica"
TCQAIVKSTIGIGVDEEDRKRTWVADAEECKKRGSIETARAIYAHALSVFVSKKSIWLKAAQLEKSHGTKESLYNLLRKAVTYNPRAEVLWLMSAKEKWLAGDVPAARAILQEAYASLPNSEEIWLAAFKLEFENNEPERARILLSKARERGGTERVWMKSAIVERELGNVDEERKLLEEGLKLFPSFFKLWLMLGQMEDRLGHGSKAKEVYENALKHCPSCIPLWLSLANLEEKINGLSKSRAVLTMARKKNPATPELWLAAVRAELRHGNKKEADALLAKALQECPTSGILWAAAIEMVPRPQRKAKSSDAIKRCDHDPHVIAAVAKLFWHDRKVDKARSWLNRAVTLAPDIGDFWALYYKFELQHGNADTQKDVLQRCVAAEPKHGERWQAITKAVENSHLSIEALLKKAVLALGQEENPNAADP

SEQ ID NO: 790 - protein, 128 aa, Ovis aries
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 791 - protein, 769 aa, Bos taurus
MRLSSVLALLRPALPLILGLSLGCSLSLLRVSWIQGEGDDPCVEAVGKAGGPQSLDSRTQLDQSDEDFKPRIVPYYRDPNKPYKKVLRTRYIQTELGSRERLLVAVLTSRATLSTLAVAVNRTVAHHFPRLLYFTGQRGARTPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGIGCVSQHQGQRYRSFELAKNRDPETESSLAFLSAFAVHPVSEGTLMYRLHKRFSALELERAYSEIEQLQAQIRNLTALTPEGEAGLSWPLGLPAPFTPHSRFEVLGWDYFTEQHTFSCVDGAPKCPLQGASRADVGDAVETALEQLNRRYQPRLRFQKQRLLNGYRRFDPARGMEYTLDLLLEAVTQRGHRRALARRVSLLRPLSRVEILPMPYVTEATRVQLVLPLQAAEAAAAPTFLEAFAAGVLEPREHALLTLLLVYGPREGGRGAPDPFVGVKAAAAELERRYPGTRLAWLAVRAEAPSQVRLMDVVSKKHPVDTLFFLATVWTRPGPEVLNRCRMNAISGWQAFFPVHFQEFNPALAPQRPPPGAGPDPPSPPGADPARGAAGGGRFDRQASAEGCFYNADYLAARARLAADLAGQEEEEALEGLEVMDVFLRFSGLHLFRAVEPGLVQKFSLRDCSPRLSEELYHRCRLSNLEGLGGRAQLAMALFEQEQANST

SEQ ID NO: 792 - protein, 1744 aa, Gallus gallus
MALAELYTQYNRVWIPDSEEVWQSAEITKDYKAGDRFLHVQLEDGTELHYPVDPSALPPLRNPDILVGENDLTALSYLHEPAVLHNLKVRFVESRLIYTYSGIILVAINPYKQLPIYGDAIIHAYSGQNMGDMDPHIFAVAEEAYKQMARNGKNQSIIVSGESGAGKTVSARYTMRYFATVSKSSSNAHVEDKVLASNPITEAVGNAKTTRNDNSSRFGKYTEISFDQRYRIIGANMRTYLLEKSRVVFQSENERNYHIFYQLCASAMQPEFKHLKLGSAEEFNYTRMGGSTTIEGVDDRANMIETQKTFALLGLKEDFQMDVFKTLAAILHLGNLEITAVGDERSSINLEDNHLNIFCELLELNSDKMAQWLCHRKIITTSETVIKPMTKPQALNARDALAKKIYSHLFDFIVERINQALQFSGKQHTFIGVLDIYGFETFDVNSFEQFCINYANEKLQQQFNLHVFKLEQEEYMKEDIPWTLIDFYDNQPVIDLIEAKMGILELLDEECLLPHGTDENWLQKLYNNFVNKNTLFEKPRMSNTSFIIQHFADKVEYKCEGFLEKNRDTVYEVLMEILKESKFRLCANFFQDNPVSVSPFSSTISIKSARPVLKSPNKQLRMTVGSKFRSSLSLLMETLNATTPHYVRCIKPNDEKRPFEFDSKRVAQQLRACGVLETIRISAQSYPSRWTYIEFFSRYSILMTQQELSVNDKKQICKIVLQRLIQDPNQYQFGRTKIFFRAGQVAYLEKLRSDKLRHACVVIQKSVRGWLQRRRFLCLRRAALTIQQYFRGQRTVRLRQAITARALKETWAAIIIQKYCRGYLVRKLCQLIHVAAVTIQAHTRGFLARKKYRKMLEEHKAVILQKYARAWLARRRFQNVRRFVLNIQLSYRVQRLQKKIEEQSKENHGLLERLTNLASTHMNDLDTIQKLESELEKLAAQKRTYEEKGKKYKEDSEQKILKLESQNKELREQKETLEVKLQEKTEEMKEKMDDLTKQLFDDVRKEESQRMILEKNFQNQRQDYEKEIESLKGEIKVLREEKTQLQQQIQQEMSIQDDLKMEVGQLTKQVQKIPELQKEIELLQTQKLDVEKQAQSQKREMREKMSEVTKQLLESYDFEDVRSRLSTEDLEHLNEDGELWFAYEGLKKATRVLESHFQTQKENYEKEIEGLNLKVEHLSQDINHLQKLFREENDINDGIRLEVSRLTSENLVIPDLKQQVSELENQKLDLENRLQEQTAKLKGKSIAKEISNRLHHEPEGDRTLRRTNEVQNEADMKEERLNVIPQEMEGLSNGLKQDEVQAEVKSKMKQETTRLTVENMDLEEELDMKDRIIKKLEDQIKTLTKTTEKDGEVHVSALPKEYIGMMEYKREDEERIVQNLILDLKPRGVVVNMIPGLPAHILFMCVRYADYLNDADMLKSFINVTIDGIKQVVKENSEDFEMLSFWLSNTYYFLNCLKQYSGEEEFMKYNTPHQNKNCLKHFDLSEYRQVLSDLAIRIYHQFILVMENNIQHMVVPGMLEYESLQGISGLKPTGFRKRSSSIDDTDTYTMTSILQQLSYFYSTMCQNGLDPELLKQAVKQLFFLIGAVTLNSLFLRKDMCSCRKGMQIRCNISYLEEWLKDKNLQSSNAKETLEPLSQAAWLLQVKKITDDDAKEICEHCTSLSTVQIVKILNSYTPIDDFEKRVTPSFVRKVQAMLNNREDGPQLMLDTKYRFQVTFPFTPSPHALEMIQVPSSFKLGFLTRV

SEQ ID NO: 793 - protein, 220 aa, Glycine max
MAFKLYGLPMSTNTTRAMICLHEKEVDFELVPVNVFAAEHKQPPFLSKNPFGLIPLLEDGDLTLFESRAITAYVAEKFKETGADLIRHKDAKEAALVKVWTEVESHYYEPAVSPIIYEYFVAPFQGKEPDKSVIDTNVEKLKKVLDVYEAKLSSTKYLAGDFYSLADLSNVSETHYLMQTPCASTVNERPHVKAWWEDISSRPAFTKVVGGMTFGQNQEE

SEQ ID NO: 794 - protein, 1021 aa, Glycine max
MQLVHSDEPAPERRDWPEKPEDPKADNDSLDSGTDDGAALDVTGKSVEFPAAENAEDSAECLYVYKNVYSLIPKSVSRLARLRTLKFFGNEINLFAPEFGNLTTLECLQMKISSPGIGGLPLHTLKGLKELELSKGPPRPSAFPILTEISGLKCLTKLSICHFSIRYLPPEIGCLKKLEYLDLSFNKMKTLPAEITYLKGLISMKVANNKLVELPAAMSSLSRLESLDLSNNRLTSLGSLELASMHRLQELNLQYNKLLRIFQIPSWMCCNMEGNDEARYKDDCSSSVEMDLYESNFQENDETLSDGPHNTSSSMLTSPSSSSRCFASRKSGKRWKRRYYLQQKARQERLNNSRKWKAVDHDDLLLSKKIHRISESGNHDSLASESCAEIESENGSLDDNNKRIFSERAVNDNAIDNDNNDEVITEKQFSGEDCCTTESKDEKDASLCSLEKRQSEQEEASCLELLESVSKSKRHLDRDLDNPKPCKSRKSISSSSLLSCKYSKISFCGTEDHLSDGFYDAGRDRPFMPLESYEQNQCLASREVILLDRKRDEELDAVMLAAQALVYNLKKLNGLNRHGNQVGVDNLQTASLLALFVSDHFGGSDRSAIVERTRKSVSGSNYNKPFVCTCSAGSSTSISSPTEPVANTIEDITLSKMSEKSLDSMKKRQNSIIIPIGSVQYGVCRHRALLFKYLCDHMEPPVPCELVRGYLDFSPHAWNIILIKRGATWVRMLIDACQPLDIREEKDPEYFCRYIPLNRTTIPLSTIGCPGPDYSFPSLTTCDELETKASTSLVKCKFGSVEAAAKVRTLEEQGSSADKIKNFKYNCLGEIRILGALKHPCIVEMYGHQISCQWSVSADGNPEHRVLRSAIFMEYVEGGSLKSYLEKLSEAGEKHVPVELALLIAKDVSCALSELHSRHIIHRDIKSENILFDLDRKRDDGTPTVKLCDFDSAVPLRSTLHACCIAHAGTPPPCVCVGTPRWMAPEVMRTMYKKNSYGLVRSSSYQSAIYFEFITNCVADI

SEQ ID NO: 795 - protein, 1849 aa, Oreochromis niloticus
MAAQDELNQLERVFLRLGHAETDEQLQDIISKFLPPVLLKLSSVQEGVRKKVMELLVHLNKRIKSRPKIQLPVETLLVQYQDPAAASFVTNFTIIYIKMGYPRLEVVKQCELAPTLITAMEGKPQPQQDSLMHLLIPTLYHIKYPTDTSKSASLFNLTERPKTMHLLLEFMLDVLLMPYGFVLNESPTRPAPSSSQGTSGDGTVAASSQGLPQPPPGMSVYAAKRVIGEAQWNAEQLEQCKLGIVKFIEAKQVPEVETVVHLVVASSDTRHSVATAADLELKSKQSIIDWNNPLIINKMFKVYLGDVPLKTKGGGMKQELKHEPVSTRVKLKILPHLLRSRLAAECFPANIQVVYDGLFGANTNNKLLSLTLQFVHHICMVCPDTNKPLGLMLLNGLTKLINEYKEDPKLLCVAYSAVGKLSSRMPQLFTKDIALVQQFFESMCKEEADVRLAIQEALSMMVGAYANLQGALLNLMEALVAAYIGKPEVQVRQVAMKFASTVFAPDHVPSRYLLLLAAGDPREEVSGEAQRVLRAFHAKSSEKEGPKPMPSFPDMVAYVQEKAAQRIKTPAKYIVGTSTIPFNPSAFGEIMLYLRMCLAHSAGAMPMSTRLSDMQDDAPAIGHYVHTLLFSDSQPSGSKGSEANPVHVYMDLLQQLLSAVGGIPVMYCLLEVVSVCPEKLAPRFADKIDWIKSLMNTNKEDMRELAAQLYAVVVSTMTGNELQKAVQNLVKITKDNHSPETQHGAILALGYMVGRNMSRKKAATSIDSTENMGQQMNISSQEDDELAAMATKTIGSFLDNSSAMLAIAACTALGEIGRNGPLLIPAEGEGLTKLSVVENLLARIPSGKESTKMKERAIMTLGYLPVGDEDFPHQKKLLQGLMDSVEAKQVELQFTVGEAITSGAVGTSSGAARDPWTCTEDHYTPPQNVKNNDVVPWVLNAILTKYITSQNPHVRQAACIWLLSLVKKLSQHKEITSHLKEIQGAFISVLSDPDELSQDVASKGLGLVYEMGGEGDQQELVSTLVETLMTGKRVKHAVSGDTEVFQGEGLGKTPDGHGLSTYKELCSLASDLNQPDLVYKFMNLANHHAMWNSRKGAAFGFHMIAAKAGEQLAPFLPQIIPRLYRYQFDPNLSIRQAMTSIWDALVTDKTLVDKYLKEILQDVISNLTNNAWRVRESSCLALNDLIRGRQADDLIDHLAEIWETLFRVLDDIKESVRKAADLTLKTLSKVCTRMCESTGSGAQRTVAVILPTLLEKGIVSNVAEVRSLSIQTLVKISKTAGARLKPHASRLIPALLESLSTLEPQVLNYLSLRATEQEKSAMDAARLSAAKASPMMETVNMCLQHLDVAVLGELVPRLCDLLKSGVGLGTKGGCASVIVSLTVQCPQDLTPHSGKLMSSLLNGIHDRSTVVQKAYAFALGHLVRTAKDSSVEKLLLKLNTWYLEKEEPVYKSSCALTVHAISHYSPDVLKGHAGVALPLAFLGMHQAPGPDEEKGESHDATLWSEVWQENVPGSFGGIRLYMTELIAITQKALQSQSWKMKAQGAAAMATVAKEQTGSLVAPHLGLVLTALMQGLSGRTWAGKEELLKAIGSVVSKCSTELQKPCSGQPTISEVLEVVLKECRKESLVYKIAALRCAGDVLHSSQEDRFADMAEILFPLIKKRSPESGAGSPRSLEDDDDDDDKDVKEKELQTEAIICAFETLGKSWPRKPETQTRFQAEVCNLMCEKLKLSTWKVQLAVLQSMKAYFQGLLLLEKGNEDLNSLSEILTETCAALTYPLENKSYSSVRTEALSVVDLIVKRTGESEQWDCVSVKSREQLQRSLSTLQSDSRPDLRDKAQELRRHIQSQP

SEQ ID NO: 796 - protein, 1313 aa, Ovis aries
MAAAATAGEPGTTEPSPRARPHRATFRQQAGSRNRKRNWLGRPLTSFPRRDGVNVVSVVTGLRVLFGAWDSGVAGSKMSVLTSPRGKVEVVHCRRTESQDIYCIKNLIRKFTQKLFGNLNIIYLLEKANLAITLHNDQEEIMAQATFLDYPNWNIATQDDWVSVFRELDSDIPCTPLNTLFMHLFVAVDEYSVGCCKEIIRTVFKAVLDLHFVFLIVPSCMSLGSTLITVFSQVGYVPSLTNDEEFAVHVCHRHNHYPQLHIRKARVEDHDNLMPIFLHHDTILKETYGEYFLAELIEAQDEENHAVVCEVEGVAVGFMSVCSQVNLELLHKCFDLGPFHGLCVPHQDDILEPPQEFSIHESSDSKLENSGEESQKIVKEPQEAVSLETRESIQRKGTEAAVEEALSPVTSENTGEVEDSEKLSQVSSMVYMGYYISHRSSLSLSLAEDASSFRPIYKGASTAFCIQLFFIDEKYEARSLDFMNFVFHLFRDKDFCIISVPHLTPEFVLIQSFVKVVPFNNCTLEQDLYVFHRAGLLKTIEIRLATLSDTPGVEKLISTLMPCKSILEDLKQYNEARRDPDGTPLQVFVAEVAEQVVGIAVIRNEMDIEYIRSHYNIEDFIYFNHHQREEHGHLYHFVLNPIFRHYTKFFLKEILRLGYKSCLYYPVYPQVKEGKVQSPKAHSLTSALHYLVPVRPRRQIVYPLEKLGINAPSKEVSKGTLSYALNHTNRKLSLEPKITVNAKIVVVGASNVGISFLETLVFCSHLKFSNLTLISTYGLPGKKLLGNEQRKFLANDHCYNDRDHELMSLCSWVNVVAARMTAIDRAAKQVIVSREKVVLYDHLILCTGRQYQVPCPTEVDISLHPTNREVSNSCLRRYTGPIPCNHFTLNDEEDCLRALAWIKNNSITTEGNVIIYGNSIDTYTTVETLLNLGVRGSCIHLVQHPPTSIITCINDCAVEGAIEEALQAAGVNVYRDALLAQWNNGLYSDPIHTASFTTPAKPFQLPCSMFFSFLEKNVDYETFKAFNDACLVYDGRLVIDSNFHTNDIAIRAAGPLTKFSNRYYSNEWTHSNFNSKEIGFQLAAAMLKLFDPTLEPVTEPPADLDRLIPMYKGAKIKGGILPGSYHYLHVSKPAIPTPLEVQRAQSDFGSEIVTGNVKNGNYFRIHINKYRMVETITCLSKVPFPASNYIRLFGQHEQALNNLCARYEDGLVPDLYSYFTEPWCMALFHDRFIDLRKALHQILSSKEDENLPSMEELARQIEDEEINLPEKPRNYLKRVFQETIYRPLVEKSILDYLHYNHYHLPMYAWPGII

SEQ ID NO: 797 - protein, 380 aa, Saccharomyces cerevisiae
  source: /note="strain FostersB"
  MOD_RES (17)..(17): Any amino acid
  MOD_RES (221)..(221): Any amino acid
MTQTSPSPNQNSIQSKXSNQNMLTNLSQLNETLKEALSNYMIQRTSEVITELNTQYENSKREFEKNLQKNLLQEVDEFKENLTKQKDKELEEKLKANEELLQAKHANEVGLLSITQVKEFNKIIKDKIEKERNGRLAHLEEINSEVNDLSKSIDRSSKILSKNEALVQLTFQVDEIKSRINNNNLPDVNIDKELSRLKLLSNLLSTFNKKSCCDDGDCCSXKKGNKNEGKEGKISCKCKPKTNPPSLLSVALDELESTCSGKKILSNEQIYNRWNLLADDFKTASLLPPNSGILGQLTAKVFSLFLFTKTGNPSNATDFDSVYARVGDNLRVSNLNDAVEEVVSLKGWPHKVCESWIEDARRKLEVQRLVEILDCEIRTL

SEQ ID NO: 798 - protein, 603 aa, Saccharomyces cerevisiae
  source: /note="strain FostersB"
  MOD_RES (517)..(517): Any amino acid
MLSPERRPSMAERRPSFFSFTQNPSPLVVPHLAGIEDPLPATTPDKVDVLIAGTGMVESVLAAALAWQGSNVLHIDKNDYYGDTSATLTVDQIKRWVNEVNEGSVSCYKNAKLYVSTLIGSGKYSSRDFGIDLSPKILFAKSDLLSILIKSRVHQYLEFQSLSNFHTYENDCFEKLTNTKQEIFTDQNLPLMTKRNLMKFIKFVLNWEAQTEIWQPYAERTMSDFLVEKFKLEKPQVFELIFSIGLCYDLNVKVPEALQRIRRYLTSFDVYGPFPALCSKYGGPGELSQGFCRSAAVGGATYKLNEKLVSFNPTTKVATFQDGSKVEVSEKVIISPTQAPKDSKHVPQQQYQVHRLTCIVENPCTEWFNEGESAAMVVFPPGSLKSGNKEVVQAFILGAGSEICPEGTIVWYLSTTEQGPRAEMDIDAALEAMEMALLRESSSGLENDEEIVQLTGNGHTIVNSVKLGQSFKEYVPRERLQFLFKLYYTQYTSTPPFGVVNSSFFDVNQDLEKKYIXGASDNGVIYTTMPSAEISYDEVVTAAKVLYEKIVGSDDDFFDLDFEDEDEIQASGVANAEQFENAIDDDDDVNMEGSGEFVGEMEI

SEQ ID NO: 799 - protein, 496 aa, Saccharomyces cerevisiae
  source: /note="strain FostersB"
MTAAHPVAQLTAEAYPKVKRNPNFKVLDSEDLAYFRSILSNDEILNSQAPEELASFNQDWMKKYRGQSNLILLPNSTDKVSKIMKYCNDKKLAVVPQGGNTDLVGASVPVFDEIVLSLRNMNKVRDFDPVSGTFKCDAGVVMRDAHQFLHDHDHIFPLDLPSRNNCQVGGVVSTNAGGLNFLRYGSLHGNVLGLEVVLPNGEIISNINALRKDNTGYDLKQLFIGAEGTIGVVTGVSIVAAAKPKALNAVFFGIENFDTVQKLFVKAKSELSEILSAFEFMDRGSIECTIEYLKDLPFPLENQHNFYVLIETSGSNKRHDDEKLTAFLKDTTDSKLISEGMMAKDKADYDRLWTWRKSVPTACNSYGGMYKYDMSLQLKDLYSVSAAVTERLNAAGLIGDAPKPVVKSCGYGHVGDGNIHLNIAVREFTKQIEDLLEPFVYEYIASKKGSISAEHGIGFHKKGKLHYTRSDIEIRFMKDIKNHYDPNGILNPYKYI

SEQ ID NO: 800 - protein, 223 aa, Ovis aries
MKFFIFTCLLAVALAKHKMEHVSSSEEPINISQEIYKQEKNMAIHPRKEKLCTTSCEEVVRNANEEEYSIRSSSEESAEVAPEEVKITVDDKHYQKALNEINQFYQKFPQYLQYLYQGPIVLNPWDQVKRNAGPFTPTVNREQLSTSEENSKKTIDMESTEVFTKKTKLTEEEKNRLNFLKKISQYYQKFAWPQYLKTVDQHQKAMKPWTQPKTNAIPYVRYL

SEQ ID NO: 801 - protein, 894 aa, Glycine max
MAVETSDKPNLPHDFEDDDDGPVIYKRYSSSKKNQSHSEVRKSSSHSHDGQSYRQISNAPSSSGQTSCLQKGNTVPSAKPSPVKPSVGISKASKSLVNTSSTKLPVANSKSPSLGDRQKMSVDIKGEPKTIEHHAKNFVEDSEDDEDNKPLSFRLKNSNHDNKVTSVIAKKSSEDSDDDVPLAKKLYRNSNLGTTSSNHDDSNQKKPISKIQKEQKNGSGMSNKLDRPSPLPAKRPLDNSNSLHPSVKKSKVLDPVASIKSKAVSVKHELKVEDDDDDDDIPISQRIKKSAMSGDKSSSMKKVLTKVTKVNKPGSKPFKKQIKKTVKKSGSGSEYSKSSKILPSSGDGQKKWTTLVHNGVIFPPPYQPHGVKMLYKGRPVDLTPEQEEVATMYAVMRDTEYMQKDKFKENFWNDWRKLLGRNHVIQNLKDCDFTPIYDWYQSEKDKKKQMTTEEKKALKEEKMKLEEKYMWAIVDGVKEKVGNFRVEPPGLFRGRGEHPKMGKLKKRIHPGDITINIAKDAPIPECPIPGERWKEIRHDNTVTWLAYWSDPINPKLFKYVFLAASSSLKGQSDKEKYEKARTLKDYIGNIRSAYTKDFTSKDITKQQIAVATYLIDKLALRAGNEKDDDEADTVGCCTLKVENVTREPPNKLKFNFLGKDSIKYENTVEVELPVYNAILKFQKDKKPGDDLFDKLDTSKLNAHLKELMPGLTAKVFRTFNASITLDVMLNKETKDGDVGEKIVVYQHANKQVAIICNHQRSVSKSHTAQMSKLTEKIDELQAVLKELKTDLDRARKGKPPSKSSDGKRKKNLSPEMLEKKISQTNAKIEKMQRDMKTKEDLKTVALGTSKINYLDPRITVAWCKRHEVPIEKIFNKSLLAKFCWAMDVDPDFRF

SEQ ID NO: 802 - protein, 525 aa, Bos taurus
MSRQFTCKSGAAAKGGFSGCSAVLSGGSTSSYRAGGKGLSGGFGSRSLYNLGGVRSISFNVASGSGKSGGYGFGRGRASGFAGSMFGSVALGPMCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRSVRDVVEDYKKRYEEEINRRTAAENEFVLLKKDVDAAYANKVELQAKVDSMDQEIKFFKCLYEAEIAQIQSHISDMSVILSMDNNRDLNLDSIIDEVRAQYEDIALKSKAEAEALYQTKFQELQLAAGRHGDDLKNTKNEISELTRLIQRIRSEIENVKKQASNLETAIADAEQRGDNALKDARAKLDELEAALHQSKEELARMMREYQELMSLKLALDMEIATYRKLLESEECRMSGEFPSPVSISIISSTSGSGGYGFRPSSVSGGYVANSGSCISGVCSVRGGESRSRSSTTDYKDALGKGSSLSAPSKKASR

SEQ ID NO: 803 - protein, 214 aa, Ovis aries
MKLLILTCLVAVALARPKHPIKHQGLSSEVLNENLLRFVVAPFPEVFRKENINELSKDIGSESIEDQAMEDAKQMKAGSSSSSEEIVPNSAEQKYIQKEDVPSERYLGYLEQLLRLKKYNVPQLEIVPKSAEEQLHSMKEGNPAHQKQPMIAVNQELAYFYPQLFRQFYQLDAYPSGAWYYLPLGTQYTDAPSFSDIPNPIGSENSGKITMPLW

SEQ ID NO: 804 - protein, 526 aa, Saccharomyces cerevisiae
  source: /note="strain FostersB"
MSSATAAATSAPTANAANALKASKAPKKGKLQVSLKTPKGTKDWADSDMVIREAIFSTLSGLFKKHGGVTIDTPVFELREILAGKYGEDSKLIYNLEDQGGELCSLRYDLTVPFARYVAMNNIQSIKRYHIAKVYRRDQPAMTKGRMREFYQCDFDVAGTFESMVPDSECLSILVEGLTSLGIKDFKIKLNHRKILDGIFQIAGVKDEDVRKISSAVDKLDKSPWEAVKKEMTEEKGQSEETADKIGEYVKLNGSLKEIHAVLSADANITSNEKAKQGLDDIATLMKYTEAFDIDSFISFDLSLARGLDYYTGLIYEVVTSASAPPENASELKKKAKSAEDASEFVGVGSIAAGGRYDNLVNMFSEASGKKSTQIPCVGISFGVERIFSLIKQRINSSTTIKPTATQVFVMAFGGGKDWTGYLPERMKVTKQLWDAGIEAEYVYKAKANPRKQFDAAEKAGCHIAVILGKEEYLEGKLRVKRLGQEFADDDGELVSAADIVPIVQGKLSQIHEDGLNEVTRLIKGL

SEQ ID NO: 805 - protein, 222 aa, Ovis aries
MKVLILACLVALALAREQEELNVVGETVESLSSSEESITHINKKIEKFQSEEQQQTEDELQDKIHPFAQAQSLVYPFTGPIPNSLPQNILPLTQTPVVVPPFLQPEIMGVPKVKETMVPKHKEMPFPKYPVEPFTESQSLTLTDVEKLHLPLPLVQSWMHQPPQPLPPTVMFPPQSVLSLSQPKVLPVPQKAVPQRDMPIQAFLLYQEPVLGPVRGPFPILV

SEQ ID NO: 806 - protein, 360 aa, Saccharomyces cerevisiae
  source: /note="strain FostersB"
MCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHAILRIDLAGRDLTDYLMKILSERGYSFSTTAEREIVRDIKEKLCYVALDFEQEMQTAAQSSSIEKSYELPDGQVITIGNERFRAPEALFHPSVLGLESAGIDQTTYNSIMKCDVDVRKELYGNIVMSGGTTMFPGIAERMQKEITALAPSSMKVKIIAPPERKYSVWIGGSILASLTTFQQMWISKQEYDESGPSIVHHKCF

SEQ ID NO: 807 - protein, 859 aa, Saccharomyces cerevisiae
  source: /note="strain FostersB"
  MOD_RES (626)..(626): Any amino acid
MTYKYNCCDDGSGTTVGSVVRFDNVTLLIDPGWNPSKVSYEQCIKYWEKVIPEIDVIILSQPTIECLGAHSLLYYNFTSHFISRIQVYATLPVINLGRVSTIDSYASAGVIGPYDTNKLDLEDIEISFDHIVPLKYSQLVDLRSRYDGLTLLAYNAGVCPGGSIWCISTYSEKLVYAKRWNHTRDNILNAASILDATGKPLSTLMRPSAIITTLDRFGSSQPFKKRSKIFKDTLKKGLSSDGSVIIPVDMSGKFLDLFTQVHELLFESTKINAHTQVPVLILSYARGRTLTYAKSMLEWLSPSLLKTWENRNNTSPFEIGSRIKIIAPNELSKYPGSKICFVSEVGALINEVIIKVGNSEKTTLILTKPSFECASSLDKILEIVEQGERNWKTFPEDGKSFLCDNYISIDTIKEEPLSKEETEAFKVQLKEKKRDRNKKILLVKRESKKLANGNAIIDDTNGERAMRNQDILVENVNGVPPIDHIMGGDEDDDEEEENDNLLNLLKDNSEKSAAKKNTEVPVDIIIQPSAPSKHKMFPFNPAKIKKDDYGTVVDFTMFLPDDSDNVNQNSRKRPLKDGAKTTSPVNEEDNKNEEEDGYNMTDPVSKRSKHRASRYSGFSGTGEAEXFDNLDYLKIDKTLSKRTVSTVNVQLKCSVVILNLQSLVDQRSASIIWPSLKSRKIVLSAPKQIQNEEITAKLIKKNIEVVNMPLNKIVEFSTTIKTLDISIDSNLDNLLKWQRISDSYTVATVVGRLVKESLPQVNNHQKTASRSKLVLKPLHGSSRSHKTGALSIGDVRLAQLKKLLTEKNYIAEFKGEGTLVINEKVAVRKINDAETIIDGTPSELFDTVKKLVTDMLAKI

SEQ ID NO: 808 - protein, 894 aa, Saccharomyces cerevisiae
  source: /note="strain FostersB"
  MOD_RES (82)..(82): Any amino acid
MSSDKSIEKNTDTIASEVHEGDNHSNNLVSMEEEIKSTLSDQYEEIAIIPTEPLHSDKELNDKQQSLGHEAPTNVSREEPIXISGDEDTQITEQNVNEQRQETREPSSEIDLNEPLDVEKDVTTDVQAPNGLNIEKEYDAVKENEKVYADTKEVVSSPENREVTGKNSGGEKSSSSKFLDDESGTTTAANANDISISSEVTPERSSENDNNQIHITNEVAAGINLNENKEQKAAIEDGPVTAENLSSETARKVPPIPTQIINEKDDNSSENEVSAIPTTSSPPLPPRQNVATSTSPKLPPRGKQREQPPKTKNAVPPPLEEEMKSEKFRKNFEETKRNSYHHVPLTGSKTAQLESTAEINLIASRYRKTSHHLNKEGEETRESLQEGQSFLKSTFTSFLENLSEYNEVENVNEEDREMFKIDWSFWTQVVNDYATVASNEPENLEAHVTNGIPPQIRGIIWQLMANSKSREMEDIYETLLDTECLHEATIRRDLRRTKFVAEDKMESLYKVIKVYSVYDPDVGYTQGMGFIAAPLLINCENEAESFGLLVGLMKNYGLRELFLPGMPGLMLMLYQFDRLLEEHSPSLYNRLIREGISSTMYATQWFLTFFAYKFPLEFVLRIFDIVFVEGIEVLLKFAVNLMLKNEETLVKLRFDELLDFLKDELFNYYLMGNQDDASVVQMGLSNGNSFKGNDDGTFSYNVDLFVHDAMTGVYITPLTLRRYRGEYVEIHEKEQKKEDHYESLRIQNHQLQREAQKLEHDYSILNKENISAANELIQNRLNMEMLLDEKNDLINTITDIKSQIEEEIRKQNLPNPDASLPKADLREDLERTISRNNEVMRENGQLEERITELQAEIDELININKEQVSTASLLERDSKAKGRKGWTGFKKVFK

SEQ ID NO: 809 - protein, 192 aa, Ovis aries
MMKSFFLVVTILALTLPFLGAQEQNQEQRICCEKDERFFDDKIAKYIPIQYVLSRYPSYGLNYYQQRPVALINNQFLPYPYYAKPVAVRSPAQTLQWQVLPNAVPAKSCQDQPTAMARHPHPHLSFMAIPPKKDQDKTEIPAINTIASAEPTVHSTPTTEAVVNAVDNPEASSESIASAPETNTAQVTSTEV

SEQ ID NO: 810 - protein, 727 aa, Saccharomyces cerevisiae
  source: /note="strain FostersB"
MLDAGIHPAYQGLASLPFYDEFDLSKVDILLISHFHLDHAASLPYVMQRTNFQGRVFMTHPTKAIYRWLLRDFVRVTSIGSSSSSMGTKDEGLFSDEDLVDSFDKIETVDYHSTVDVNGIKFTAFHAGHVLGAAMFQIEIAGLRVLFTGDYSREVDRHLNSAEVPPLSSNVLIVESTFGTATHEPRLNRERKLTQLIHSTVMRGGRVLLPVFALGRAQEIMLILDEYWSQHADELGGGQVPIFYASNLAKKCMSVFQTYVNMMNDDIRKKFRDSQTNPFIFKNISYLRNLEDFQDFGPSVMLASPGMLQSGLSRDLLERWCPEDKNLVLITGYSIEGTMAKFIMLEPDTIPSINNPEITIPRRCQVEEISFAAHVDFQENLEFIEKISAPNIILVHGEANPMGRLKSALLSNFASLKGTDNEVHVFNPRNCVEVDLEFQGVKVAKAVGNIVNEIYKEENEDNLDSQAEKGLVDEEEHKDIVVSGILVSDDKNFELDFLSLSDLREHHPDLSTTILRERQSVRVNCKKELIYWHILQMFGEAEVLQDDDRVTNQEPKVKEESKDNLTNTGKLILQIMGDIKLTIVNTLAVVEWTQDLMNDTVADSIIAILMNVDSAPASVKLSSHSCDDHDHNNVQSNAQGKIDEVERVKQISRLFKEQFGDCFTLFLNKDEYASNKEETITGVVTIGKSTAKIDFNNMKILECNSNPLKGRVESLLNIGGNLVTPLC

SEQ ID NO: 811 - protein, 463 aa, Saccharomyces cerevisiae
  source: /note="strain FostersB"
MSDGTQKLWGGRFTGETDPLMHLYNASLPYDYKMYKADLEGTKVYTAGLQKLGLLTETELAKIHEGLAEIKKEWDADKFVRHPNDEDIHTANERRLGELIGRDIAGKVHTGRSRNDQVVTDLRIYCRDIVNDTLFPALKGLVEVLIKRAEGEIDVLMPGYTHLQRAQPIRWSHWLSSYATYFTEDYKRLGQILHRLNQSPLGAGALAGHPYGIDREFLAEGLGFNSVIGNSLVAVSDRDFIVELMFWGTLFMNHISRFAEDLIIYCTAEFGFIQLSDAYSTGSSLMPQKKNADSLELLRGKSGRVFGDLTGFLMSLKGIPSTYDKDMQEDKEPLFDCLTTVEHSMLIATGVISTLTVNKEKMEAALTMDMLATDLADYLVRKGVPFRETHHISGECVATAERLGLSGIDKLTLEQYQKIDSRFGQDLFETFNFEQSVERRDATGGTAKSAVLKQLDNLKSQLN

SEQ ID NO: 812 - protein, 279 aa, Saccharomyces cerevisiae
  source: /note="strain FostersB"
  MOD_RES (84)..(84): Any amino acid
MVDLTITGDDDDILSMFFDEEFVPHAFVDILLSNALNEDQIQTQSVSSLLLTRLDFYTKNLTKELESTIWNLDKLSQTLPRTWXSSRYHKEAEQNDSSLYSTESLKSSKLEYYLDTLASAVRALETGMHNVTEKLSDLDNENNHNTNVRQQLQSLMLIKERIEKVVYYLEQVRTVTNISTVRENNTTSTGTDLSITDFRTSLKALEDTIDESLSSAIDNEAKDETNKDLIGRIDSLSELKCLFKGLDKFFAEYSNFSESIKSKAQSYLSTKDIDDGMIS

SEQ ID NO: 813 - protein, 523 aa, Solanum lycopersicum
MALMSQAGSSHCIYSEKVRCISGHRSIINNMDMFRMREICFGVDISSRNASRRVQGNYLNHIGVGSRRGDLTIVAASPPTEDAVVAAEPLTKEDLVGYLASGCKSKEKWRIGTEHEKFGFEFGTLRPMKYDQIADLLNGIAERFDWEKVMEGDKIIGLKQGKQSISLEPGGQFELSGAPLETLHQTCAEVNSHLYQVKAVAEEMGIGFLGTGFQPKWGLKDIPIMPKGRYEIIRNYMPKVGSLGLDMMFRTCTVQVNLDFSSEADMIRKFRAGLALQPIATALFANSPFTEGKPNGYLSKRSHIWTDTDNNRAGMLPFVFDDSFGFEQYVDYALDVPMYFVYRKKKYVDCTGLSFRDFMNGKLPPIPGEYPTLNDWENHLTTIFPEVRLKRYLEMRGADGGPWRRLCALPAFWVGILYDEGSLQSVLDMTFDWTAEERDMLRNKVPKSGLKTPFRDGLLMHVAQDVVKLAKEGLERRGFKETGFLNEVAEVVKTGVTPAEKLLELYHGKWGQSVDPIFEELLY

SEQ ID NO: 814 - protein, 147 aa, Gallus gallus
MRSLLILVLCFLPLAALGKVFGRCELAAAMKRHGLDNYRGYSLGNWVCAAKFESNFNTQATNRNTDGSTDYGILQINSRWWCNDGRTPGSRNLCNIPCSALLSSDITASVNCAKKIVSDGNGMNAWVAWRNRCKGTDVQAWIRGCRL

SEQ ID NO: 815 - protein, 686 aa, Saccharomyces cerevisiae
  source: /note="strain FostersB"
  MOD_RES (642)..(642): Any amino acid
MANTTSFPIAPQAPPNWSFTPSDISGKTNEIINKSNNFYDSMSKVESPSVSNFVEPFMKFENELGPIINQLTFLQHVSSDKEIRDASVNSSMKLDELNIDLSLRHDIFLQFARVWQDVQSKADSVERETFKYVEKSYKDYIHSGLELDEGNRLKIKEIKKKISVNSINFSKNLGEQKEYITFTKEQLEGVPDSILTQFETIKSDKESDETLYKVTFKYPDIFPVMKLASSAQTRKQAFLADQNKVPENEAILLDTLKLRDELASLLGYDTYANYNLYDKMAKDSTTVMNFLNDLKDKLIPLGRKELQVLQDMKAEDVKKLNQGADPNYYIWDHRYYDNKYLLENFNVDLEKISEYFPLEATITGMLEIYETLFNLKFIETKDSQNKSVWHDDVKQIAVWNMDDAKSPNFVGWIYFDLHPRDGKYGHAANFGLSSSFMIDDTTRSYPVTALVCNFSKSTKDKPSLLKHNEIVTFFHELGHGIHDLVGQNKESRFNGPGSVPWDFVEAPSQMLEFWTWNKNELINLSSHYKTGEKIPESLINSLIKTKHVNGALFTLRQLHFGLFDMKVHTCKDLQNLSICDTWNQLRQDISLISNGGTLSKGYDSFGHIMSDSYSAGYYGYLWAEVFATDMYHTKFAKDPLNXKNGIQYRDIVLARGGLYDINDNLKEFLGREPSKDAFLKELGLQN

SEQ ID NO: 816 - protein, 874 aa, Saccharomyces cerevisiae
  source: /note="strain FostersB"
MILVCNAIQHDLQHPNEYIRGNTLRFLTKLREAELLEQMVPSVLACLEYRHAYVRKYAILAVFSIFKVSEHLLPDAKEIINSFIVAETDPICKRNAFIGLAELDRENALHYLENNIADIENLDPLLQAVFVQFIRQDANRTPALKAQYIELLMELLSTTTSDEVIFETALALTVLSANPNVLVPAVNKLIDLAVKVSDNNIKLIVLDRIQDINANNVGALEELTLDILRVLNAEDLDVRSKALDISMDLATSRNAEDVVQLLKKELQTTVNNPDQDKAMQYRQLLIKTIRTVAVNFVEMAASVVSLLLDFIGDLNSVAASGIIAFIKEVIEKYPQLRANILENMVQTLDKVRSAKAYRGALWIMGEYAEGESEIQHCWKHIRNSVGEVPILQSEIKKLTQNQEHTEENEVDATAKPTGPVILPDGTYATESAFDVKTSQKSVTDEERDSRPPIRRFVLSGDFYTAAILANTIIKLVLKFENVSKNKTVINALKAEALLILVSIVRVGQSSLVEKKIDEDSLERVMTSISILLDEVNPEEKKEEVKLLEVAFLDTTKSSFKRQIEIAKKNKHKRALKDSCKNIEPIDTPISFRQFAGVDSTNVQKDSIEEDLQLAMKGDAIHATSSSSISKLKKIVPLCGFSDPVYAEACITNNQFDVVLDVLLVNQTKETLKNLHVQFATLGDLKIIDTPQKTNVIPHGFHKFTVTVKVSSADTGVIFGNIIYDGAHGEDARYVILNDVHVDIMDYIKPATADDEHFRTMWNAFEWENKISVKSQLPTLHAYLRELVKGTNMGILTPSESLGEDDCRFLSCNLYAKSSFGEDALANLCIEKDSKTNEVIGYVRIRSKGQGLALSLGDRVALIAKKTNKLALTHV

SEQ ID NO: 817 - protein, 511 aa, Saccharomyces cerevisiae
  source: /note="strain FostersB"
MTIIQLKKLKSDYWKLYGVDESELSIPSDMSIVDNILLVSTMNEKDNLKLFEISAEKKLKELQTITVPGKPITCICLLPMVDFPPQIFPSSQINPNHNQLILTGHQDGIVNLIATSTYKGCAKIIKRFNHNKFLKSTVSTSIPILEITPKTAPILKVSPWNKTGFVSLLNDSLFIYDLKSNLDCIKTPIFLQSYPGINSFAVNEFHDPFLLALVGSKFGPNGISLLDLRTNLYIPDILDNSISAACGKDHLQRKNTSLDCVWISNHHVAQSLNDKIQIWDIQSCDGKPVCELYAKKGYIESLKFNEKTGALYSSDDQGFVICWDLQNLQNMKYGELVHGFNSISLDSENELLLTKQVFQCGNIIVSGMSDKNICLKSNDTKANGKGCGFLFLDMANDGSLVTLDNFCELGLHQICQVQFNVDTGKIIDGNGTGKSGISDSSMLSLSNESDHSMTETSDDMFSNSGNWDCSSANTVSEGRLNDDQEDIVFTKRMYSVNDVHLSGSTIDTTVV

SEQ ID NO: 818 - protein, 753 aa, Saccharomyces cerevisiae
  source: /note="strain FostersB"
  MOD_RES (100)..(100): Any amino acid
  MOD_RES (127)..(127): Any amino acid
  MOD_RES (596)..(596): Any amino acid
MVEFSLKKARNNWKHVKKSASSPAKQKTPPSPAKPKQKTKKNPYSDLKDPATSYTLPTINARERSRVATSMQRRLSIHNTNYAPPTLDYSMPLPDMPNMXVPNDNVDSSHNNSSFTTENESVSSKGXSNSLNLSTADLSLNDSSYNKVPARSAMRNTVNPSGSNDPFNNSTSLRKMLANPHFNAKDFVHDKLGNASAITIDKFTSNLTDLSIQVQEEVKLNINKSYNEIMTVNNDLNVAMLELKRVRANINDLNEVLDQCTKIAEKRLQLQDQIDQERQGNFNNVESHSNSPALLPPLKAGQNGNLMRRDRSSVLILEKFWDTELDQLFKNVEGAQKFINSTKGRHILMNSANWMELNTTTGKPLQMVQIFILNDLVLIADKSRDKQNDFIVSQCYPLKDVTVTQEEFSTKRLLFKFSNSNSSLYECRDADECSRLLDVIRKAKDDLCDIFHVEEENSKRIRESFRYLQSTQQTPGRENNRSPNKNKRRSMGGSITPGRNVTGAMDQYLLQNLTLSMHSRPRSRDMSSTAQRLKFLDEGVEEIDIELARLRFESAVETLLDIESQLEDLSERISDEELMLLNLISLKIEQRREAIXSKLSQSILSSNEIVHLKSGTENMIKLGLPEQALDLFLQNRSNFIQDLILQIGSVDNPTNYLTQLAVIRFQTIKKTVEDFQDIFKELGAKISSILVDWCSDEVDNHFKLIDKQLLNDEMLSPGSIKSSRKQIDGLKAVGLDFVYKLDEFIKKNSDKIR

SEQ ID NO: 819 - protein, 103 aa, Oreochromis niloticus [sequence omitted]

SEQ ID NO: 820 - protein, 550 aa, Saccharomyces cerevisiae
  source: /note="strain FostersB"
  MOD_RES (455)..(455): Any amino acid
MSSDEEDFNDIYGDDKPTTTEEVKKEEEQNKAGSGTSQLDQLAALQALSSSLNKLNNPNSNNSSSNNSNQDTSSNKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNXSNTDSGSPPLNLPNGPKGPSQYNDDHNSGYGYNRDRGDRDRNDRDRDYNHRSGGNHRRNGRGGRGGYNRRNNGYHPYNRLKKKKSSRKLEKSFLV

SEQ ID NO: 821 - protein, 709 aa, Saccharomyces cerevisiae
  source: /note="strain FostersB"
  MOD_RES (47)..(47): Any amino acid
MASETFEFQAEITQLMSLIINTVYSNKEIFLRELISNASDALDKIRXKSLSDPKQLETEPDLFIRITPKPEQKVLEIRDSGIGMSKAELINNLGTIAKSGTKAFMEALSAGADVSMIGQFGVGFYSLFLVADRVQVISKSNDDEQYIWESNAGGSFTVTLDEVNERIGRGTILRLFLKDDQLEYLEEKRIKEVIKRHSEFVAYPIQLVVTKEVEKEVPIPEEEKKDEEKKDEEKKDEDDKKPKLEEVDEEEEKKPKTKKVKEEVQEIEELNKTKPLWTRNPSDITQEEYNAFYKSISNDWEDPLYVKHFSVEGQLEFRAILFIPKRAPFDLFESKKKKNNIKLYVRRVFITDEAEDLIPEWLSFVKGVVDSEDLPLNLSREMLQQNKIMKVIRKNIVKKLIEAFNEIAEDSEQFEKFYSAFSKNIKLGVHEDTQNRAALAKLLRYNSTKSVDELTSLTDYVTRMPEHQKNIYYITGESLKAVEKSPFLDALKAKNFEVLFLTDPIDEYAFTQLKEFEGKTLVDITKDFELEETDEEKAEREKEIKEYEPLTKALKEILGDQVEKVVVSYKLLDAPAAIRTGQFGWSANMERIMKAQALRDSSMSSYMSSKKTFEISPKSPIIKELKKRVDEGGAQDKTVKDLTKLLYETALLTSGFSLDEPTSFASRINRLISLGLNIDEDEETETAPEASTAAPVEEVPADTEMEEVD

SEQ ID NO: 822 - protein, 716 aa, Oryza sativa
  source: /note="subsp. japonica"
MAWRMLRRKDFHTGLVNLASRVDHGGAKNFSSGTFGKLADFVLSDTHTPIVKGAANCTAYKHCTIRNFHAGVYMLAWSRKREEVAGLKAPKKEKRVKRETRTQPPVEAPYVAPKQKIAIKSSPDKTVDIFDGMTLLDLSKRTGASIGALQDILTDLGEKVESEFDAISIDLAELVAMELGVNIRRMHTGEGTLEPRPAVVTIMGHVDHGKTSLLDSLRQTSVAAKEAGGITQHIGAFVVEMPSGASITFLDTPGHAAFSAMRARGAAVTDIVVLVVAADDGVMPQTLEAMSHAKAANVPIVVAVNKCDKSGADPERVRIQLGSEGLLLEDMGGDVQVVEISAVTKLGLDKLEEALLLQAEIMDLKARIDGPAQAFVVEARVDRGRGPLATAIVKAGTLVSGQHIVVGAEWGRIRSLRDTAGKITESAKPAMPVEIEGLRGLPMAGDDVVVVDSEERARMLSQGRKKKQEKDRLRKIDEDMTEEAEIGEETPERVEMPIIVKADVQGSVQAVTDALRSLNSPQVFVNIVHVGVGPISQHDIDLAQACRAYIVGFNIRTPPSAITLAATQANIKILLHKVIYHLLEEMGREIVEKAPGTPETQVSGEAEVLNIFELKGRSKSKGPDIKIAGCRITDGHLSKTGTMRLLRSGDVVFEGPCASLKREKQDAETVDKGNDCGLVIQDCNDFQVGDIVQCLEQVIRKPKFISTQSGAVRIEC

SEQ ID NO: 823 - protein, 547 aa, Vitis vinifera
MGMSAQPISKERKAAPVIIPEKRKPVTEVDTRFVRCTVFSKLVSECLSEKWLSTPIHVSIFFPLLCLARRLHIVPVFFLWSSSYSSSMDETMGSMPSQKTLGNYRLGKTLGIGAFGKVKVALHTTTKLKVAIKILDRQSIDDSTADRVKREINILRLFSHPHIVRLYEVIETRTKIYVVMEYMNSGELFDYITENDRLQEDEARHFFQQIISGVECCHVNMVVHRDLKPENLLLDTKRNVKVADFGLSNVMRDGHFLKTSCGSPNYAAPEVISEQLYSGPEVDVWSCGVILFALLCGRLPFDADSLSGLYAKIKSGIYTFPNHLSRAARDLIARILVVDPIKRISIPEIRRHPWFQQHLPKYIALRTIDAIYTTNKVDEEIVQQVVKIGFDINEVIQSLQNRLQNEATVAYHLLLDNHFRIHCSYLKNEFIESLPQDPNPTDHPEMQMSSLAPMQRQWALGLKSQARPIETMTTVLKVFERLNVKWKKIGPYNMKCLWIPPLAAYPKLTVGNDPAQDHIYSVDPSIMAMNKRAIRSQNAVKFEIQGK

SEQ ID NO: 824 - protein, 501 aa, Vitis vinifera
MGDKSCCWLVFFLFIFSSFVEQSHGRVRKQTELLKLLQKAKMQGNSGIDTSLFEVNEIKSEAESYKILPQKGMKEKDRIERLPGQPHVGFSQYGGYVTIDESKGEAFYYYFVEAPTSRESLPLLLWFNGGPGCSSLAYGAMQELGPFRVHSDGKTLYRNQYAWNKVANVLFLESPAGVGFSYSNTTSDNQSGGDRKTANENYAFLVNWLERFPEYKKRDFYISGESYAGHYVPQLAHTILHHNKKANGPIINLKGIIIGNAVIDDEADDIGRYQYLGSHALVSEKTIHQMEKHCNFSPGATSQSKECTEAVDEVHSNIDVIDIYNIYSPLCFNTILTAKPKKVTPEFDPCSDYYVSAYLNRADVQKALHANVTKLKYEWRPCSDIDKNWTDSPLTIIPLLREFMANGLRVWVFSGDTDGDVPVTSTMASIGKMRLSVKTPWHPWFVAGEVGGYTEVYKGDLTFATVRGAGHQVPSFRPKRALSLIVHFLSGTPLPKPSSKH

SEQ ID NO: 825 - protein, 1278 aa, Saccharomyces cerevisiae
  source: /note="strain FostersB"
MNGSGKTTIIECLKYATTGDLPPNSKGGVFIHDPKITGEKDIRAQVKLAFTSANGLNMIVTRNIQLLMKKTTTTFKTLEGQLVAINNSGDRSTLSTRSLELDAQVPLYLGVPKAILEYVIFCHQEDSLWPLSEPSNLKKKFDEIFQAMKFTKALDNLKSIKKDMSVDIKLLKQSVEHLKLDKDRSKAMKLNIHQLQTKIDQYNEEVSEIESQLNEITEKSDKLFKSNQDFQKILSKVENLKNTKLSISDQVKRLSNSIDILDLSKPDLQNLLANFSKVLMDKNNQLRDLETDISSLKDRQSSLQSLSNSLIRRQGELEAGKETYEKNRNHLSSLKEAFQHKFQGLSNIENSDMAQVNHEMSQFKAFISQDLTDTIDQFAKDIQLKETNLSDLIKSITVDSQNLEYNKKDRSKLIHDSEELAEKLKSFKSLSTQDSLNHELENLKTYKEKLQSWESENIIPKLNQKIEEKNNEMIILENQIEKFQDRIMKTNQQADLYAKLGLIKKSINTKLDELQKITEKLQNDSRIRQVFPLTQEFQRADLEMDFQKLFINMQKNIAINNKKMHELDRRYTNALYNLNTIEKDLQDNQKSKEKVIQLLSENLPEDCTIDEYNDVLEETELSYKTALENLKMHQTTLEFNRKALEIAERDSCCYLCSRKFENESFKSKLLQELKTKTDANFEKTLKDTVQNEKEYLHSLRLLEKHIITLNSINEKIDNSQKCLEKAKEETKTSKSKLDELEVDSTKLKDEKELAESEIRPLIEKFTYLEKELKDLENSSKTISEELSSYNTSEDGIQTVDELRDQQRKMNDSLRELRKTISDLQMEKDEKVRENSRMINLIKEKELTVSEIESSLTQKQNIDDSIRSKRENINDIDSRVKELEARIISLKNKKDEAQSVLDKVKNERDIQVRNKQKTVADINRLIDRFQTIYNEVVDFEAKGFDELQTTIKELELNKAQMLELKEQLDLKSNEVNEEKRKLADSNNEEKNLKQNLELIELKSQLQHIESEISRLDVQNAEAERDKYQEESLRLRTRFEKLSSENAGKLGEMKQLQNQIDSLTHQLRTDYKDIEKNYHKEWVELQTRSFVTDDIDVYSKALDSAIMKYHGLKMQDINRIIDELWKRTYSGTDIDTIKIRSDEVSSTVKGKSYNYRVVMYKQDVELDMRGRCSAGQKVLASIIIRLALSETFGANCGVIALDEPTTNLDEENIESLAKSLHNIINMRRHQKNFQLIVITHDEKFLGHMNAAAFTDHFFKVKRDDRQKSQIEWVDINRVTY

SEQ ID NO: 826 - protein, 469 aa, Saccharomyces cerevisiae
  source: /note="strain FostersB"
MDLFKRKVKEWVYSLSTDDHYAEYNPDETPTFNMGKRLNSNNGQVNPSQMYLNSVDEEMSMGFQNGVPSNEDINIDEFTSTESNDGVSETLLAWRHIDFWTSEHNPDLNATLSDPCTQNDITHAEEDLEVSFPNPVKASFKIHDGQEDLESMTGTSGLFYGFQLMTLDQVVAMTQAWRNVAKNLNKRSQQGLSHVTSTGSSSSMERLNGNKFKLPNIPDQKSIPPNAVQPVYAHPAWIPLITDNAGNHIGVDLAPGPNGKYAQIITFGRDFDTKFVIAENWGEFLLSFANDLEAGNWYLVDDNDDYFSGDGELVFRDKKSNGPIQDYFEVLKRRTWIKYQENLRSQQQKSQPDTSLQEQKYVPASQKKVAAEQPSTLNAESIKGEDSGSADVQSVQDHESVKIVKTEPSEAETTTVNTESLGQAEHEIKADNVDIKQESERKEDEKQPKVEEKEHVENEHVTESAKKRR

SEQ ID NO: 827 - protein, 1098 aa, Saccharomyces cerevisiae
  source: /note="strain FostersB"
  MOD_RES (374)..(374): Any amino acid
  MOD_RES (412)..(412): Any amino acid
  MOD_RES (415)..(415): Any amino acid
  MOD_RES (761)..(761): Any amino acid
MALIVASLFLPYQPQFELDTSLPENSQVDSSLVNIQAMANDQQQQRALSNNISQESLVAPAPEQGVPPAISRSATRSPSAFNRASSTTNTATLDDLVSSDIFMENLTANATTSHTPTSKTMLKPRKNGSVERFFSPSSNIPTDRIASPIQHEHDSGSRIASPIQQQQQDPTTNLLKNVNKSLLVHSLLNNTSQTSLEGPNNHIVTPKSRAGNRPTSAATSLVNRTKQGSASSGSSGSSAPPSIKRITPHLTASAAKQRPLLAKQPSNLKYSELADISSSETSSQHNESDPDDLTTAPDEEYVSDLEMDDAKQDYKVPKFGGYSNKSKLKKYALLRSSQELFSRLPWSIVPSIKGNGAMKNAINTAVLENIIPHXHVKWVGTVGIPTDEIPENILANISDSLKDKYDSYPVLXDDXTFKAAYKNYCKQILWPTLHYQIPDNPNSKAFEDHSWKFYRNLNQRFADAIVKIYKKGDTIWIHDYHLMLVPQMVRDVLPFAKIGFTLHVSFPSSEVFRCLAQREKILEGLTGADFVGFQTREYARHFLQTSNRLLMADVVHDEDLKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILXGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 828 - protein, 720 aa, Agaricus bisporus
  source: /note="var. bisporus"
  source: /note="strain H97 / ATCC MYA-4626 / FGSC 10389"
MTVKEIPDRSIRICADRGGTFCDIHASYPDPENPSEQKELVVKLLSQDTANYKDAPTEGIRRVLEQVTGKSIPRGSVLSTDKIDYIRLSTTVATNALLERKGHKHALLITKGFKDLLLIGNQARPKIFDLNIRRPPPLYSKVIEVDERVTLVGYTSDPKSEEHAVQFDADGKVTRGYRGKGWDNEGLAEGPGEIIRGISGEAVRIMKKPDMKAVEKDLRDLYSEGYRSIAIVLVHSYTFPDHEVAIGSLARSIGFAQVSESAQLLPMIKMVPRGVSSTADAYLTPILREYLDGFFDNFDEKLRDGKVKSPRVEFMGSDGGLVDLERFSGLKSILSGPAGGVVGYALTSWDVKVKKPIIGLDVGGTSTDVSRFDGRYEVVYETTTAGVTIQSPQLDINTVAAGGGSCLTFRNGLFLAGPESAGAQPGPACYRKGGPLAVTDANLMLGRLIPDYFPKIFGKSEKEPLDSDASRVLFEQLAKDINASHEGEFSLDDVVYGFIKVANETMARPIRALTEARGHATSKHVLATFGGAGGQHACEIAKLLGITTILVHRYSSILSAYGLALADRANEIQEPSSTFYTPQNRAGLLSRLDKLTKQVRTELEQEGFEDKRISMERMLNMRFEGTDTALMVLPNENDGDGNEDFLAAFNRAYKAEFGFLLESKSVIVDDIKVRGIGKTFDSLGDSVYTEVASLQSSNSIKALSPTQADSRHSVYFDVIG

SEQ ID NO: 829 - protein, 1413 aa, Bos taurus
LQSADIDNHHALIEYNEAEGSFVLQDFNSRSGTFVNECHIQNVAVKLLPGDLLRFGTGGLTYELVIENPASVSFPWTMGPAPWPRPQPSRTTQQPNQSPSPPQVPFHPGVRPVPVQRSWSQGFPRPSVVPPASHKRPMSASGKMFSFMMDGTAHGVPIIKQVWTNAVDLSDQPVAEEIPGAGSAREMFVDHDLAQREKDEIILLLGKEVSRLSDFELESKYKDAVISNLQNEVARLSQKLSETATSRQNERVVPPKLQVLEEDDDAQQREIENLKSQISALQQGYSQVLCQTLSERNLEITSLKNQGENLRRDNAITSEMVSSLQKDMLAKDEQVQQLKQEVNQLKSENKEKDHQLEALNSRCSVLKEELKKEDAQKGEEAQEKELKLYKTQIHGMEKEVRKLREELKRSSTEQSLISKTLREKSKVEEKLQEDSRRKLLQLQEMGNRENLIKANLERAVGQLEHFRSQVIKATYGRTKPFQDKPISDQQLIEKITQVTEDNINFQQKKWTLPKESQLGLCRHEEVTDSVERLKKALDSCQACMKMSCCSNDLRKEVSLLQHLQVSPPVSGLQKVSLDILRLSLSWLEETEHLLQDVGIQFSSSNKGLSLYLKYLLEHYKKITSRTQELQIKISSSQETQQSLMQEKLREHLAEKEKLSEERLQQEEKLKARVQCLMEEKAALEETISQEKSRAKEALEGQQSKVQELENRLTHQKEVLESSMAHEKRKAKEALETEKRKVQDLENHLTQQKEISESSIAYEKNKAKEAIEKEKKKVQDLENRITKQKEEMDLKMQKEDILNNKLNDALAMLEKAQKTKIAESLKAENLTMKLNETLAELETAKTKMIMMEERMQLQQHRVMALQEEQESQKHEFEKQIMEYKEQIKQHSQTIVSLEERLQKVTEHHRKIEGEIATLKDNDPAQEGDAQPDPAAAPLGESSSKDAMCDHLIEDLLTAQKEILSQQEIIMRLRKNLTEAHNRMSDLRGELNEKQKIELERNVALVQQQSSELSVLKDKMVQMTGLVEKKDKELEVLKQALRASQEKQKLQLHKEKEQKPRNTTKMCDISVQIEPVHTDIFLSSQEEQSFSDLGAKCKGSRHEEVIQRQKKALSELRARIKELEKAGSSNPKDHMDESFLDLKTLGMEKNVQKILDVKPDLPTFSRVESRVPQNGLSSSGSIMATNKLGKTDATEALDLSEKLYMDMSKTLGSLMNIKDMSGHVSMKHLSPKERERVNQLRQRDLDMVFDKITQLKNRLERKEELLRGYEKDIEQLRQSKVSVQMYQSQVAKLEDDIYKEAEEKALLKEALERMEQQLHQEKRVNRAIRQQKERLEDLEQRNAKESAACNCSFKEKERQRQMFVEAVKNKMQNSNFQVGARKATAKMDQEREMLKREMSSKSSQSLLFSKPGGRN

SEQ ID NO: 830 - protein, 267 aa, Glycine max
CSEKKRPSPPYILWMKDQRNEIKKVNPEAGFKEISTMLGVKWKTVTAEEKKPYEGIYHAEKEAYLQVIAKEKHETESMRLLEDEQKQRTAMELLEQYMQFKQEAEKDGKKNKKEKDPLKPKHPMSAYFLFTNDRRAALAAENKNFLEVPKITFEEWKNMTEEQKRPYEEMAKKNKEQYALEMEAYKQKKDEEAGHFMKEEEDHMKVQKQEALQLLKKKEKIENIIKFFSSNLQKKKQNKDDKNSDPNRPKMQHTSLLQLSFSSCSFY

SEQ ID NO: 831 - protein, 915 aa, Agaricus bisporus
  source: /note="var. bisporus"
  source: /note="strain H97 / ATCC MYA-4626 / FGSC 10389"
MSTEIPAVPPRAPRYGPPQLPWGRSFDYTYSDDDGIKESFLVFSSKAYELDKQLGQLANGCLRLGRVAGLLLAIKRTREMLRRTREVFFHNATALVPELFELAREDCNSKSGASNSERFHISSQYFDQHLPPFEMLPTNLEELATSFYLLYVRIDEFREFTDEGKLLKSLLMTLDRDLKYRASCAGFYSGRLNTPLIQRYVHQFINELQVDFEKVTAAVDEFAAVGVSAISHEQARSSLNLTNILTVSTFFSGVTASTLQMSTSASDDKDDTILLANLLWFMSMIFSVGAALNSLLAMAWKATRSGSRGSKLPFWVTMWIDGSQLLFLGISILTFSAGLIVFAFASSQASYTPYLAVASTAVTFIGLVAILLWMLYEMVVSPVLRQQADIIKSSGDSVHSEFSNISLVHGGIASAITNALPFLRFQQDQPREDVEQVEDKDDESEESPTQKHNLQDQLKMKLQGGVKSVSIINSALGAFATAGRKKKRGRHERRRQLKPKLRIDNSSAAVPLTELTLSDKPVSYLELARYGIIRDVAYSDDGKWLAVTCTKEHAAQSWTATLTVLLDTWHEGRVIAECLKWSPSGKKLIVKFEHRFDVWDLDAKVLHIIERHHMVQDVAWFDEDTFLVAEHSCVFKMDLTRLVMAVYRFERNHIRSIGVEMKNNYLVLITRVAKSPEEFEPACGRSEKRIIIYDMGKQEEIYQVPVLEDISYIYPIPDELDILITHKDQATFQLWTLDAGVRGAQITAKLKKRIVTPHRDPGDYIGPTRIGGNYNQFVFNVTTSGDIDIWRRESGMPYLRFQSPKLQEEGEGVHCFSWRRSDDETATFATAGIQGHTLWVWRGEELLLPKTPASLESLNRFSPKFATNERNRARWQRATNMSVVASSGSLSPREIERIDESVTEVNPEEDLHARS

SEQ ID NO: 832 - protein, 222 aa, Agaricus bisporus
  source: /note="var. bisporus"
  source: /note="strain H97 / ATCC MYA-4626 / FGSC 10389"
MPLLNKNNSAVKRIMQEARELANDPSTDYSAAPLEDDIFEWHCTLRGSPGTEFEGGLYHFRILLPAEYPFRPPSIMMLTPNGRFELNTKICISFTNYHEELWQPAWGVRTAIIGLQGFFPLKGEAAVGVGSIEYPASERRRLAGLSREWVCPQCQRQNAELLREDGEGERKVPEKAGDDGGHGSVGGMEPAKPKSHRPPVVLDGAICIVFVLFCVLLCRRFF

SEQ ID NO: 833 - protein, 4852 aa, Gallus gallus
MAAMVPPVKLKWLEHLNSSWITEDSESIATREGVSILYAKLVSNKEVVPLPQQVLCLKGPQLPDFERESLSSDEQDHYLDALLSSQLALAKMVCSDSPFAGALRKRLLVLQRVFYALSNKYHDKGKVKQQQHSPESSSGSTDVHSVSERPRSSTDALIEMGVRTGLSLLFALLRQSWMMPASGPGLSLCNDVIHTAIEVVSSLPPLSLANESKIPPMGLDCLSQVTTFLKGVTIPNSGADTLGRRLASELLLGLAAQRGSLRYLLEWIEMALNASAVVNTMEKTKLLQSPEGMISFDCFMSILMQMRRSLGSSADRSQWREPTRTSDGLCSLYEAALCLFEEVCRMASDYSRTCASPDSIQTGDAPIVSETCEVYVWGSNSSHQLVEGTQEKILQPKLAPSFSDAQTIEAGQYCTFVISTDGSVRACGKGSYGRLGLGDSNNQSTLKKLTFEPHRSIKKVSSSKGSDGHTLAFTTEGEVFSWGDGDYGKLGHGNSSTQKYPKLIQGPLQGKVVVCVSAGYRHSAAVTEDGELYTWGEGDFGRLGHGDSNSRNIPTLVKDISNVGEVSCGSSHTIALSKDGRTVWSFGGGDNGKLGHGDTNRVYKPKVIEALQGMFIRKVCAGSQSSLALTSTGQVYAWGCGACLGCGSSEATALRPKLIEELAATRIVDISIGDSHCLALSHDNEVYAWGNNSMGQCGQGNSTGPITKPKKVSGLDGVSIQQISAGTSHSLAWTALPRDRQVVAWHRPYCVDLEESTFSHLRSFLEHYCDKINSEIPPLPFPSSREHHSFLKLCLKLLSNHLALALAGGVATSILGRQAGPLRNLLFRLMDSSVPDEIQEVVIETLSVGATMLLPPLRERMELLHSLLPQGPDRWESLSKGQRMQLDIILTSLQDHTHVASLLGYSSPSDTTETSSLCISYGNLSDQTYSVQSSHPDTHLAEILMKTLLRNLGFYTDQAFGELEKNSDKFLLGASSSENSQPAHLHELLCSLQKQLLAFCHINSVSENSSSVALLHKHLQLLLPHATDIYSRSATLLKESSWNGSVGEKLRDVIYVSAAGSMLSQIVNSLLLLPVSVARPLLSYLLDLLPPLDRLNRLLPAAALLEDQELQWPLHGGPELIDPAGVSLPQPAQSWVWLVDLERTVALLIGRCLGGMLQGPPVSPEEQDTAYWLKTPLFSDGVEMDIPHLDKCMSSLLEVALSGNEEQKPFDYKLRPEITVYVDLALGCTKEPARSLWISMQDYAVSKDWDTATLTNESLLDTVSRFVLAALLKHTSLLSQACGESRYQPGKALAEVYRCVYKVRSRLLACKNMELIQTRSSSRDRWMLDNQESADVDTQEHSFTRTIDEEAEMEEQAERDREEGHIEQEDEEEEREHEVMTAGKIFQCFLSAREVARSRDRDRMSTGTGTRLDDQPPQSQQERRISTDLTEGQDVYTAACNSVIHRSALLILGVSPVIEDFQKRREDGHLQQPPSTAPEGIGLMTRSESLTAESRSIHANSNYRLMKSRSESDLSQPESDEEGYSLSGRRNVDLDLASSHRKRGAIHSQVEPLTDSWARLKHSRDWLYTSSYSFIESDFDLSRSLGVHTLIENVVSFVSGDVGNSPGFKEPEESMSTSPQASIIAMEQQQLRAELRLEALHQILVLLSGMEEKGSVALMGSHQGPGFQSSSLLTSVRLQFLAGCFGLGTVGHAGAKGESVRLHHYQDGIRAAKRSIQIEIQVAVHKIYQQLSATLERALQANKHHIEAQQRLLLVTVFALSVHYQPVDVSLAISTGLLNVLSQLCGTDTMLGQPLQLLPKTGISQLSTALKVASTRLLQILAITTGTYADKLSPKVVQSLLDLLCSQLKNLLSQAGVMLMASFGEEEVEEHEAESKKADSNGENEKRDFRAALRKQHAAELHLGDFLVFLRRVVSSKAIQSKMASPKWTEVLLNIASQKCCSGVPLVGNLRTRLLALHVLEAVLPACESGVEDDQMAQVVERLFSLLSDCMWETPIAQAKHAIQIKEKEQEMKLQKQGESEDEDENLPIQEVSFDPEKAQCCIVENGQILTHGSGGKGYGLASTGVTSGCYQWKFYIVKENRGNEGTCVGVSRWPVHDFNHRTTSDMWLYRAYSGNLYHNGEQTLTLSSFTQGDFITCVLDMEARTISFGKNGEEPKLAFEDVDAAELYPCVMFYSSNPGEKVKICDMQMRGTPRDLLPGDPICSPVAAVLAEATIQLIRILHRTDRWTHCINKKMMERLNKIKTCLKEAGQKLKKSRSIQSREENEVREEKENKEEEKGKHNRHGLADLSELQLKMLCVEVWPVLAVIGGVDAGLRVGGRCVHKQTGRHATLLGVVKEGSTSAKVQWDEAEITISDTPLYNLEPCEPLPFDVARFRGLTATVLLDLTYLTGIHEDMGKQSTKRHEKKHRHESEDKGETDQKMEGDAGPDTRSALSADDNKAHSTASSKSENEIASFSLEPSALGMESQHQPAEGRKKNHEHSPRNHDIVQSEIRAVQLSYLYLGAMKSLSVLLSCSKYAELLLIPKVLAENGHNSDCASSPVVHEDVEMRAALQFLMRHMVKRAVMRSPIKRALGLADLERAQAMIYKLVVHGLLEDQFGGRLKQEVDQQVEEGDQSQQAQTPVTTSPSASSTTSFMSSSLEDTTTATTPVTDTETVPASESPGVMPLSLLRQMFSSYPTTTVLPARRAQTPPISSLPTSPSDEVGRRQSLTSPDSQSARPTNRTALSDPSSRLSTSPPPPAIAVPLLEMGFSLRQIAKAMEATGARGEADAQNITVLAMWMIEHPGNEDDEEPQPDVTADARHGAIVSGSGGKSGDHCYLQSPGDIPSADAAEMEEGFSESPDNMDHVDNAASASGPPSRSRSSVTRRHKFDLAARTLLARAAGLYRSVQAHRNQSRREGISLQQDPGALYDFNLDEELEIDLDDEAMEAMFGQDLASDNDILGMWIPEVLDWPTWHVCESEDREEVVVCELCESSVVSFNQHMKRNHPGCGRSANRQGYRSNGSYVDGWFGGECGSGNPYYLLCGVCREKYLALKSKSKTSTSERYKGQAPDLIGKQDSVYEEDWDMLDVDEDEKLTGEEEFELLAGPLGLNDRRIVPEPVQFPDSDPLGASVAMVTATNSMEETLMQIGCHGSIEKSSSGRITLGEQAAALVNPHDRVMALRRVTAAAQVLLARTMVMRALSLLSVSGSSCSLAAGLESLGLTDIRTLVRLMCLAAAGRAGLSTSPCTVSSSTERSRGIHSKTSKPISCLAYLSTAVGCLASNTPSAAKLLVQLCTQNLISAATGVNLTTVDDPIQRKFLPSFLRGIAEENKLVTSPNFVVTQALVALLADKGAKLRPNYDKAEFEKKGPLELANALAACCLSSRLSSQHRQWAAQQLVRTLAAHDRDNQTIPQTLADMGGDLRKCSFIKLEAHQKQVMTCVWCNKKGLLATSGNDGTIRVWNVTKKQYSLQQTCVLNKLEGDSEESLGSPSDLSLSLICWSISGKYLAGATEKMVNIWQVNGGKGLLDLQPHWVSALAWPEEGPAAAWKGELLLIGRMDGSLGLIEVVDISTMHRIELEHCYRKDVSVTCLAWFSEDKPFAVGYSDGKLLIGTKEPLEKGEIVLLDAHKDTIVSMKWDPTGKILLTCAKEEMVKLWAYMGGSWRRLHSLPHPAFVNGIAWCGLPGKGSKLQLLLATGCHNGLVCVWTVPQDIAVTLQTSSAYSEGWWDQETSGQDGYRKAVEAKCVFQLRGHITPVRTVAFSPDGLALVSGGLGGLMNIWSLRDGSVLQSVVIGSGAIQTAVWIPEVGVAACCNRSKDVLVVNCTSEWISSNHILATCRTALKQQGVLGLNMAPCMRAFLERLPIMLQEQYAYEKPHVVCGDQLVHSPYMQCLASLAVGLHLDQLLCNPPVPPHHQNCLPDPSTWSPTEWAWLECFSTTIKAAEALAKGAQFPESFTVPDLEPVPEDELTLLMDNSKWINGMDEQIMSWATSRPEDWHLGGKCDVYLWGAGRHGQLAEAGRNVMVPVAAPSFSQAQQVVCGQNCTFVIQANGTVLACGEGSYGRLGQGNSDDLHVLTVISALQGFVVTQLVTSCGSDGHSMALTESGEVFSWGDGDYGKLGHGNSDRQRRPRQIEALQGEEVVQMSCGFKHSAVVTADGKLFTFGNGDYGRLGLGNTSNKKLPERVTALEGYQIGQVACGLNHTVAVSTDGSMVWAFGDGDYGKLGLGNSTAKSSPQKVDILCGIGIKKVACGTQFSVALTKDGHVYTFGQDRLIGLPEGRARNHNRPQQVPVLSGVFIEDIAVGAEHTLALSSTGDVYAWGSNSEGQLGLGHTNHVREPTLITVLQGKNIRQISAGRCHSAAWTAPPVPPRAPGVSVPLQLGLPDAIPPQYGALKEVSIHTVRARLRLLYHFSDLMYSSWRLLNLSPNNQNSTSHYNAGTWGIVQGQLRPLLAPRVYTLPMVRSIGKTMVQGKNYGPQITVKRISTRGRKCKPIFVQIARQVVKLNASDLRLPSRAWKVKLVGEGADDAGGVFDDTITEMCQELETGVVDLLIPSPNATAEVGYNRDRFLFNPSACLDEHLMQFKFLGILMGVAIRTKKPLDLHLAPMVWKQLCCIPLILEDLEEVDLLYVQTLNSILHIEDSGITEENFHEMIPLDSFVGQSADGKMVPIIPGGNSIPLTFSNRKEYVERAIEYRLHEMDRQVAAVREGMSWIVPVPLLSLLTAKQLEQMVCGMPEISVEVLKKVVRYREVDEQHQLVQWFWHTLEEFSNEERVLFMRFVSGRSRLPANTADISQRFQIMKVDRPYDSLPTSQTCFFQLRLPPYSSQLIMAERLRYAINNCRSIDMDNYMLSRNVDNAEGSDTDY

SEQ ID NO: 834 - protein, 390 aa, Gallus gallus
MPYVDRQNRICGFLDIEENENSGKFLRRYFILDTREDSLVWYMDNPQNLPSGSPPVGVIKLTYISKVSDATKLRPKAEFCFVMNAGMRKYFLQANDQQDLVEWVNVLNKATKITVPKQSDPLCQMDNANRQAESPGGKKQVSYRTEIVGGVPIITPTQKEEVNECSEGGDRSYLKRSQSHLPYFTAKHPPDNAIIKAGYCVKQGAVMKNWKRRYFQLDENTIGYFKSELEKEPLRVIPLKEVHKVQECKQSDIMMRDNLFEIVTTSRTFYVQADSPEDMHSWIKAISGAIVAQRGPGRSAASMRQARRLSNPCIQRSIPSLLPNPAMLSVLPSQPQPPHIPQPLTTALWSQTLTPNTLPWRSEDFTNLLPRPSQGATRSRLSLQENQLPK

SEQ ID NO: 835 - protein, 542 aa, Glycine max
MAEAEHNDPTSPEREVQTKSNKKKLRKRKRPHKTEQKRDEDKNDANIDSAQTQTEDEEEEQKEEDTNNFSSGIMSTESFSSLGLSEPTSKAIADMGFHRMTQIQAKAIPPLLTRKDVLGAARTGAGKTLAFLVPAVELLYSIQFTPRNGTGVVVICPTRELAIQTHAVAKELLKYHSQTLGLVIGGSGRKGEAERIVKGVNLLVATPGRLLDHLQNTKGFIYKNLKCLMIDEADRILEANFEEEMKQIINILPKKRQTALFSATQTKKVEDLARLSFQATPIYIDVDDGRKKVTNEGLQQGYVVVPCAKRFVVLYSFLRRYQSKKVMVFFSSCNSVKFHADLLKCTGLDCLNIHGKQKQHARTTTFFNFCKAEKGILLCTDVAARGLDIPDVDWIVQYDPPDEPKEYIHRVGRTARGEGGKGNALLFLIPEELQFLHYLKAAKVPVKEYAFDHKKLANVQSQLEKLVAGIYHLNVMAKDAYRSYILAYNSHSMKDIFNVHRLDLQAVAASFCFSNPPKVNLNIDSSASKHRKKIRKVEGKRR

SEQ ID NO: 836 - protein, 3260 aa, Ovis aries
MSWALEEWKEGLPTRALQKIQELEGQLDKLKKERQQRQFQLETLEAALQKQKQKIENEKTEGANLKRENQSLMEICENLEKTKQKISHELQVKESQVNFQEGQLNSSKKQIEKLEQELKRCKSELERSQQAAQSADVSLNSCLTPQKIFATPLTPSQYYSGSKYEDLKEKYNKEVEERKRLEAEVKALQAKKASQAIPQSTMNHRDIARHQASSSVFSWQQEKTPSRLSSNTLKTPVRRDFSASHFSGEQEVTPSRSTLQIGKTDANSSFCDNSSNSHLLDQLKAQNQELRSKISELELRLQGQEKEMKGQVNKLQELQLQLEKAKVELNEKEKVLNKTRDELVRTTSQYDQASTKCTALEQKLKKLTEDLSCQRQNAESARCSLEQKIKEKEKEFQEELSRQQRSFQTLDQECTQMKARLTQELQQAKNTYNILQAELDKVTSVKHQVEKKLEEFKQNLSKTEQALQASQTKENELRRSSEEMKRENSLLKSQSEQRAREVCHLEEELKKAKQCLSQSQNFAEEMKAKNTSQETMLRDLQEKINQQENSLTLEKLKLALADLEKQRDCSQDLLKKREHHIEQLNEKLSKTERESEALLSALELKKKEYEELKEEKTLFSRWKRENEQLLNQMESEKESLQSKVNHLETCLKTQQIKSHEYNERVRTLEMERENLNVEIRNLQNVIDSKTAEAETQKRAYGELQQKAEFSDQKHEKEIENMCLKISHLTGQVEDLEHKLQLLSSEIMGKDQRYQDLHAEYESLRDLLKSRDSSAVTVEPHQRSRLAFEQQSALNNSFASIIGEQESVSSERSGCHVATDQSPESSSMLQNRVVSLEFSLESQKQMNSDLQKQCEELVQIKGEIEENLMKAEQMHQSFVAETSQRISKLQEDTSVHQNVVTETLAALESKERELQFLNEKLETEQAEIGELKKNNHLLQESLKELQFLSETLSLEKKELNSIISLNKKDIEGLTQENGTLKEINATLTREKMNLLQKTESFSNCIDERDKSISELSNQYKQERLTLLQRCEETGNAFQDLSEKYKAVQEKNSKLECLLSECTGVCEDRKNELGQLKETFAREHQAFVSQLASAEERNQNLILELETVQQALQSEITDIQNSSKREADGLKQEIMKLKEEQNKMQQEVNALLQENEHLMELMRTKHEHQCLELEPIQDSEKEGEREINTCHVQLPMDLDVKDSSLDTYKAQLVQVESEVRNMELRLQKSEKEECLQHELQARELETEDLQQDTQSQDISSLGDSEIDPEEKYISVLHELSTSQQDNAHLQCSLQTAMNKLNELEKMCEALQVEKSELISELNDSRSECITATSKMAEEVGKLVKEVETLNDENGLLQGESVEETPEGEFGVQQDEQTSVNLNPLDDCNFYEHLTMSNKEVQMHFAELQEKFSSLQSEHKILHEQHCLMSSKMSELQSYVDTLKAENSVLSMSLRSAQGDLVKEVTPAPGEEHSLSLSFSCVTDSPGNASLGESSFYKDLLEHTTETSLLHNLEGTVSANQSSVEEVSCSSLEEENLTEKETPSGPLRSTRELETLCQTYLQSLKQLEEEIESQGLTKNKEIEELKELLSSSREELDYLRKQYLSENEQWQQKLTDVTAEMESKLAAEKRHTEHLTLELEVARLQLQGLDLSSRSLLGTDIEDAIPGGNDSCDIRESEEYTSEPKERTPKHEIHQVCEKDVQQDLSLEMEKITKTGAARLTEEWSREQSSEASPEAPVGDPAQGCSECTSELYLPGPNASVPRDVLENQVTIQSLELKVKETSNENLRLLHGIEERDQKVDNLLNEIKELDSKFHLLEVQLTTKIEACVALEKIVEELKKEKLDLNEKLASFSCHNQREESSGGLTPSLEMVTSKLPHEDIEDDVAKVTDNWREKCLQVENELQRVQSEKDSMEHHTLSAEASLEAVQTEKLYLEKDNENKQTVITCLEEGLSVVTSERDQLRGELDTLSKENQELDQMSEKMKEKIRELESHQRECLHLQEQLQSLEKDSQALSLVRSELENQIEQLNKEKDSLVWESESLQTKLSESENEKLAITKALETALMEKGEVAVRLSSTQEEVHQLRKGIEKLRVRIEADEKKQLHVSEKLKASERRNDSLQDKVETLERELQMAEENQELVILDAENCKAEVETLKTQIELTTERLKDLESDLVTIRTEKENLVKQLQEKQGQASELDTLLSSLKNLLEEKEREKIQMKEESKAAVEMLQTQLRELSEEVAALCDDQETWKVKEQSLDSPAQEVQQLRNNIEKLKLHLDIDKKQQLHILEKLKESEHQADLLKDTVENLERELKLSGENQEHVTLEAEKSKAEVETLKATAKEMDQNLRGLQLDLVNIRSEKEDLTKELLKEQSRVSELQTLNSSFENLLREKEQEKVQMKEESKAAVEMLQTQLKELSEEVATLYVDQETWKVEEQSLDSPIEEVQQLRNNLGKLKVCLDADKKQQLCILEKLKESQHQADFLKDTVENLERELELSGKNQEHVTLEAEKSKAEVETLKTTMEEMDQNLRGLQLDLVNIRSEKEDLSKELQKEQSRVSELETLNSSFENMLREKEQEKVQMQEESKAAVEMLQKELEELNEKMAALGNDQETWKVKEQSLSSQVDSLEHEKAQLLQGLDDAKSNYMILQSSVNDLIQEVEDGKQKLEKKDEEISILESQTRDQEQLVSKLSQMEGEQQLWKKQKADLENLMVELEQKIQVLQSKNDALQDTLEALQNSYRNLEKELELTNLEKTSFVEKVNTMTVKETELQKEMHAMIQKTAELKEEFSGEKNRLTEELNLMLEEVKSSKGQLNELMLENSELKKSLDCVHKDHMEEQGKMRGEIAEYQLRLQEAENKHQALLLDTNKQHEMEIQTYREKLTSKEECLSSQKVEIDLLKSSKEELNNSLKATTEILEELKKTKMENLKHADKLKKENDRAQSKIKLLMKSCKQLEEEKVMLQKELSHLEAAQEKQRADTVVDANVDELITEMKELKESLEEKTKEADEYLDKYCSLLISHEKLEKAKEMLETQVARLSSQQSKLNLRSSPLVNSVAPGPSPVPSATEKKLPSGQNKSSGKRQRSSGIREDGGETTPSTPETFSKKSRKAIKSGTHPPEDAEDAEFEPEGLPEVVKKGFADIPTGKTSPYILRRTTMATRTSPRLAAQKLAASPLSLDKENLTETSKPTAGGSRSQKVKVSQQSPVDSGTTFRDPTARSLSISNLPERSPAGSPREGLRAKRGHHAPSPEASLQSKGSENCRVQ

SEQ ID NO: 837 - protein, 569 aa, Solanum lycopersicum
MAIFTKPKLLFIFFLILSLVLVSQCYDQNPRGYQDPQEKLRECQQRCERQQPGQQKQLCKQRCEQQYRKEQQQQHGGETGEDDLGNRGPDKSYKRLQECQRRCQSEQQGQRLQECQQRCQQEYQREKGQHQGETNPQWEQQEKSNNPYLFESQRFRSRFRASHGDFRILERFNQRSQLLKGIEKYRVAILELEPQSFVLPHHCDGEAIYVVVKGQGVINIAEQDNKNSFNLQKGDVIRLFAGSNVYLLNKDNNEKLFVYVLAKSVNAPGNLQEYFSAGGQNPESFYRAFSSDILESAFNNPRDKLERLFGQHKEGIIIKASEEQIRAISEHASRSTQQTRGRTQGPFNLMKERPVFESRFGQFFEARPERYEQLRDLDAAVGFMNINQGGMVLPYYNTKSTKLVMVIEGNARFEMACPHLGRQSQSPWSRGQGREQEREQEQEQEEGDVHYQKIRGNLNVGDVLVIPAGHPITFVATGNSNLRIVGFGVDAENNKKNFLAGKQNIWRNIDREAKELSFSMPGREVEEIFQRQDQSYFVAGPEHRQQRERGEEGRRGQDQYLSSILDFVF

SEQ ID NO: 838 - protein, 532 aa, Saccharomyces cerevisiae
  source: /note="strain ATCC 204508 / S288c"
MLLQAFLFLLAGFAAKISASMTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 839 - protein, 532 aa, Saccharomyces cerevisiae; identical to SEQ ID NO: 838
  source: /note="strain ATCC 204508 / S288c"

SEQ ID NO: 840 - protein, 884 aa, Agaricus bisporus
  source: /note="var. bisporus"
  source: /note="strain H97 / ATCC MYA-4626 / FGSC 10389"
MRALLLSILPVVLAQTSSSLSDVVTSTLSASSAPVSAPLSSLTSTLTASISSSVVSSATSISQPLSSSASVSSLSTSSAISSASSNATSSAASTPATAPGSTVTEPIIKPPVTPTTFTPFPTPSDEPIPGVFEVTDPRKPPAVGSPIIPDFGPAWDAAYAKARSKIASFSLEEKVNVTTGVGWMGGRCVGNIPSVGDEWPGLCLEDSPLGVRNADFVTYPINAATTFNRKLIRARGLAMGQEHVGKGVHVALGPMMNMGRVAAGGRNWEGFGADPFLAGEAAYETILGMQQAGVQACAKHLVDNEQEHKRTTSSSDVDDRTQHEIYTHPFLRSIMAGAASIMCSYNLINGTYACENDKVMNGIVKAEYGFRGYIMSDWAATESTMSAATGLDMTMPGDINFNSGDSYFGGNLTAFVRNGTIPEARVDDMATRIVAAWYFLRQDAPSFPTVNFDAFRVDDDSVNEHIDVQEDHDKVVREVGAASIVLLKNENDALPLKKPRSLVLIGSDAGPGRAGPNQFSDQGGLDGVLAMGWGSGTANMTYLVTPLDAIQRRARKDHTSVFWFLDDFDLPAAGNVARKKSAAIVFIASDSGEEYITVDGNQGDRNNLTAWHGGDALVEAVAAQNENTIVVIHSVGPLILEPWINHPNVTAVLWAGAPGQEAGNSLTDVLYGDWNPSGRLPYTIAKRIEDYSAQVIPGDGVRDILSIPYDDRLQIDYRHFDANGIEPRFEFGFGLSYTKFDYSKISIKKVHVKGREVDAAREWDQGHASPQVEGGSIASWLHRPLYEVSFNVKNTGRVLGAESPQLYINFPESAGEPPSVLRGFDSVPIRPGETTNVKMTLSRYDLSIWDVNAQGWRRPEGTFGVTVGASSRDKRLEGTIPGSR

SEQ ID NO: 841 - protein, 885 aa, Oryza sativa
  source: /note="subsp. japonica"
MMGSPPAPPARRLGALAVFLLALFLAAPWGVDCGYNVASVAGSKNRLRARLELAGGGGGAAPELGPDVRRLSLTASLETDSRLHVRITDADHPRWEVPQDVIPRPSPDSFLAATRPGGGRVLSTATSDLTFAIHTSPFRFTVTRRSTGDVLFDTTPNLVFKDRYLELTSSLPPPGRASLYGLGEQTKRTFRLQRNDTFTLWNSDIAAGNVDLNLYGSHPFYMDVRSGGGGGGGAAHGVLLLNSNGMDVIYGGSYVTYKVIGGVLDFYFFAGPSPLAVVDQYTQLIGRPAPMPYWSFGFHQCRYGYKNVADLEGVVAGYAKARIPLEVMWTDIDYMDAYKDFTLDPVNFPADRMRPFVDRLHRNGQKFVVIIDPGINVNTTYGTFVRGMKQDIFLKWNGSNYLGVVWPGNVYFPDFLNPRAAEFWAREIAAFRRTLPVDGLWVDMNEISNFVDPPPLNAIDDPPYRINNSGVRRPINNKTVPASAVHYGGVAEYDAHNLFGFLEARATHDALLRDTGRRPFVLSRSTFVGSGRYTAHWTGDNAATWEDLHYSINTMLSFGLFGIPMIGADICGFGGNTTEELCSRWIQLGAFYPFSRDHSAIGTVRRELYLWESVARSARKALGLRYRLLPYLYTLMYEAHTTGAPIARPLFFSYPGDVETYGIDRQFLLGRGVLVSPVLEPGATTVTAYFPAGRWFSLYDFSLAVATKTGKRVTLPAPADTVNVHVAGGNILTLQQPALTSSRVRQSVVHLLVALADDGTATGDLFLDDGESPEMAGPRSRWSQIKFSGATESGGGVVRVRSHVVHDSYAPSRTMAIGKVVLMGLRSAAPPKGFAVYANGVQVNASTAVGGAAGSPEKGALGVAHVSGLTLVVGQEFDLKVVMTY

SEQ ID NO: 842 - protein, 419 aa, Agaricus bisporus
  source: /note="var. bisporus"
  source: /note="strain H97 / ATCC MYA-4626 / FGSC 10389"
MLSSRALLFAVVGLVLSPLSLCITPSFPYGQRKVRGVNLGGWLVLEPWITPSIFDNTGDSRVIDEWTFGQFVDRSTATNVLRNHWNTWITEEDFARIAAAGLNHVRLPIGYWAFEVAAGEPYIQGQLPFLEKAVTWAQNHNLKLIIDLHGAPGSQNGFDNSGQKKSFPEWHTRADYVDRTNAIIKTIASTYKNMADVVAVIAPLNEPAGFDGAQVLSVTKQYWFDSYGNIRFPFGTSQQSNTMVMIHDAFQSLSFWNGFMQPPDFDGVLLDTHRYQMFSDAENHKSEQQHIQSACSSGPGLASAPLWAIVGEWTPAANDCAKYLNGRGVGSRYDGSFPGSSRVGSCTGLTGKASTFSSSYKRFLRQFWEAQATAYEQGQGWLQWTWKTEITDEWSYKAGLDNGWIPQNPTERQFPGICG

SEQ ID NO: 843 - protein, 448 aa, Saccharomyces cerevisiae
  source: /note="strain ATCC 204508 / S288c"
MLSLKTLLCTLLTVSSVLATPVPARDPSSIQFVHEENKKRYYDYDHGSLGEPIRGVNIGGWLLLEPYITPSLFEAFRTNDDNDEGIPVDEYHFCQYLGKDLAKSRLQSHWSTFYQEQDFANIASQGFNLVRIPIGYWAFQTLDDDPYVSGLQESYLDQAIGWARNNSLKVWVDLHGAAGSQNGFDNSGLRDSYKFLEDSNLAVTTNVLNYILKKYSAEEYLDTVIGIELINEPLGPVLDMDKMKNDYLAPAYEYLRNNIKSDQVIIIHDAFQPYNYWDDFMTENDGYWGVTIDHHHYQVFASDQLERSIDEHIKVACEWGTGVLNESHWTVCGEFAAALTDCTKWLNSVGFGARYDGSWVNGDQTSSYIGSCANNDDIAYWSDERKENTRRYVEAQLDAFEMRGGWIIWCYKTESSLEWDAQRLMFNGLFPQPLTDRKYPNQCGTISN

SEQ ID NO: 844 - protein, 567 aa, Bos taurus
  MOD_RES (86)..(86): Any amino acid
MGWCGRGSGPPPSRLLMLLSLLLAVRGAGAAPRSALYSSSDPLTLLRADTVRSTVLGSSSAWAVEFFASWCGHCIAFAPTWKALAXVISDWRPALNLAALDCAEETNSAVCRDFNIPGFPTVRFFKAFSKTGSGTTLSVAGADVQTLRERLIDALESHSDTWPPACPPLEPARLEEITGFFARNNEEYLALIFEKEGSYLGREVTLDLSQHQGIAVRRVLNTERDVVNRFGVTNFPSCYLLSRNGSFSRVPALTESRSFYTTYLRKFSGSTRGAVQTTAAPATTSAVAPTVWKVADRSKIYMADLESALHYILRIEVGKFSVLEGQRLVALKKFMAVLAKYFRGRPLVQNFLHSMNDWLKKQQRKKIPYGFFKNALDSRKEGTVIAEKVNWVGCQGSEPHFRGFPCSLWILFHFLTVQAAQEGVDHPQERAKAQEVLQAIRGYVRFFFGCRECAGHFEQMASGSMHRVGSLNSAVLWFWSSHNKVNARLAGAPSEDPQFPKVQWPPRELCSACHNELRGTPVWDLDNILKFLKTHFSPSNIVLDFPSAGPGPWRGAERMAVIPKQLI

SEQ ID NO: 845 - protein, 712 aa, Bos taurus
MWVCLQLPVFLASVTLFEVAASDTIAQAASTTTISDAVSKVKIQVNKAFLDSRTRLKTTLSSEAPTTQQLSEYFKHAKGRTRTAIRNGQVWEESLKRLRRDTTLTNVTDPSLDLTALSWEVGCGAPVPLVKCDENSPYRTITGDCNNRRSPALGAANRALARWLPAEYEDGLALPFGWTQRKTRNGFRVPLAREVSNKIVGYLDEEGVLDQNRSLLFMQWGQIVDHDLDFAPETELGSNEHSKTQCEEYCIQGDNCFPIMFPKNDPKLKTQGKCMPFFRAGFVCPTPPYQSLAREQINAVTSFLDASLVYGSEPSLASRLRNLSSPLGLMAVNQEAWDHGLAYLPFNNKKPSPCEFINTTARVPCFLAGDFRASEQILLATAHTLLLREHNRLARELKKLNPHWNGEKLYQEARKILGAFIQIITFRDYLPIVLGSEMQKWIPPYQGYNNSVDPRISNVFTFAFRFGHMEVPSTVSRLDENYQPWGPEAELPLHTLFFNTWRIIKDGGIDPLVRGLLAKKSKLMNQDKMVTSELRNKLFQPTHKIHGFDLAAINLQRCRDHGMPGYNSWRGFCGLSQPKTLKGLQTVLKNKILAKKLMDLYKTPDNIDIWIGGNAEPMVERGRVGPLLACLLGRQFQQIRDGDRFWWENPGVFTEKQRDSLQKVSFSRLICDNTHITKVPLHAFQANNYPHDFVDCSTVDKLDLSPWASREN

SEQ ID NO: 846 - protein, 441 aa, Oryza sativa
  source: /note="subsp. japonica"
MRPAVAAALLLVAAAVAASPVSALYSAGSPVLQFNPNNFKSKVLNSNGVVLVEFFAPWCGHCQQLTPIWEKAAGVLKGVATVAALDADAHKELAQEYGIRGFPTIKVFVPGKPPVDYQGARDVKPIVEFALSQVKALLRDRLNGKTSAGSGGKKSGGSSEKTEPSASIELNSQNFDKLVTKSKDLWIVEFFAPWCGHCKKLAPEWKKAAKNLKGQVKLGHVDCDAEKSLMSKYKVEGFPTILVFGADKESPFPYQGARVASAIESFALEQLEANAAPPEVSELTGPDAMEEKCASAAICFVSFLPDILDSKAEGRNKYLELLLSVAEKFKKSPYSFVWTAAGKQADLEKQVGVGGYGYPAMVALNVKKGAYAPLRSAFQLDEITEFVKEAGRGGKGNLPLDGTPTIVQSEPWDGKDGEVIEEDEFSLEELMADNSPVNDEL

SEQ ID NO: 847 - protein, 427 aa, Bos taurus
MPCPRLLAALFCSSGLFAASGDFCDSSLCLHGGTCLLNEDRTPPFYCLCPEGFTGLLCNETEHGPCFPNPCHNDAECQVTDDSHRGDVFIQYICKCPLGYVGIHCETTCTSPLGMQTGAIADSQISASSMHLGFMGLQRWAPELARLHQTGIVNAWTSGNYDKNPWIQVNLMRKMWVTGVVTQGASRAGSAEYLKTFKVAYSTDGRQFQFIQVAGRSGDKIFIGNVNNSGLKINLFDTPLETQYVRLVPIICHRGCTLRFELLGCELNGCTEPLGLKDNTIPNKQITASSYYKTWGLSAFSWFPYYARLDNQGKFNAWTAQTNSASEWLQIDLGSQKRVTGIITQGARDFGHIQYVAAYRVAYGDDGVTWTEYKDPGASESKIFPGNMDNNSHKKNIFETPFQARFVRIQPVAWHNRITLRVELLGC

SEQ ID NO: 848 - protein, 443 aa, Bos taurus
MSWSSHPPSVIFYILSLLSSACLAYVATRDNCCILDERFGSYCPTTCGIADFLNNYQTSVDKDLRTLEGILYQVENKTSEARELVKAIQISYNPDQPSKPNNIESATKNSKSMMEEIMKYETLISTHESTIRFLQEIYNSNSQKIVNLRDKVVQLEANCQEPCQDTVKIHDVTGRDCQDVANKGAKESGLYFIRPLKAKQQFLVYCEIDGSGNGWTVFQKRLDGSLDFKKNWIQYKEGFGHLSPTGNTEFWLGNEKIHLISTQSTIPYVLRIQLEDWNGRTSTADYASFKVTGENDKYRLTYAYFIGGDAGDAFDGYDFGDDSSDKFFTSHNGMQFSTWDSDNDKYDGNCAEQDGSGWWMNKCHAGHLNGVYYQGGTYSKTSTPNGYDNGIIWATWKSRWYSMKKTTMKIIPLNRLAIGEGQQHQLGGAKQVGVEHHVEIEYD

SEQ ID NO: 849 - protein, 313 aa, Saccharomyces cerevisiae
  source: /note="strain ATCC 204508 / S288c"
MRFSTTLATAATALFFTASQVSAIGELAFNLGVKNNDGTCKSTSDYETELQALKSYTSTVKVYAASDCNTLQNLGPAAEAEGFTIFVGVWPTDDSHYAAEKAALQTYLPKIKESTVAGFLVGSEALYRNDLTASQLSDKINDVRSVVADISDSDGKSYSGKQVGTVDSWNVLVAGYNSAVIEASDFVMANAFSYWQGQTMQNASYSFFDDIMQALQVIQSTKGSTDITFWVGETGWPTDGTNFESSYPSVDNAKQFWKEGICSMRAWGVNVIVFEAFDEDWKPNTSGTSDVEKHWGVFTSSDNLKYSLDCDFS

SEQ ID NO: 850 - protein, 386 aa, Saccharomyces cerevisiae
  source: /note="strain ATCC 204508 / S288c"
MRLSNLIASASLLSAATLAAPANHEHKDKRAVVTTTVQKQTTIIVNGAASTPVAALEENAVVNSAPAAATSTTSSAASVATAAASSSENNSQVSAAASPASSSAATSTQSSSSSQASSSSSSGEDVSSFASGVRGITYTPYESSGACKSASEVASDLAQLTDFPVIRLYGTDCNQVENVFKAKASNQKVFLGIYYVDQIQDGVNTIKSAVESYGSWDDVTTVSIGNELVNGNQATPSQVGQYIDSGRSALKAAGYTGPVVSVDTFIAVINNPELCDYSDYMAVNAHAYFDKNTVAQDSGKWLLEQIQRVWTACDGKKNVVITESGWPSKGETYGVAVPSKENQKDAVSAITSSCGADTFLFTAFNDYWKADGAYGVEKYWGILSNE

SEQ ID NO: 851 - protein, 229 aa, Zea mays
MAAARRLSLPLVLLVVLAVAGRAAAQDYDFFYLVLQWPGAYCDTKQSCCYPKSGKPAADFGIHGLWPNRDDGTYPQNCSPDNAFNPSKVSDLLSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAF

SEQ ID NO: 852 - protein, 256 aa, Vitis vinifera
MAKNLLHALAMVRVICYFFSNVNAFTASGWTKAHATFYGGSDASGTMGGACGYGNLYSTGYGTRTAALSTALFNDGASCGQCYKIICDYQSDSQWCKKGASVTITATNFCPPNYALPSNNGGWCNPPLQHFDMAQPAWEKIGIYRGGIVPVLFQRVPCKKHGGVRFSVNGRDYFELVLISNVAGAGSIQSVSIKGSRTSWMAMSRNWGANWQSNAYLNGQSLSFKVTTTDGVTQEFDNVVPSDWGFGQTFSSSVQF

SEQ ID NO: 853 - protein, 118 aa, Bos taurus
MARFVALVLLGLLSLSGLDAIQRPPKIQVYSRHPPEDGKPNYLNCYVYGFHPPQIEIDLLKNGEKIKSEQSDLSFSKDWSFYLLSHAEFTPNSKDQYSCRVKHVTLEQPRIVKWDRDL

SEQ ID NO: 854 - protein, 147 aa, Sus scrofa
MAASSAQPTVLVMTALALLLLLCLGPGGTNGNKLKLMLQKRKAPAPSETPVAVRESKAKEFLSSLRRQKRQLWDRTRPEVQQWYQHFLYLGFDEAKFEDDITYWLNRDRNGDDDYDHYQRHYDEDAAIGPRSPHSFRYGASVNYDDY

SEQ ID NO: 855 - protein, 202 aa, Bos taurus
MALLWALAVLSHLPLLDAQSPECANLMTVAPITNATMDLLSGKWFYIGSAFRNPEYNKSARAIQAAFFYLEPRHAEDKLITREYQTIEDKCVYNCSFIKIYRQNGTLSKVESDREHFVDLLLSKHFRTFMLAASWNGTKNVGVSFYADKPEVTQEQKKEFLDVIKCIGIQESEIIYTDEKKDACGPLEKQHEEERKKETEAS

SEQ ID NO: 856 - protein, 234 aa, Bos taurus
MRTHGLTLLSLLLLAVPMLLVEAKKEGRNRRGSKASADESLALGKPGKEPRSQPTNYPIKGKFVTPDHADCRWAVTKQEEGIVLKVECTQRDNTFSCFFTGNPTSCLELHKNNAYWKQIGRNLRSQKVICGDAKSVLKTRVCRKKFPESNLKLVNSTLIRIKKPSQELMEPSPMDTVEVTTSSSPEKTQTMATKDPQCEEEDLKNQRKAALEYCGETWGSLCNFFLSMVQGSSC

SEQ ID NO: 857 - protein, 299 aa, Bos taurus
MVPVLLALLLLLGPAVSEETQAGNYSLSFLYTGLSKPREGFPSFQAVAYLNDQPFFHYNSEGRRAEPLAPWSQVEGMEDWEKESALQRAREDIFMETLSDIMDYYKDREGSHTFQGAFGCELRNNESSGAFWGYAYDGQDFIKFDKEIPAWVPLDPAAQNTKRKWEAEAVYVQRAKAYLEEECPGMLRRYLPYSRTHLDRQESPSVSVTGHAAPGHKRTLKCLAYDFYPRSIGLHWTRAGDAQEAESGGDVLPSGNGTYQSWVVVGVPPEDQAPYSCHVEHRSLTRPLTVPWDPRQQAE

SEQ ID NO: 858 - protein, 295 aa, Meleagris gallopavo
MKTLQAAFFLVAFVPLVKPAPTIQQDSSELNKYDTDIAMGSLIQQDYEMLSKDIIKTKDGTNVSLDTGLRLQGDDSELSARPTKDTNLPTCLLCVCLSGSVYCEEIDIEAVPPLPKETAYLYARFNKIKRIAVSDFADITTLRRIDFSGNMIEEIEDGAFSKLLLLEELSLAENRLVKLPVLPPKLTTFNANQNRIKSRGIKNNAFKKLTNLAYLYLGHNALESVPLNLPESLRILHLQHNNITTINDDTFCKSNNTRYIRTRMDEIRMEGNPILLAKHVNAFSCLRTLPVGTYY

SEQ ID NO: 859 - protein, 153 aa, Bos taurus
MKFLCVLLLASLAATSLAILNKPEDETHLEAQPTDASAQFIRNLQISNEDLSKEPSISREDLISKEQIVIRSSRQPQSQNPKLPLSILKEKHLRNATLGSEETTEHTPSDASTTEGKLMELGHKIMRNLENTVKETIKYLKSLFSHAFEVVKT

SEQ ID NO: 860 - protein, 339 aa, Bos taurus; identical to SEQ ID NO: 727

SEQ ID NO: 861 - protein, 375 aa, Bos taurus; identical to SEQ ID NO: 763

SEQ ID NO: 862 - protein, 375 aa, Bos taurus
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 863 - protein, 533 aa, Glycine max
MQIFVKTLTGKTITLEVESSDTIDNVKSKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 864 - protein, 149 aa, Solanum lycopersicum
MAEQLTEEQIAEFKEAFSLFDKDGDGCITTKELGTVMRSLGQNPTEAELQDMISEVDADQNGTIDFPEFLNLMARKMKDTDSEEELKEAFKVFDKDQNGFISAAELRHVMTNLGEKLTDEEVDEMIREADIDGDGQVNYEEFVRMMLAK

SEQ ID NO: 865 - protein, 154 aa, Oryza sativa; identical to SEQ ID NO: 103
  source: /note="subsp. japonica"

SEQ ID NO: 866 - protein, 166 aa, Oryza sativa
  source: /note="subsp. japonica"
MAEVEVRVRQEQVAEFRETFAFFDKDGDGCITLEELDTVVRSLGQTPTREELAEMIRDVDVDGNGTIEFAEFLALMARKASRGGENGGGGDDSGDAADEELREAFKVFDKDQDGLISAAELRHVMISLGEKLTDEEVEQMIREADLDGDGQVNFDEFVRMMMLSDQ

SEQ ID NO: 867 - protein, 151 aa, Arabidopsis thaliana
MEETALTKDQITEFKEAFCLFDKDGDGCITVEELATVIRSLDQNPTEQELHDIITEIDSDSNGTIEFAEFLNLMAKKLQESDAEEELKEAFKVFDKDQNGYISASELSHVMINLGEKLTDEEVEQMIKEADLDGDGQVNYDEFVKMMINID

SEQ ID NO: 868 - protein, 151 aa, Arabidopsis thaliana
MADAFTDEQIQEFYEAFCLIDKDSDGFITKEKLTKVMKSMGKNPKAEQLQQMMSDVDIFGNGGITFDDFLYIMAQNTSQESASDELIEVFRVFDRDGDGLISQLELGEGMKDMGMKITAEEAEHMVREADLDGDGFLSFHEFSKMMIAASY

SEQ ID NO: 869 - protein, 124 aa, Solanum tuberosum
GCITTKELGTVMRSLGQNPTEAELQDMINEVDADGNGTIDFPEFLNLMARKIKDTDFEEELKEAFRVFDKDRNGFISAAELPHVMTNLGEKLTDEEVDEIIREADVDCDGQINYDEFVKVMMAK

SEQ ID NO: 870 - protein, 170 aa, Oryza sativa
  source: /note="subsp. japonica"
MESHLNEQQISDFRDAFSLFDKNNDGCISREELATVLTRLGMAPSQEDLQDMIVAVDEDGNGTIEFDEFLAIMKKKLYENDKGDDEEELRKAFRIFDKDDNGFISRNELSMVMASLGEEMTEDEIDDMMKAADSNNDGQVDYEEFKRVMMSTWNITEIFKPHVTIWRYKP

SEQ ID NO: 871 - protein, 217 aa, Lactobacillus gasseri
  source: /note="strain ATCC 33323 / DSM 20243"
MINLILLGLPGAGKGTASESIVDKYHLAHISTGDMFREAMANETPVGLEAKSYIDKGDLVPDEVTAKLVEERLKQPDTKNGFILDGFPRTTVQAELLEGITKRLEKPLTNVIAIDVDEDVLIKRLSARYICKNCGATYNKISNPTKVEGTCDRCGGHEFFQREDDKPEVVKNRLEVNKKMNTPLRDFYEEKGILSTVNGEQTPEKVFEDIDKILSKD

SEQ ID NO: 872 - protein, 194 aa, Sus scrofa
MEEKLKKSKIIFVVGGPGSGKGTQCEKIVQKYGYTHLSTGDLLRAEVSSGSARGKMLSEIMEKGQLVPLETVLDMLRDAMVAKVDTSKGFLIDGYPREVKQGEEFERKIGQPTLLLYVDAGPETMTKRLLKRGETSGRVDDNEETIKKRLETYYKATEPVIAFYEKRGIVRKVNAEGSVDDVFSQVCTHLDTLK

SEQ ID NO: 873 - protein, 194 aa, Gallus gallus
MSTEKLKHHKIIFVVGGPGSGKGTQCEKIVHKYGYTHLSTGDLLRAEVSSGSERGKKLQAIMEKGELVPLDTVLDMLRDAMLAKADTSKGFLIDGYPREVKQGEEFEKKIAPPTLLLYVDAGKETMVKRLLKRGETSGRVDDNEETIKKRLETYYKATEPVIAFYKGRGIVRQLNAEGTVDEVFQQVCSYLDKL

SEQ ID NO: 874 - protein, 172 aa, Bos taurus
MLLPNILLTGTPGVGKTTLGKELASRSGLKYINVGDLAREGQLYDGYDEEYDCPILDEDRVVDELENQMSEGGVIVDYHGCDFFPERWFHIVFVLKTDNSILYKRLENRGYNEKKLKDNIQCEIFQVLHEEALASYKEEIVHQLPSNKPEDLEDNINQILKWIEHWVKDHSS

SEQ ID NO: 875 - protein, 172 aa, Oryctolagus cuniculus
MRLPNILLTGTPGVGKTTLGKELASRSGLKYVNVGDLAREGELYDGFDEEYNCPILDEDRVIDELDTQMRDGGVIVDYHGCDFFPERWFHIVFVLRTETSVLYKRLETRGYSEKKLNDNIQCEIFQVLYEEAMESYKEEIVHQLPSNKPEELEENISQILKWIEQWIKDHNS

SEQ ID NO: 876 - protein, 175 aa, Schizosaccharomyces pombe
  source: /note="strain 972 / ATCC 24843"
MGNEERELPNIIICGTPGTGKTTLAEQVAETTELENICIGDVVKENHLHFGFDEKWKTYDVDEDKVLDYLEPKLLKGGCIIDWHTCGLFSEELIDLVVVLRTDHSKLWERLESRGYSLEKIQENNEAEIMQICLEEARESFDPKIVVELPSESIEEMESNLSRITQWVTNWKKNH

SEQ ID NO: 877 - protein, 197 aa, Saccharomyces cerevisiae
  source: /note="strain ATCC 204508 / S288c"
MEARRYGPNIIVTGTPGCGKSSTCEFLKNKLKDYKYYNISDFAKDNDCFEGYDEGRKSHIVDEDKLLDMLEPLLRQGNSIVDWHVNDVFPERLIDLVVVLRCDNSNLYSRLHARGYHDSKIEENLDAEIMGVVKQDAVESYEPHIVVELQSDTKEDMVSNVSRIVAWEKMWLEQHPDGVTNEYQGPRSDDEDDEDSE

SEQ ID NO: 878 - protein, 196 aa, Bos taurus
MKPQVVFVLGGPGAGKGTQCARIVEKYGYTHLSAGELLRDERKNPDSQYGELIEKYIKDGKIVPVEITISLLRREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVRKIDASKSVDEVFDEVVKIFDKEG

SEQ ID NO: 879 - protein, 196 aa, Gallus gallus
MKPVVVFVLGGPGAGKGTQCARIVEKYGYTHLSAGDLLRDERKRPGSQYGELIENYIKEGEIVPVEITISLLKRAMDQTMAANSQKNKFLIDGFPRNEDNLQGWNKTMDGKADVSFVLFFDCDNEICIGRCLERGKSSGRSDDNRESLEKRIHTYLQSTRPIIDLYERMGKVRRVDASKSVDEVFEKVVQIFDKEG

SEQ ID NO: 880 - protein, 78 aa, Capra hircus
MDCCTESACSKPDDDILDIPLDDPGANAAAAKIQASFRGHMARKKIKSGERGRKGPGPGGPGGAGGARGGAGGGPSGD

SEQ ID NO: 881 - protein, 87 aa, Oryza sativa
  source: /note="subsp. japonica"
MGCDDKCGCAVPCPGGTGCRCASSARSGGGDHTTCSCGDHCGCNPCRCGRESQPTGRENRRAGCSCGDSCTCASCGSTTTTAPAATT

SEQ ID NO: 882 - protein, 93 aa, Triticum aestivum
MASGQQERSQLDRKAREGETVVPGGTGGKSLEAHENLAEGRSRGGQTRREQMGEEGYSEMGRKGGLSTNDESGGERAAREGIDIDESKFKTKS

SEQ ID NO: 883 - protein, 188 aa, Oryza sativa
  source: /note="subsp. japonica"
MARRGTEAFPDLGAQCDREDCNQLDFLPFDCDGCGKTFCAEHRTYRDHGCARAADQGRTVVVCEACGDAIERRAGDGGGDDAAVLEAHARSRRCDPARKRKPRCPVPRCKETLTFSNTSGCKGCGQKVCLKHRFPADHACAGAGAGAASKAAGAAAAARSAGQCGRDAQKKEGGGWKLPQSVRNMKIF

SEQ ID NO: 884 - protein, 216 aa, Oryza sativa
  source: /note="subsp. japonica"
MDRKDKARKNFSSSSSSSAASMAALAAAAAAGDGGAALPSPMEEDKKPRLVASSLAPVAGGGGGGSSSSAAVAAGASSSSSSSSVAAAARRGAGRAGGGAPSGGGGGPRCQVERCGVDLSEAGRYNRRHKVCQTHSKEPVVLVAGLRQRFCQQCSRFHELTEFDDAKRSCRRRLAGHNERRRKSAADTAHGENCRHADQDAGRSHQGTGNPPFQIR

SEQ ID NO: 885 - protein, 257 aa, Bos taurus
MADKMDMSLDDIIKLNRSQRGGRGGGRGRGRAGSQGGRGGGAQAAARVNRGGGPIRNRPAIARGAAGGGGRNRPAPYSRPKQLPDKWQHDLFDSGFGGGAGVETGGKLLVSNLDFGVSDADIQELFAEFGTLKKAAVHYDRSGRSLGTADVHFERKADALKAMKQYNGVPLDGRPMNIQLVTSQIDTQRRPAQSVNRGGMTRNRGSGGFGGGGGTRRGTRGGSRGRGRGTGRSSKQQLSAEELDAQLDAYNARMDTS

SEQ ID NO: 886 - protein, 116 aa, Sus scrofa
TRTNAIDVLERDLRNLRVWDKHQALQHLVEMLHELEKKKQLKHKDIFFIDRNKKMNQMFLKEIDRVYKVDIQMIDFKDKEKTKKAINQFVADKIDKKAKNLITHLDPQTLLCLVNY

SEQ ID NO: 887 - protein, 76 aa, Saccharomyces cerevisiae
  source: /note="strain ATCC 204508 / S288c"
FENDQNITDPTAWEKVVKDQVDLRKRKHLEENERRHEDAIKRRKEAVNMNVEKPTVYHCKVFQFKNLQNPKIRFKL

SEQ ID NO: 888 - protein, 76 aa, Saccharomyces cerevisiae
  source: /note="strain ATCC 204508 / S288c"
AETDYVDPKRLAMVIIKEFVDDLKKDHIAIDWEDEEKYEDEDEEKILDNTENYDDTELRQLFQENDDDDDDDDEVD

SEQ ID NO: 889 - protein, 96 aa, Bos taurus
LARMRPVDPIEYLALWIYKYKKNVTMEKQRQEEMAQLEHEREVALMEQEMMERLRAEELLFQQQQLEFQLELEEQEKERQRIEELERAQEQFEKEL

SEQ ID NO: 890 - protein, 146 aa, Bos taurus
VFNQYPKFIVDYQTQERERIRNDELDYLRERQAVEEMQAEVDQQRVEDEAWYQKQELLRRAEETRREILLQEEEKMIQQRQRLAAVRRELKVKEMHLQDAARRRLLQLQQDQREMELRRLDDEIERKVHMRDREIAATAKDLEMRH

SEQ ID NO: 891 - protein, 126 aa, Bos taurus
LNKEEQFQEDALKERIAQAEADIWAKADERQRQAVKKALEEANDMYKMQIQFLKEEHEKELKEMATRTKMQLHKNLEEELQREHLAAEQRMVHRIQRIMMECHREKVQAVQEAREQERLMAQEEIQ

SEQ ID NO: 892 - protein, 81 aa, Saccharomyces cerevisiae
  source: /note="strain ATCC 204508 / S288c"
RIAYNTNLHMMLPPNHRKTWYALDDFRKDNLKTDEKRINKLFDLDPFKTMVEDRKLKAQREKEQVAQNNQAQKEQVARTIL

SEQ ID NO: 893 - protein, 71 aa, Saccharomyces cerevisiae
  source: /note="strain ATCC 204508 / S288c"
KVPEHDQQLNTFEKRYDELFDAQFNKLEFFKIRMKKLKKNKPIEKKNYKIWCLEKEDLKDLVWDPLKRICN

SEQ ID NO: 894 - protein, 1938 aa, Bos taurus
MSSDQEMAVFGEAAPYLRKSEKERIEAQNKPFDAKTSVFVADPKESFVKATVQSREGGKVTAKTEAGATVTVKEDQVFPMNPPKFDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEPTSGKMQGTLEDQIISANPLLEAFGNAKTVRNDNSSRFGKFIRIHFGTTGKLASADIETYLLEKSRVTFQLKAERSYHIFYQIMSNKKPELIEMLLITTNPYDYAYVSQGEITVPSIDDQEELMATDSAIEILGFTSDERVSIYKLTGAVMHYGNLKFKQKQREEQAEPDGTEVADKAAYLQGLNSADLLKALCYPRVKVGNEFVTKGQTVEQVYNAVGALAKAVYDKMFLWMVARINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDMSFKNKLYEQHLGKSNNFQKPKPAKGKAEAHFSLIHYAGTVDYNITGWLDKNKDPLNETVVGLYQKSSVKTLALLFSGPASGEAEGGPKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDVDHTQYKFGHTKVFFKAGLLGLLEEMRDEKLAQLITRTQARCRGFLARVEYQKMVERRESIFCIQYNVRAFMNVKHWPWMKLYFKIKPLLKSAETEKEMANMKEEFEKTKEELAKSEAKRKELEEKMVTLTQEKNDLQLQVQSEADALADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESTMDIENDKQQLDEKLKKKEFEMSNLQSKIEDEQALAMQLQKKIKELQARIEELEEEIEAERASRAKAEKQRSDLSRELEEISERLEEAGGATSAQIEMNKKREAEFQKMRRDLEEATLQHEATAAALRKKHADSVAELGEQIDNLQRVKQKLEKEKSEMKMEIDDLASNMETVSKAKGNLEKMCRALEDQLSELKTKEDEQQRLINDLTTQRARLQTESGEFSRQLDEKDALVSQLSRGKQAFTQQIEELKRQLEEEIKAKSALAHALQSARHDCDLLREQYEEEQEGKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILSEWKQKYEETHAELEASQKESRSLSTELFKIKNAYEESLDQLETLKRENKNLQQEISDLTEQIAEGGKRIHELEKVKKQVEQEKSEIQAALEEAEASLEHEEGKILRIQLELNQVKSEIDRKIAEKDEEIDQLKRNHIRIVESMQSTLDAEIRSRNDAIRLKKKMEGDLNEMEIQLNHANRMAAEALKNYRSTQAILKDTQIHLDDALRGQEDLKEQLAMVERRANLLQAEIEELRATLEQTERSRKIAEQELLDASERVQLLHTQNTSLINTKKKLETDITQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERRVKELTYQTEEDRKNILRLQDLVDKLQAKVKSYKRQAEEAEEQSNVNLSKFRKLQHELEEAEERADIAESQVNKLRVKSREVHTKIISEE

SEQ ID NO: 895 - protein, 1940 aa, Bos taurus
MSSDQEMAIFGEAAPYLRKSEKERIEAQNKPFDAKTSVFVAEPKESFVKGTIQSREGGKVTVKTEGGATLTVKEDQVFPMNPPKFDKIEDMAMMTHLHEPAVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVTFQLKAERSYHIFYQITSNRKPELIEMLLITTNPYDYPFISQGEISVASIDDQEELIATDSAIDILGFTNEEKVSIYKLTGAVMHYGNLKFKQKQREEQAEPDGTEVADKAAYLQSLNSADLLKALCYPRVKVGNEYVTKGQTVEQVTNAVGALAKAVYEKMFLWMVARINQQLDTKQPRQYFIGVLDIAGFEIFDFNSLEQLCINFTNEKLQQFFNHHMFVLEQEEYKREGIEWTFIDFGMDLAACIELIEKPMGIFSILEEECMFPKATDMSFKNKLYDQHLGKSANFQKPKVVKGKPEAHFALIHYAGVVDYNITGWLEKNKDPLNDTVVGLYQKSALKTLAFLFSGTPTGDSEASGGTKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQYIDSKKASEKLLASIDIDHTQYKFGHTKVFFKAGLLGLLEEMRDEKLAQLMTRTQARCRGFLARVEYQKMVERRESIFCIQYNIRAFMNVKHWPWMKLFFRIKPLLKSAETEKEMATMKEEFQKTKDELAKSEAKRKELEEKMVTLLKEKNDLQLQVQSEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAAALRKKHADSVAELGEQIDNLQRVKQKLEKEKSEMKMEIDDLASNVETISKAKGNLEKMCRTLEDQVNELKSKEEEQQRLINDLTTQRGRLQTESGEFSRQLDEKEALVSQLSRGKQAFTQQIEELKRQLEEEIKAKNALAHGLQSARHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKYEETHAELEAAQKEARSLGTELFKMKNAYEESLDQLETLKRENKNLQQEISDLTEQIAEGGKRMHELEKIKKQVEQEKSEIQAALEEAEASLEHEEGKILRIQLELNQVKSEIDRKIAEKDEEIDQLKRNHIRVVESMQTMLDAEIRSRNDAIRLKKKMEGDLNEMEIQLNHANRMAAEALKNYRNTQAILKDTQIHLDDALRGQEDLKEQLAMVERRANLLQAEIEELRATLEQTERSRKIAEQELLDASERVQLLHTQNTSLINTKKKLETDITQIQGEMEDILQEARNAEEKAKKAITDAAMMAEELKKEQDTSAHLERMKKNMEQTVKDLQNRLDEAEQLALKGGKKQIQKLEARVRELEGEVESEQKRNVEAVKGLRKHERRVKELTYQTEEDRKNILRLQDLVDKLQAKVKSYKRQAEEAEEQSNTNLSKFRKLQHELEEAEERADIAESQVNKLRVKSREVHTKIISEE

SEQ ID NO: 896 - protein, 7000 aa, Bos taurus
MATQAPTFTQPLQSVVVLEGSTATFEAHISGFPVPEVSWFRDGQVISTSTLPGVQISFSDGRAKLTIPAVTKANSGRYSLRATNGSGQATSTAELLVTAETAPPNFTQRLQSMTVRQGSQVRLQVRVTGIPTPVVKFYRDGAEIQSSLDFQISQEGELYSLLIAEAYPEDSGTYSVNATNSVGRATSTAELLVQGEEVVPAKRTKTIVSTAQISETRQTRIEKKIEAHFDARSIAAVEMVIDGAAGQQLPHKTPPRIPPKPKSRSPTPPSIAAKAQLARQQSPSPIRHSPSPVRHVRAPTPSPVRSVSPAGRISTSPIRSVKSPLLVRKAQTPTMPPGPEVPPPWKQEGYVASSEAEMRETTVTSATQIRTEERWEGRYGIQEQVTISGAAGAAASTTFAAGAVAAGAAEVKQEADKSAAVATVVAAVDMARVREPVISAVEQTAQRTTTTAVHIQPAHEQIRKEAEKTAVTKVVVAADKAKEQEVKARTREVITTKQEQVHVTHEQIRKETEKAFVPKVVISAAKAKEKETKITGEITTKQEQKQITQETIIQKAETAAVSMVVVETAKPTTLETILGAQEEIVTQQDQMHITHEKILKETRKTVVPKVIVATPKVKEQDVVSRTREGITTKREQVQVTHEKMRKEAEKTALSTIAVATAKAKEQETILRTREEMATRQEQIQVTHGKVGVGKKAEAVATVVAAVDQARVREPREPRHVEESYAQQTTLEYGYKEHISATKVAEQPPRPASEPQVVPKAVKPGVIHAPSETHIATTDQMGMHISSQIKKTTDLTSERLVHVDKRPRTASPHFTVSKISVPKTEHGYEASIAGSAIATLQKELSATPSAQKVTKSVKAPTVKPAEARVRAEPTPSPQFPFAETPETFKSQAGIEVKKEVGVSITGVAVREERFEALRERETKVTETARVPAPVEIPVTPPTLVSGLKNVTVIEGESVTLECHISGYPSPKVTWYREDYQIESSIDFQITFQSGIARLLIREAFAEDSGRFTCTAVNEAGTVSTSCYLAVQVSEEFEKETTAVAEKITTEEKRFVESRDVVMTDTSITEEHAGPGEPAAPFFITKPVVQKLVEGGSIVFECQVGGNPKPHVYWKKSGVPLTSGYRYKVSYNKQTGECRLVISMTFADDAGEYTIVIRNKHGETSASASLLEEADYESLMKSQQEMLYQTQVTAFVQEPKVGEIAPGYVYSEYEKEYEKEQALIRKKMAKDTVMVRTFVEDQEFHISSFEERLIKEIEYRIIKTTLEELLEEDGEEKMAVDISESEAIEAGFDLRVKNYRILEGMGVTFHCKMSGYPLPKIAWYKDGKRIKHGERYHMDFLQDGRASLRIPVVLPEDEGIYTAFASNMKGNAICSGKLYVEPAAPLSAPTYIPTPEPVSRIRSISPRSVSRSPIRMSPARMSPARMSPGRRLEETDESQLERLYKPVFVLKPTSFKCVEGQTARFDLKVVGRPMPETFWFHDGQQIVNDYTHKVVVKEDGTQSLLIVPATPSDSGEWTVVAQNRAGKSSISVILTVEAVEHQVKPVFVEKLRNLNIKEGSRLEMKVRATGNPNPDIVWLKNSEIIVPHKYPKIRIEGTKGEAALKIDSTVSQDSAWYTATAINKAGRDTTRCKVNVEVEFAEPEPERRLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYAVAYSRDSGVITCRATNKYGTDHTSATLIVKDEKSLVEESQLPEGRKGLQRIEELERMAHEGALTGVTTDQKEKQKPDIVLFPEPVRVLEGETARFRCRVTGYPQPKVNWYLNGQLIRKSKRFRVRYDGIHYLDIVDCKSYDTGEVKVTAENPEGVIDHKVKLEIQQREDFRSVLRRAPEPKPEFHVHEPGKLQFEVQKVDRPVDTTETKEIVRLKRAERITHEKVSEESEELRSKFKRRTEEGYYEAITAVELKSRKKDESYEELLRKTKEELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGVEIHTGDKYRMHSDRKVHFLSVLMIDTSDAEDYSCVLVEDENVKTTAKLIVEGAVVEFVKELQDIEVPESFSGELECIITPENIEGKWYHKGVELKSNGKYTITSRRGRQNLTVKDVTKEDQGEYSFVVDGKKTTCKLKMKPRPIAILQGLSDQKVCEGDIVQLEVKVSLENVEGVWMKDGEEVQPGDRVHIVIDKQSHMLLIEDMTKEDAGHYSFTIPSLGLSTHGRVSVYSVDVITPLKDVNVLEGTKAVLECKVSVPDVTSVKWYLNDEQIKPDDRVHAIVKGTKQRLVINRTHASDEGPYKLVVGRVETSCDLSVEKIKIIRGLRDLTCTETQNVVLEVELSHSGIDVLWNFKDKEIKPSSKYKIEAHGKIYKLTVLNMMKDDEGEYTFYAGENRTSGKLTVAGGAISKPLTDQTVAESQEAVFECEVANPDSEGEWLKDGKHLPLSKTIRSESDGRKRRLIIAATKLDDIGEYTYKVATSKTSAKLKVEAVKIKKTLKNLTVTETQDAVFTVELTHPNVKGVQWIRNGVVLESSDKYTVSVKGTVYSLRIKNCAVADESVYGFKLGKLGASARLHVETVKIIKKPKDVTALENATVSFEVSVSHDTVPVKWFHKNVEIKPSDKHRLVSERKVHKLMLQHISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLKVTPIMITSMLKDINAEEKDTITFEVTVNYEGISYKWLKNGVEIKSTDRCQMRTKKLTHSLNIRNVHFGDAAEYTFVAGKATSTATLYVEARHIEFRKHIKDIKVLEKKRAMFECEVSEPDITVQWMKDGQELQLVDRIKIQKEKYVHRLLIPSTRMSDAGKYTVVAGGNMSSANLFVEGRDVRIRSIKREVQVIEKQRAVVEFEVNEDDVDAHWYKDGIEINFQVQERHQYVVERRIHRMFISETRHSDAGEYTFVAGRNRSSVTLYVNAPEPPQILQELQPITVQSGKPARFCAVISGRPQPKISWYKEEQLLSTGFKCKFLHDGQEYTLLLIEAFPEDAAVYTCEARNDYGVATTSASLSVEVPEVVSPDQEMPVYPPAIVSPLQDAVTSEGRPAHFQCRVSGTDLKVSWYSKDKKIKPSRFFKMTQFEDTYQLEVAEAFPEDEGIYTFVASNAVGQVSSTATLRLEAPEAMLHEQIEMEMKEFSISLLSGKEERPQTSSWDLQLFDINETLEPLSEPSVYSPKFDSKKEGNAPVFIKEVSNAEISIGDVAKLFVTVTGIPTPQIQWFFNGAMLTPSADYKFVFDGNDHSLIILFTKLEDEGEYTCIASNEYGQAMCSAYLKINSEAEGHEEPESAEKSLEKLQGPCPPYFLKELKPVHCVQGLPAIFEYVVLGEPAPTVLWFKENKQLCTNVYYTIIHNPDGSGTFIVNDPQKEDGGLYVCKAENVWGGSTCAAELFVLLEDTDMTDATCKAAPTPEAPEGFPHTSVKDPAVETFDSEQEVVTFVKDAILKASLIAEEKQQFSYEHVVKTNELSSQVTLKAEQLQSTVILEHDMPTPESTRELLSISGTIHVQPIKELPPSLQLQIAQSQDTLPREDTLMCQEPESQVVLSDTEKIFPSFMSIEEISLSTVESLQTLLAEPEESYPQPLIKETPAHSYPTSVAEEVLLSKDKTVSAVDRGQRETSQKQESQNALFLNQNLAEGHAQSLQGPDVTVSRVSSEHTCTESEILMESVDQLDSAGQDFAARIEEGQSLRFPLACEEKQVLLKEEHSDTLALPLNQTTEYKKEPMAVNGVQEVQGSDFLSKESLLPGIPEEQRLNLKTQIRSALQAAVASEQLSLFSEWLRNIEQVEVKAIDFTQEPNCIMCTYLITSVKSLTEEVTVTIKGIDPQMADLKTELKEALCSICEEMNILTAEEPGIEKGATVVLQEDVSFSSSQKLEAITEPEAESKYLVSKEEISYFKVESQVKAVGTTTASAAVSDEKQDELPKPSEEKEKVSEGGTEEVGTVEIQEAEDEEDRKLGEDGPDVQTPLVDTIAEEGDIISLTSCITNAKEVNWYFESKLVPSDEKFKCLQDQNTYTLVIDKVNREEHQGEYTCEALNDNGKATTSAKLTVVKRAAPVIRRRIEPLEVALGHLAKFTCEIHSAPNVRFQWFKAGREIYESDKCSIRSANYVTTLEILRTQVVDCGEYTCKASNEYGSVSCTATLTVTEAYPPTFFSRPKSVTTFVGKAAKFLCTVTGTPVIETIWQKDGMALSPSPTCKISDVDNKHILELSNLTVHDKGVYSCKASNKFGADTCQAELDIIDKPHFIKELEPVQSAINKKIHLEGQVDEDRKVTITWSKNGQKLPPGKDYKIYFEDKIASLEIPLAKLKDSGTYVCTASNEAGSSSTSATVTIREPPSFVKKVDPSYLMLPGESARLHCRLKGSPVIQVTWFKNNKELTESNTIRMSFVNSEAVLDITDVKVEDSGTYSCEAVNDVGSDSCSAEIVVKEPPSFIKTLEPADIVRGTNALLQCEIAGTGPFEISWFKDKKQIRSSKKYRLFSQKSTVSLEIFSFNSADVGDYECVVANEVGKCGCVATHLLKVEPPTFVKKVDDFTALAGQTVTLQAAVRGSEPISVTWMKGQEIIKEDGKIKMSFANGVAVLIIPDVQISFGDKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVSGTCRLDCKIAGSLPMRVSWFKDGKEVTSSDRYRIAFVEGTASLEISRVDMSDAGNFTCRATNSVGSKDCSGALIVQEPPSFVTKPASKDILPGSAVFLKSTFQGSTPFTIRWFKGDKELVSGGNCYINKEALESSLELYSVKTTDSGTYTCKVSNVAGAVECSANLFVKEPATFVERLELSQLLKKGDTTQLACKVTGTPPIKITWFANDREIKESSKHKMSFVESTAVLRLTDIAVEDSGEYMCEAQNEAGSDHCSSILIVKESPYFTKEFKPIEVLKEYDVMLLAEVAGTPPFEITWFKDNTTLRSGRKYKTFIQDRLVSLQILKFVAADVGKYQCRVTNEVGSSTCSARVTLREPPTFVKKIESTSSLRGGTAAFQATLKGSLPITVTWLKDNEEITEDDNIRMTFENNVASLYLSGIEVKHDGKYVCQAKNDAGIQRCFAVLSVKEPATIIEEAVSIDVTQGDPATLQVKFSGTKEITAKWFKDGQELTLGQKYKISVTDTVSILKIISTEKRDSGEYTFEVQNDVGRSSCKASINVLDLIIPPSFTKKLKKMDSIKGSSIDLECIVAGSHPISIQWFKDDQEITASEKYKFSFHDNTAFLEISQLEGSDSGTYTCSATNKAGHNQCSGHLTVKEPPYFLEKPQSQDVNPNTRVQLKALVGGTAPMTIKWFKDNKELHSGAARSVWKDDTSTILELFSAKAADSGTYICQLSNDVGTATTKASLFVKEPPQFIKKPSPVLVLRNGQSTTFECQITGTPEIRVSWYLDGNEITAVEKHGISFIDGLATFQISGARVENSGTYVCEAQNDAGTASCSIELKVKEPPTFIRELKPVEVVKDSDVELECEVMGTSPFQVTWLRNNKEIRSSKKYTLTDRVSVFNLNINRCDPSDTGDYQCIVSNEGGSCSCSARVSLKEPPSFIKKIENITTVLKSSATFQSTVAGSPPISITWLKDDQILDEDDNVHISFVNNVATLQIRSVDNGHSGRYTCQAKNESGVERCYAFLLVQEPAQIIEKAKSVDVTERDPVTLECVVAGTPELKVKWLKDGKQIVPSRYFSMSFENNVASFRIQSVMKQDSGEYTFKVENDFGSSSCDAYLRVLDQNIPPSFTKKLTKMDKVLGSSIHMECKVSGSLPISAQWFKDGKEISTSAKYRLVCHENTVSLDVNNLELEDTANYTCRVSNVAGDAACSGILTVKEPPSFLVKPERQQAIPDSTVEFKAVLKGTPPFKIKWFKDDVELASGPKCFIGLEGSTSFLNLYSVDASKTGQYTCQVTNDVGSDSCTTTLLVTEPPKFVKKLEATKIVKAGDSARLECKITGSPDIRVVWYRNEHELPASDKYRMAFIDSVAVLQMNYLGTEDTGDFICEAQNPAGSTSCSTKVIVKEPPVFSSFPPVVETLKNAEVSIECELSGTPPFEVVWYKDKRQLRSSKKYKIASKNFHASIHILNVDTLDIGEYHCKAQNEVGSDTCICIVKLKEPPRFVSKLNSLTVVAGEPAELQASIEGTQPISVQWLKEKEEVVRESENIRITFVENVATLQFSKAEPANAGKYICQIKNDGGMRENMATLSFISEPAVIVEKAGSMTVTVGETCTLECKVAGTPELSVEWYKDGKLLTSSQKHKFSFYNKISSLKILSVEKQDAGTYTFQVQNNVGKSSCTAVVDVSDRMVPPSFTRRLKDTIGVLGTSCILECKVAGSSPISVAWFHGKTKIVSGAKYQTTFSDNVCTLQLNSLDSSDMGSYTCVAANVAGSDECRAVLAVQEPPSFVKEPEPLEVLPGKNITFTSVIRGTPPFKVGWFRGARELVKGDRCNIYFEDTVAELELFNVDISQSGEYTCVVSNNAGQTSCTTRLFVKEPAVFVKKLSDHSVEPGKSIILESTYKGTLPISVTWKKDGFNITPSEKCSIVTTEKTCILEILNSTKRDAGRYSCEIENEAGRDVCEALVSTLEPPYFVTELEPLEASVGDSVSL

SEQ ID NO: 897 - protein, 1935 aa, Bos taurus
MVDAEMAAFGEAAPYLRKSEKERLEAQTRPFDLKKDVFVPDDKEEFVKATILSREGGKVTAETEHGKTVTVKEDQVLQQNPPKFDKIEDMAMLTFLHEPAVLYNLKERYASWMIYTYSGLFCVTINPYKWLPVYNAEVVAAYRGKKRSEAPPHIFSISDNAYQYMLTDRENQSILITGESGAGKTVNTKRVIQYFAVIAAIGDRSKKEQATGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTTEEKNSMYKLTGAIMHFGNMKFKLKQREEQAEPDGTEEADKSAYLMGLNSADLLKGLCHPRVKVGNEYVTKGQNVQQVVYAKGALAKAVYERMFNWMVTRINATLETKQPRQYFIGVLDIAGFEIFDFNSFEQLCINFTNEKLQQFFNHHMFVLEQEEYKKEGIEWEFIDFGMDLQACIDLIEKPMGIMSILEEECMFPKATDMTFKAKLFDNHLGKSSNFQKPRNIKGKPEAHFSLIHYAGTVDYNIIGWLQKNKDPLNETVVDLYKKSSLKMLSSLFANYAGFDTPIEKGKGKAKKGSSFQTVSALHRENLNKLMTNLRSTHPHFVRCIIPNETKSPGVIDNPLVMHQLRCNGVLEGIRICRKGFPNRILYGDFRQRYRILNPAAIPEGQFIDSRKGAEKLLGSLDIDHNQYKFGHTKVFFKAGLLGLLEEMRDERLSRIITRIQAQSRGVLSRMEFKKLLERRDSLLIIQWNIRAFMGVKNWPWMKLYFKIKPLLKSAETEKEIALMKEEFGRLKEALEKSEARRKELEEKMVSLLQEKNDLQLQVQAEQDNLADAEERCDQLIKNKIQLEAKVKEMTERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQHVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELSEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKLELQSALEEAEASLEQEEGKILRAQLEFNQIKAEMERKLAEKDEEMEQAKRNHLRVVDSLQTSLDAETRSRNEALRVKKKMEGDLNEMEIQLSHANRLAAEAQKQVKSLQSLLKDTQIQLDDAVRANDDLKENIAIVERRNNLLQAELEELRAVVEQTERSRKLAEQELIETSERVQLLHSQNTSLINQKKKMEADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 898 - protein, 377 aa, Bos taurus
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 899 - protein, 375 aa, Bos taurus; identical to SEQ ID NO: 862

SEQ ID NO: 900 - protein, 1934 aa, Bos taurus
MSSDAEMAIFGEAAPYLRKSEKERIEAQNRPFDSKKACFAVDDKELYVKGMIQGRENDKVTVKTLDDRTLTLNSEQVFPMNPPKFDKIEDMAMMTHLHEPAVLYNLKERYAAWMIYTYSGLFCVTVNPYKWLPVYNPEVVAAYRGKKRQEAPPHIFSISDNAYQFMLTDRDNQSILITGESGAGKTVNTKRVIQYFATIAVTGDKKKEQQPGKMQGTLEDQIIQANPLLEAFGNAKTVRNDNSSRFGKFIRIHFGATGKLASADIETYLLEKSRVTFQLSSERSYHIFYQIMSNKKPELIDLLLISTNPFDFPFVSQGEVTVASIDDSEELLATDNAIDILGFSSEEKVGIYKLTGAVMHYGNMKFKQKQREEQAEPDGTEVADKAGYLMGLNSAEMLKGLCCPRVKVGNEYVTKGQNVQQVTNSVGALAKAVYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNIAGWLDKNKDPLNETVVGLYQKSSLKLLSFLFSNYAGAEAGDSGASKKGGKKKGSSFQTVSAVFRENLNKLMTNLRSTHPHFVRCLIPNETKTPGVMDHHLVLHQLRCNGVLEGIRICRKGFPSRILYGDFKQRYRILNASAIPEGQFIDSKNASEKLLNSIDVDREQYRFGHTKVFFKAGLLGLLEEMRDEKLVTLMTRTQALCRGYLMRVEFKKMMERRDSIFCIQYNIRSFMNVKHWPWMNLFFKIKPLLKSAEAEKEIATMKEDFERAKEELARSEARRKELEEKMVSLLQEKNDLQLQVQTETENLMDAEERCEGLIKSKIQLEAKVKELNERLEEEEEMNSELVAKKRNLEDKCSSLKRDIDDLELTLTKVEKEKHATENKVKNLSEEMTALEENISKLTREKKSLQETHQQTLDDLQVEEDNVNGLIKINAKLEQQTDDLEGCLEQEKKLRADLERAKRKLEGDLKLCQESIMDLENDKQQMEEKLQKKDFEISQLQTKIEDKQVHSLQLQKKIKELQARTEELEEEVEAEHTLRGKIEKQRADLSRELEEISERLEEASGATSVQIEMNKKREAEFQKLLRDLEEATLQHEATTTTLRKKHADSVAELGEQIDNLQRVKQKLEKEKSELKMEIDDMASNIETVSKSKSNVERMCRTVEDQFNEIKAKDDQQTQLIHDLNMQKARLQTQNGELSHQVEEKAALISQLTKGKQVLTQQLEDLKRQLEEETKAKSALAHALKSARHDCDLLREQYEEEQEGKAELQRAMSKANSEVAQWRTKYETDAIQRTEELEEAKKKLAQRLQEAEENTEAASSKCASLEKTKQRLQGEVDDLMLDLERANTACACLDKKQRNFDKVISEWKQKLDESQAELEAAQKESRSHSTEVFKMRNAYEEVVDQLETLRRENKNLQEEISDLTMQIAETNKNLQEVEKTKKQAEQEKSDLQAALEEVEGSLEHEESKILRVQLELNQVKSELDRRLTEKDEEIEQLKRSSQRAAEAMQSILDAEIRSRNDALRLKKKMEGDLNEMEIQLGHSNRQMAETQKHLRSVQGQLKDSQLHLDDALRSNEDLKEQLAMVERRNGLLQEELEEMKVALEQTERTRKLSEQELLDASDRMQLLHSQNTSLINTKKKLEADIAQCQAEVENSIQESKNAEEKAKKAITDAAMMAEELKKEQDTSAHLERMMKNLEQTVKDLQHRLDEAEQLALKGGKKQIHKLENRVRELESELDAEQKRGAEALKGAHRYERKVKEMTYQAEEDRKNILRLQDLVDKLQAKVKAYKRQAEEAEEQANTQLSRCRRVQHELEEAEERADIAESQVNKLRAKSRDVGAQ

SEQ ID NO: 901 - protein, 381 aa, Bos taurus
MPFGNTHNKHKLNFKAEEEYPDLSKHNNHMAKALTLEIYKKLRDKETPSGFTLDDVIQTGVDNPGHPFIMTVGCVAGDEESYTVFKDLFDPIIQDRHGGFKPTDKHKTDLNHENLKGGDDLDPNYVLSSRVRTGRSIKGYALPPHCSRGERRAVEKLSVEALNSLTGEFKGKYYPLKSMTEQEQQQLIDDHFLFDKPVSPLLLASGMARDWPDARGIWHNDNKSFLVWVNEEDHLRVISMEKGGNMKEVFRRFCVGLQKIEEIFKKAGHPFMWNEHLGYVLTCPSNLGTGLRGGVHVKLAHLSKHPKFEEILTRLRLQKRGTGGVDTAAVGSVFDVSNADRLGSSEVEQVQLVVDGVKLMVEMEKKLEKGQSIDDMIPAQK

SEQ ID NO: 902 - protein, 842 aa, Bos taurus
MSRPLTDQEKRKQISVRGLAGVENVTELKKNFNRHLHFTLVKDRNVATPRDYYFALAYTVRDHLVGRWIRTQQHYYEKDPKRIYYLSLEFYIGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGRVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCLDPVRTNFDAFPDKVAIQLNDTHPSLAIPELMRILVDQERLEWEKAWEVTVKTCAYTNHTVLPEALERWPVHLIETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVMCNPGLAEIIAERIGEEYIADLDQLRKLLSYVDDESFIRDVAKVKQENKLKFSAYLEKEYKVHINPNSLFDIQVKRIHEYKRQLLNCLHVITLYNRIKKEPNKFFVPRTVMIGGKAAPGYHMAKMIIKLITAIGDVVNHDPVVGDRLRVIFLENYRVSLAEKVIPAADLSEQISTAGTEASGTGNMKFMLNGALTIGTMDGANVEMAEEAGEENFFIFGMRVEDVERLDQKGYNAQEYYDRIPELRHVIDQLSSGFFSPKQPDLFKDIVNMLMHHDRFKVFADYEEYVKCQERVSALYKNPREWTRMVIRNIATSGKFSSDRTIAQYAREIWGVEPTRQRMPAPDEKI

SEQ ID NO: 903 - protein, 894 aa, Bos taurus
MNQIEPGVQYNYVYEDDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERVEHLAEKFRQKASTHETWAYGKEQILLQKDYESSTLTEVRALLRKHEAFESDLAAHQDRVEQIAAIAQELNELDYHDAVNVNDRCQKICDQWDRLGTLTQKRREALERTEKLLETIDQLHLEFAKRAAPFNNWMEGAMEDLQDMFIVHSIEEIQSLITAHEQFKATLPEADGERQSILAIQNEVEKVIQSYSIRISSSNPYSTVTVDEIRSKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYTAFSSALYGESDL

SEQ ID NO: 904 - protein, 901 aa, Bos taurus
MMMVLQPEGLGTGEGPFAGGRGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRVQEKCQLEINFNTLQTKLRLSHRPAFMPSEGKLVSDIANAWRGLEQAEKGYEDWLLSEIRRLQRLQHLAEKFQQKASLHEAWTRGKEDMLSQRDYETASLQEVRALLRRHEAFESDLAAHQDRVEHIAALAQELNELDYHEAASVNSRCQAICDQWDNLGTLTQKRRDALERMEKLLETIDQLQLEFARRAAPFNNWLDGAVEDLQDVWLVHSVEETQSLVTAHDQFKATLPEADRERGAILGIQGEIQKICQTYGLRPSSTNPYITLTPQDINTKWDTVRKLVPSRDQMLQEELTRQQVNERLRRQFAAQANAIGPWIQGKVEEVGRLAAGMAGSLEEQMAGLRQQEQNIINYKSNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTAEQVVASFKILAGDKNYITAEELRRELPAEQAEYCIRRMAPYKGAGAPAGALDYVAFSSALYGESDL

SEQ ID NO: 905 - protein, 284 aa, Bos taurus
MDAIKKKMQMLKLDKENALDRAEQAEADKKAAEDRSKQLEDELVSLQKKLKATEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDKYEEEIKVLSDKLKEAETRAEFAERSVTKLEKSIDDLEDELYAQKLKYKAISEELDHALNDMTSI

SEQ ID NO: 906 - protein, 434 aa, Bos taurus
MAMQKIFAREILDSRGNPTVEVDLHTAKGRFRAAVPSGASTGIYEALELRDGDKSRYLGKGVLKAVEHINKTLGPALLEKKLSVVDQEKVDKFMIELDGTENKSKFGANAILGVSLAVCKAGAAEKGVPLYRHIADLAGNPELILPVPAFNVINGGSHAGNKLAMQEFMILPVGASSFREAMRIGAEVYHHLKGVIKAKYGKDATNVGDEGGFAPNILENNEALELLKTAIQAAGYPDKVVIGMDVAASEFYRNGKYDLDFKSPDDPARHISGEKLGELYKNFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAVFAGRKFRNPKAK

SEQ ID NO: 907 - protein, 1198 aa, Bos taurus
MPEPTKKEENEVLAPAPAPPPEEPNKEKEAGTAPVKEPNKEKEAGTAPAKEPNKEKEAGTAPAKEPNKEKEAGTSPGKDEEDASPPGGLPPEWSIGESPAGEEQDKQNANSQLSILFVEKPQGGTVKVGENITFIAKVKAEDLLRKPTVKWFKGKWMDLASKAGKHLQLKETFERHSRVYTFEMQIIKAKENYAGNYRCEVTYKDKFDSCSFDLEVLESTGTTPNIDIRSAFKRSGEGQDDAGELDFSGLLKRREVKPQEEQPEVDVWELLKNAKPSEYEKIAFQYGITDLRGMLRRLKRMRRVEKKSAAFARILDPAYQVDKGGRVRFVVELADPKLEVKWYKNGQEIRPSTKYIFEHKGCERIMFINNCVLTDDSEYYVTAGDEKCSTELFVREPPVMVTKQLEDTKAYCGERVELECEVSEDDANVKWFKNGEEIIPGPKSRYHIRVEGKKHILIIDGATKADSAEYSVMTTGGQSSAKLSVDLKPLKILTPLTDQTVNLGKEICLKCEVSENITGKWTKNGLPVQETDHLKIVHKGRIHKLVIANALVEDEGDYVFTPDDYSVTLPAKVHVVDPPKINLDGLDADNTVTVIAGNKLRLEIPISGEPPPKALWSRADKAIMEGSGRIRSENYPDSTTLVIDIAEKDDSGVYHINLKNEAGEAHASIKIKVVDIPDPPVAPNVTDVGDDWCIMTWDPPLYDGGSPILGYFIERKKKQSSRWMRLNFDLCKETIFEPKKMIEGVAYEVRIFAVNAVGISKPSMPSKPFVPLAVTSPPTLLTVDSVTDTTVTMKWRPPDQIGAAGLDGYVLEYCFEGSTSAKQSDENGEAAYDLPADDWIAANTELIEKTKFTITGLPTDSRIYVRVKAVNAAGASEPKYYSQPILVKEIIEAPKIRIPRHLKQTYIRRVGEAINLVIPFQGKPRPELIWTKDGAPIDKNQINIRNSETDTIVFIRKAERSHSGKYDLQVKVEKFVETASIDIRVIDRPGPPQLVKIEDVWGENVALSWTPPRDDGNTAITGYTIQKADKKSMEWFTVIEHYHRTSATITELVIGNEYYFRVFAENMCGLSEDATMTKESAVIAKDGKIYKNPVYEDFDFTEAPMFTQPLVNTYAVAGYNATLNCSVRGNPKPKITWMKNKVVIKDDPRYRMFSNQGVCTLEIRKPSPYDGGTYCCKAVNDLGTVEIECKLEVKVVAQ

SEQ ID NO: 908 - protein, 284 aa, Bos taurus
MDAIKKKMQMLKLDKENAIDRAEQAEADKKQAEDRCKQLEEEQQALQKKLKGTEDEVEKYSESVKDAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 909 - protein, 333 aa, Bos taurus
MVKVGVNGFGRIGRLVTRAAFNSGKVDIVAINDPFIDLHYMVYMFQYDSTHGKFNGTVKAENGKLVINGKAITIFQERDPANIKWGDAGAEYVVESTGVFTTMEKAGAHLKGGAKRVIISAPSADAPMFVMGVNHEKYNNTLKIVSNASCTTNCLAPLAKVIHDHFGIVEGLMTTVHAITATQKTVDGPSGKLWRDGRGAAQNIIPASTGAAKAVGKVIPELNGKLTGMAFRVPTPNVSVVDLTCRLEKPAKYDEIKKVVKQASEGPLKGILGYTEDQVVSCDFNSDTHSSTFDAGAGIALNDHFVKLISWYDNEFGYSNRVVDLMVHMASKE

SEQ ID NO: 910 - protein, 332 aa, Bos taurus
MATLKDQLIQNLLKEEHVPQNKITIVGVGAVGMACAISILMKDLADEVALVDVMEDKLKGEMMDLQHGSLFLRTPKIVSGKDYNVTANSRLVIITAGARQQEGESRLNLVQRNVNIFKFIIPNIVKYSPNCKLLVVSNPVDILTYVAWKISGFPKNRVIGSGCNLDSARFRYLMGERLGVHPLSCHGWILGEHGDSSVPVWSGVNVAGVSLKNLHPELGTDADKEQWKAVHKQVVDSAYEVIKLKGYTSWAIGLSVADLAESIMKNLRRVHPISTMIKGLYGIKEDVFLSVPCILGQNGISDVVKVTLTHEEEACLKKSADTLWGIQKELQF

SEQ ID NO: 911 - protein, 1467 aa, Bos taurus
MSLVAVPFYQKRHKHFDQSYRNIQTRYLLDEYSAKKKRASAQSSLQRSVTRKSSSQRESSRAALGRTTCRLCAKRMSSALEEEAQERKRRYQSMVAAYGEAKRERYLSELAQLEEDVHVARTHARDQLDRLALQHAVDDRLAWERHSFEERISRAPEILVRLRSHTVWERMSVKLCFTVQGFPTPVVQWYKDGSLICQAGEPGKYRIDSKYGVHTLEINRADFDDTATYSAVATNVHGQVSTNAAVVVRRFRGDEEPFHSVGLPIGLPLSSVIPYTHFDVQFIEKFGVTFRREGETLTLKCTLLVTPDLKRVQPRAEWYRDDVLLKESKWTKMFFGEGQASLSFSHLNKDDEGLYTLRIVSRGGITDHSAFLFVRDADPLVTGAPGAPMDVHCHDVNRDYVIVTWKPPNATKESPVIGYFIDRCEVGTDNWIQCNDAPVKICKYPVTGLFEGRSYIFRVRAVNSAGISRPSRVSEAVAALDPVDLRRLQAVHLEGEKDIVVYQEELEGEVQIPGPPTNVHASETSRTYVVLSWDPPEPRGKEPLMYFIEKSMVGSGSWQRVNAQTAVRSPRYAVFDLAEGKPYVFRVLSANKHGLSDPSEITAPIQAQDTIVVPSAPGRVLASRNTRTSVVVQWDRPKHEEDLLGYYVDCSVAGSNVWEPCNHKPIGYNRFVVHGLTTGEQYIFRVKAVNAVGTSENSQESDVIKVQAALTVPSHPYGITLLNCDGHSMILGWKVPKFSGGSPILGYYVDKREAHHKNWHEVNSSPLKERILTVEGLTEGSLYEFKIAAANMAGIGQPSDPSELFKCEAWTMPEPGPAYDLTFCEVRDTSLVLLWKPPVYSGSSPVSGYFVDYKEEDSGEWLTVHETATPHRYLKVCDLHQGKTYVFRVRAVNASGVGRPSDTSEPVLVEARPGTKEVSAGVDEEGNVYLSFDCPEVTDASHFTWCKSYEDIADDDRFKVETAGDHSKLYFKNLDKEDLGTYSVSVSDTDGVSSSFVLDEEELERLKALSNEIKNPTIPLKSELAYEIFDKGQVRFWLQAEHLSPDSSYRFIINDREVADSETHRIKCDKSTGIIEMVMDRFTIDNEGTYTVQIQDGKAKSQSSLVLIGDAFKAVLKEAEFQRKEFLRKQGPHFAEYLHWDVTEECEVRLVCKVANTKKETVFKWLKDDVLYETEKMPDLEKGVCELLIPKLSKKDHGEYKATLKDDRGQDVSTLEIAGKVYEDMILAMSRVCGASASPLKILCTPEGIRLQCFMKYFTEEMKVNWYHKDAKITSSEHMRIGGNEQMAWLQICEPTEKDKGKYTFEILDGKKNHQRSLDLSGQAFDEAFAEFQQLKAAAFAEKNRGKVIGGLPDVVTIMEGKTLNLTCTVFGNPDPEVVWFKNDKDIELSDHFSVKVEQGKYVSMTIKGVTSEDSGKYSIHVKNKYGGEKIDVTVSVYKHGEEIPDVVLPQQAKPKLLPAAAPSPAH

SEQ ID NO: 912 - protein, 192 aa, Bos taurus
MAPKKDVKKPAAAAAPAPAPAPAPAPAPAPPKEEKIDLSAIKIEFSKQQQDEFKEAFLLFDRTGECKITLSQVGDVLRALGTNPTNAEVKKVLGNPSNEEMNAKKIEFEQFLPMLQAISNNKDQGTYEDFVEGLRVFDKEGNGTVMGAELRHVLATLGEKMKEEEVEALMAGQEDSNGCINYEAFVKHIMSN

SEQ ID NO: 913 - protein, 607 aa, Bos taurus
MKWVTFISLLLLFSSAYSRGVFRRDTHKSEIAHRFKDLGEEHFKGLVLIAFSQYLQQCPFDEHVKLVNELTEFAKTCVADESHAGCEKSLHTLFGDELCKVASLRETYGDMADCCEKQEPERNECFLSHKDDSPDLPKLKPDPNTLCDEFKADEKKFWGKYLYEIARRHPYFYAPELLYYANKYNGVFQECCQAEDKGACLLPKIETMREKVLASSARQRLRCASIQKFGERALKAWSVARLSQKFPKAEFVEVTKLVTDLTKVHKECCHGDLLECADDRADLAKYICDNQDTISSKLKECCDKPLLEKSHCIAEVEKDAIPENLPPLTADFAEDKDVCKNYQEAKDAFLGSFLYEYSRRHPEYAVSVLLRLAKEYEATLEECCAKDDPHACYSTVFDKLKHLVDEPQNLIKQNCDQFEKLGEYGFQNALIVRYTRKVPQVSTPTLVEVSRSLGKVGTRCCTKPESERMPCTEDYLSLILNRLCVLHEKTPVSEKVTKCCTESLVNRRPCFSALTPDETYVPKAFDEKLFTFHADICTLPDTEKQIKKQTALVELLKHKPKATEEQLKTVMENFVAFVDKCCAADDKEACFAVEGPKLVVSTQTALA

SEQ ID NO: 914 - protein, 993 aa, Bos taurus
MEAAHSKTTEECLAYFGVSETTGLTPDQVKRHLEKYGHNELPAEEGKSLWELVLEQFEDLLVRILLLAACISFVLAWFEEGEETVTAFVEPFVILLILIANAIVGVWQERNAENAIEALKEYEPEMGKVYRADRKSVQRIKARDIVPGDIVEVAVGDKVPADIRILTIKSTTLRVDQSILTGESVSVIKHTEPVPDPRAVNQDKKNMLFSGTNIAAGKAIGIVATTGVGTEIGKIRDQMAATEQDKTPLQQKLDEFGEQLSKVISLICVAVWLINIGHFNDPVHGGSWIRGAIYYFKIAVALAVAAIPEGLPAVITTCLALGTRRMAKKNAIVRSLPSVETLGCTSVICSDKTGTLTTNQMSVCKMFIIDRIDGDLCLLNEFSVTGSTYAPEGEVLKNDKPVRSGQYDGLVELATICALCNDSSLDFNETKGIYEKVGEATETALTTLVEKMNVFNTEVRNLSKVERANACNSVIRQLMKKEFTLEFSRDRKSMSVYCSPAKSRAAVGNKMFVKGAPEGVIDRCNYVRVGTTRVPMTGPVKEKILSVIKEWGTGRDTLRCLALATRDTPPKREEMVLDDSTKFMEYETDLTFVGVVGMLDPPRKEVMGSIQLCRDAGIRVIMITGDNKGTAIAICRRIGIFGENEDVADRAYTGREFDDLPLAEQREACRRACCFARVEPTHKSKIVEYLQSFDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRTPKEPLISGWLFFRYMAIGGYVGAATVGAAAWWFLYAEDGPHVTYSQLTHFMKCSEHSPDFEGVDCEVFEAPQPMTMALSVLVTIEMCNALNSLSENQSLVRMPPWVNIWLVGSIGLSMSLHFLILYVDPLPMIFKLQALDLYHWLMVLKISLPVIGLDEILKFVARNYLEG

SEQ ID NO: 915 - protein, 531 aa, Bos taurus; identical to SEQ ID NO: 739

SEQ ID NO: 916 - protein, 562 aa, Bos taurus
MVKIVTVKTKAYQDQKPGTSGLRKRVKVFQSSSNYAENFIQSIISTVEPAQRQEATLVVGGDGRFYMKEAIQLIVRIAAANGIGRLVIGQNGILSTPAVSCIIRKIKAIGGIILTASHNPGGPNGDFGIKFNISNGGPAPEAITDKIFQISKTIEEYAICPDLHVDLGVLGKQQFDLENKFKPFTVEIVDSVEAYATMLRNIFDFNALKELLSGPNRLKIRIDAMHGVVGPYVKKILCEELGAPANSAVNCVPLEDFGGHHPDPNLTYAADLVETMKTGEHDFGAAFDGDGDRNMILGKHGFFVNPSDSVAVIAANIFSIPYFQQTGVRGFARSMPTSGALDRVANATKIALYETPTGWKFFGNLMDASKLSLCGEESFGTGSDHIREKDGLWAVLAWLSILATRKQSVEDILKDHWQKYGRNFFTRYDYEEVEAEGANKMMKELEALISDRSFVGKQFPVGDKVYTVEKIDNFEYSDPVDGSISRNQGLRLLFADGSRIIFRLSGTGSAGATIRLYIDSYEKDLAKIYQDPQVMLAPLISIALKVSQLQEKTGRTAPTVIT

SEQ ID NO: 917 - protein, 296 aa, Bos taurus
MASHRHSGPSSYKVGTMAEKFDCHYCRDNLQGKKYVQKDGHHCCLKCFDKFCANTCVQCRKPIGADSKEVHYKNRYWHDTCFRCSKCLQPLASETFVAKDNKILCNKCTTREDNPKCKGCLKPIVAGDQNVEYKGTVWHKDCFTCSNCKQVIGTGSFFPKGEDFYCVTCHEAKFAKHCVKCNKAITSGGITYQDQPWHAECFVCVTCSKKLAGQRFTAVEDQYYCVDCYKNFVAKKCAGCKNPITGFGKGSSVVAYEGQSWHDYCFHCKKCSVNLANKRFVFHQEQVYCPDCAKKL

SEQ ID NO: 918 - protein, 260 aa, Bos taurus
MAKEWGYADHNGPDHWHELFPNAKGENQSPIELNTKEISHDPSLKPWTASYDPGSAKTILNNGKTCRVVFDDTYDRSMLRGGPLAAPYRLRQFHLHWGSSDDHGSEHSVDGVKYAAELHLVHWNSKYNSYATALKHADGIAVVGVFLKIGREKGEFQLLLDALDKIKTKGKEAPFNNFNPSCLFPACRDYWTYHGSFTTPPCEECIVWLLLKEPITVSSDQIAKLRTLYSSAENEPPVPLVRNWRPPQPIKGRIVKASFK

SEQ ID NO: 919 - protein, 779 aa, Bos taurus
MTHEHHAAKTLGIGKAIAVLTSGGDAQGMNAAVRAVVRVGIYTGARVFFVHEGYQGLVDGGDNIREATWESVSMMLQLGGTVIGSARCKDFREREGRLRAAHNLVKRGITNLCVIGGDGSLTGADTFRSEWSDLLSDLQKSGKITAEEATKSSYLNIVGLVGSIDNDFCGTDMTIGTDSALHRIIEIVDAITTTAQSHQRTFVLEVMGRHCGYLALVTSLSCGADWVFIPECPPDDDWEEHLCRRLSETRNRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTRAMDERRFDEALKLRGRSFMNNWEVYKLLAHVRPPKSKSGSHTVAVMNVGAPAAGMNAAVRSTVRIGLIQGNRMLVVHDGFEGLAKGQIEEAGWSYVGGWTGQGGSKLGTKRTLPKKSFEQISANITKFNIQGLVIIGGFEAYTGGLELMEGRKQYDELCIPFVVIPATVSNNVPGSDFSVGADTALNTICMTCDRIKQSAAGTKRRVFIIETMGGYCGYLATMAGLAAGADAAYIFEDPFTIRDLQVNVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANSPDSGCVLGMRKRALVFQPVTELKEQTDFEHRIPKEQWWLKLRPILKILAKYEIDLDTSEHAHLEHISRKRSGEANV

SEQ ID NO: 920 - protein, 6909 aa, Bos taurus
MADDEEYEEVVEYYTEETVYEEVPGETRTRFYETTTTRTSDYEQSETSRPALAQPVPEKPVERKRVIRKKVDPSKFMTPYIAHSQKMQNLFSTNKYKENYEKAKGKPYAITTDTPELRRIKKVQDQLSEVKYRVDGDVAKTICHVDEKAKDIEHAKKVSQQVSKVLYKQNWEDTKDKYLLPPDAPELVQAIKNTAMFSKKLYTEDWEADKTMFYPYNDSPELRRVAQAQKALSDIAYKKGLAEQQTQFTSLPDPPDIEFAKKVTNQVSKQKYKEDYENKVKGKWSETPCFEIATARMNSNNISTKKYQEDFEHMKDQIYFMQTETPEYKVNKQAGVAASKVKYKQDYEKNKGKADYNVLPASENPLLRQLKAAGDALSDKLYKENYEKTKAKSINYCETPKFKLDTVLHNFSSDTKYKDSYLKDILGHYVGSYEDPYHTHCMRVSAQNSDKNYKAEYEEDRGKGFFPQTITQEYEAIKKLDQCKDHTYKVHPDKTKFTQVTDSPVLMQAQVNSKQLSDLNYKAKHENEKFKCHIPPDTPAFIQHKLNAYNLSDNIYKHDWEKTKAKKFDIKVDAIPLLAAKANTKIASDVMYKKDYEKSKGKMIGALSINDDPKMLHSLKTAKNQSDRLYKENYEKTKAKSMNYCETPKYQLDTLLKNFSEAKYKDSYVQNVLGHYIGSFEDPYQVHCLKISAQNSDKNYKAEYEEDKGKCYFPQTITQEYEAIKKLDQCKDHTYKVHPDKTKFTAVTDTPVLLQAQLNTKQLSDLNYKAKHEGEKFKCHIPADAPQFIQHRVNAYNLSDNIYKHDWEKTKAKKFDIKVDAIPLLAAKANTKIASDVMYKKDYEKSKGKMIGALSINDDPKMLHSLKTAKNQSDHEYRKDYEKSKTIYTAPLDMLPLTHAKKSQAIASDVDYKHLLHNYSYPPDSVNVDLAKKAYALQSDVEYKADYNSWMKGCGWMPFGSLEMEKAKRASDILNEKKYRQHPDTLKFTSIEDAPIIVQSKINQAQRSDVAYKAKGEEVIHKYSLPADLPQFIQAKVNAYNISENLYKADLKDLSKKGYDLRIDAIPIKAAKAARQAASDVQYKKDYEKAKGKMVGFQSLQDDPKLVHYMNVAKIQSDREYKKAYEKTKTRHNTPHDMVNIVAAKKAQDVASNVNYKHSLHHYTYLPDAMDLELSKNMMHIQSDNVYKEDYNNWMKGIGWIPIGSLEVEKVKKAGDALNEKKYRQHPDTLKFTSIVDSPVMVQAKQNTQQVSDILYKAKGEDVKHKYTMSPDLPQFLQAKCNAYNLSDVCYKRDWHDLIAKGTNVLGDAIPITAAKASRNIASDYKYKEAYEKAKGKQVGFRSLQDDPKLVHYMNVAKLQSDREYKKNYENTKTSYHTPGDMVSITAAKMAQDVATNVNYKQPIHHYTYLPDALSLEHIRNVNQIQSDNVYKDEYNHFFKGMGWIPIGSLEVEKVKKAGDALNEKKYRQHPDTIKFTSVPDSMGMVLAQHNTKQLSDLNYKVEGEKVKHKYTMDPDVPQFIQAKVNAYNMSDSHYKADWKKTLAKGYDLRPDAIPIVAAKSSRNIASDFKYKEAYEKTKGKQIGFRSLQDDPKLVHFMNVAKMQSDREYKKGYEASKTKYHTPLDMLSVTAAKKSQEVATNTNYKQPFHHYTLLPDALNVEHSRNAMQIQSDNLYKSDFTNWMKGIGWLPLESLEVEKAKKAGEILSEKKYRQHPEKLKFTYAMDTMEQALNKSNKLIMDKRLYTEKWNKDKTTIHVMPDTPDILLSRVNQITMSDKLYKAGWEEEKKKGYDLRPDAISIKAARASRDIASDYKYKQAYEQAKGKQIGFRSLEDDPKLVHFMQVAKMQSDREYKKAYEKSKTSFQTPVDMLSVVAAKKSQEVATNANYRNVIHTYNMLPDAMSLELAKNMMQIQSDNQYKADYADFMKGIGWLPLGSLEAEKNKKAMEIISEKKYRQHPDTLKYSTLMDSMNMVLAKNNAKIMNEHLYKQAWEADKTKVHIMPDIPQIILAKANAINISDKLYKLSLEEAKKKGYDLRTDAIPIKAAKASRDIASDYKYKHSYEKERGKMVGFRSLEDDPKLVHSMQVAKMQSDREYKKNYEKTKTSYHTPADMLSVTAAKDAQANITNTNYKHLIHKYILLPDAMNIQLSKNMNRIQSDNEYKQDYNEWYKGLGWSPAGSLEVEKAKKATEYASDQKYRQHPSNFQFTKLNDSMDMVLAKQNAHTMNKYLYTVDWNKDKTKIHVMPDTPDILQAKQNQTMYSQVKYKMGWPSGLERVVNLPSVLIKIFKSKQNKDLIWRFKYKQGYRKQIGHHIGFRSLQDDPKLVLSMNVAKMQSEREYKKDFEKWKTKFSSPVDMLGVVLAKKCQALVSDVDYKNYLHGWTCLPDQNDVIHAKKAYDLQSENLYKSDLEWLKGIGWSPLGSLEAEKNKRASEIISEKKYRQPPDRNKFTSIPDAMDIVLAKTNAKNRSDILYREAWDKDKTQIHIMPDTPDIILAKANLINTSDKFYRMGYEELRKKGYDLPVDAIPIKAAKASREIASEYKYKEGFRMQLGHHIGARNIKDDPKMMWSMHVAKIQSDREYKKDFEKWKTKFSSPVDMLGVVLAKKCQTLVSDIDYKNYLHQWTCLPDQSDVIHARRAYDLQSDNLYKSDLQWLRGIGWLPSGSLEDEKNKRASQILSDHVYRQHPDQFKFSSLMDSIPMVLAKNNAITMNHRLYTEAWDKDKTTVHIMPDTPEVLLAKQNQINYSEKLYKLGLDEAKRKGYDMRIDAIPIRAAKASRDIASEFKYKEGYRRQLGHHIGARAIHDDPKMMWSMHVAKIQSDREYKKDFEKWKTKFSSPVDMLGVVLAKKCQTLVSDIDYKNYLHQWTCLPDQSDVIHARQAYDLQSDNVYKSDLQWLRGIGWVPIGSLDVEKSKRASEILSDKLYRQPPDKFKFTSVTDSLEQVLAKNNAINMNKRLYTEAWDKDKTQVHIMPDTPEITLARTNKVNYSENLYKLAHEEAKKKGYDLRSDAIPIIAAGLEKDHISDYKYKDGYRKQLGHHIGARDIKDDPKMMWSMHVAKIQSDREYKKDFEKWKTKFSSPVDMLGVVLAKKCQTLVSDIDYKNYLHQWTCLPDQSDVIHARQAYDLQSDNVYKSDLQWLRGIGWVPIGSVDVVKCKRAAEILSDNLYRQPPDTLKFTSVPDSLEQVLAKNNAINMNKRLYTEAWDKDKTQIHIMPDTPEIMLARQNKLNYSETLYKLANEEAKKKGYDLRSDAIPIVAAKASRDIISDYKYKDGYRKQLGHHIGARDIKDDPKMMWSMHVAKIQSDREYKKDFEKWKTKFSSPVDMLGVVLAKKCQTLVSDIDYKNYLHQWTCLPDQSDVIHARRAYDLQSDNIYKSDLQWLRGIGWVPIGSVDVVKCKRAAEILSDNLYRQRPDTLKFTSVPDSLEQVLAKNNAINMNKRLYTEAWDKDKTQIHMMPDTPEITLARQNKINYSENLYRQAMEEAKKEGYDLRSDAIPIVAAKASREIASDYKYKEAYRKQLGHHIGARAIHDDPKMMWSVHVAKMQSDREYKKDFEKYKTRFSSPVDMLGIVLAKKCQTLVSDVDYKHPLHEWTCLPDQNDIIHARKAYDLQSDNLYKSDLEWLKGIGWVPIGSVEVLKAKRAGEILSDNIYRQRPDTLKFTSVTDSPEQVLAKNNAINMNKRLYTEAWDNDKKTIHVMPDTPEIMLAKLNRINYSDKLYKLALEESRKEGYDLRLDAIPIQAAKASREIASDYKYKEGYRKQLGHHIGARNIKDDPKMMWSIHAGKLQSDLEYKKDFEKWKTKFSSPVDMMGLVQAKKCQILVSDIDYKNLLHEWTCLPDQNDIIQARKAYDLQSDAIYKADLEWLRGIGWVPIDSVGVEHAKRAGEILSERKYRQPAVQLKFTSITDTPEIVLAKNNALNVSKHLYTEAWDADKTSIHVMPDTPEILLAKSNSANISHKLYTKGWDESKMKDYDLRADAISIKSAKASRDIASDYKYKEAYEKHKGHHIGARSVEDDPRIMCAMNAGRIQSEREYKKEFQKWKTKFSSPVDMLGILLAKKCQTLVSDIDYRNYLHHWTCLPDQNDIIQARKAYDLQSDAIYKADLEWLRGIGWMPEGSPEVLRVKNAQHIFRDSVYRTPVVKLKYTSIVDTPEVVLAKSNAENISIPKYREVWDKDKTSIHIMPDTPEINLARTNALNVSNKLYREGWDEMKMSCDVRLDAIPIQAAKASREIASDYKYKLDHEKQKGHYVGTRTARDDNKIRWALIAGKIQNEREYRLHWAKWKSKFQSPPDMLSIEHSKNSQTLVSDIDYRHYLHQWTCMPDQNDVIQARKAYDLQSDAIYKADLEWLRGIGWMPADSVSVNHAKHMADIFNEKKYRTKIETLSFTPVDDRVDYVTAKHSGEILNDIKYRKDWNDTKSKYTLTETPQLHTAQEAARILDQYLYKESWEKQKATGYILPPDAVPFVHAHHSGDVQSELKYKAEHVKQKGHYVGVPTMRDDPKLVWFEHAGQIQNDRLYKENYHKTKAKIHIPPDMVSVLAAKEGQALASDIDYRNYLHQWICHPDQNDVIQARKAYDLQSDNIYKADLEWLRGIGWIPLDSVDHVRVTRNQEMMNQIKYKKDALANYPNFTSVVDPPEIVLAKINSVNQSDVKYKETFNKLIKGKYIFSPDTPYITHSKDMEKLYSTILYKRAWDGTKAYGYTLDERYIPIVGAKHADFVNSELKYKETYEKLKGHYLAGKEISEFPNVVHCLDFQKMRSLLNYRRHYEDTKANVHIPQDMMNHVLAKRCQYILSDLEYRHYFHQWTSLPEEPNVVRVRHAQEILSDNVYKDDLNWLKGIGCYVWDTPQILHAKKSYDLQSQILYTAAGKENLKNYNLVTDTPLYVTALQSGINASEVKYKENYHQTKDKYTTVLETVDYDRIKNLKDLFSSNLYKEAWDKVKATSYILPPNTVSLTHAKNQKYMASHIKYREEYEKFKALYTLPRSVEDDPNTARCLRVGKFNIDRLYRSVYEKNKMKIHIVPDMVEMVTAKDSQKKVSEIDYRLHLHEWICHPDLQVNSHVRKVTDQISDIVYKDDLTWLKGIGCYVWDTPEILHAKHAYDLRNDIKYKAHVLKTRNNYKLVTDTPVYVQAVKSGKQLSDAVYHYDYVHSIRGRVAPTTKTVDLDRALHAYKLQSENLYRKAGLHALPTGYRLPVDTPHFKHTKDTRYMSSYFKYKEVYEHMKAYGYTLGPNDVPFVNVRRVNNITSERLYRQLYHKLKDKIHTTPDTPEIRQVKKTQEAVSELIYKSDFFKMQGHMISLPYTPQVLHCRYVGDITSDIKYKEDLQVLRGMGCFLYDTPDMVRSRHLRKLWSHYLYTDKARKMRDKYKVVLDTPEYRKVQELKTHLSELVYRAAGRKQKSIFTSVPDTPDLTRAKRGQKLQSQYLYVELATKERPHHHAGNQTTALKHARHVKDMVSENKYKIQYEKMKDKYTPVPDTPILIRAKRAYWNASDLRYKETFQKTKGKYHTVKDALDIVYHRTVTDHISKIKYKENYMSQLGIWRSIPDRPEHFHHRAVTDAVSDVKYKQDLTWLKGIGCYAYDTPDFTLAEKNKTLYSKYKYKEVFERTKSNFKYVADCPINRHFKFATQLMNEKKYRADYEQRKDKYHLVVDEPRHLLAKIAGDQISQIKYRKNYEETKDKFTSIVDTPEHLRTTKVNKQISDILYKLEYNKAKPRGYTTIHDTPMLLHVRKVKDEVSDLKYKEVYQRTKSNCTIEPDAVHIKAAKDAYKVNTNLDYKKKYEATKAYWKWTPDRPDFIQAAKSTLQQSDFEYKLDREYLKGCKLSVTDDKDMVLALKNSIIESDLKYKEKHVKERGSCHAVPDTPQILLAKTVSSLVSENKYKSYVKKHLAQGSYTTLPETRDTIHVKEVTKNVSDTNYKKKFVKEKGKSNYSIMLEPPDVKHAMDVAKKQSNVAYKKDAKENLHYTTVADRPDIKKATQAAKQASEVEYRAKHRKEGSHGLSMLGRPDIEMAKKAAKLSSQVQYRENFNKEKGKTPKYNPKDSQLYKVMKDANTLASEVKYKADLKKLHKPVTDMKESLIMNHVLNTSHLASSYQYKKNYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLSEMEDTPDMLRAKNATQILNEKEYKRDLELEVKGRGLNAMANETPDFLRARNATDIASQIKYKQSAEMEKANFTSVVDTPEIIHAQQVKNLSSQKKYKEDAEKCMSYYETVLDTPEMQRVRENQKNFSLLQYQYDLKNSKGKITVVQDTPEILRVKENQKNFSSVLYKEDVSPGTAIGKTPEMMRVKQTQDHISSVKYKEVIGQGTPIPDLPEVKRVKQTQKHISSVMYKENLGTGIPTPVTPEIERVKRNQENFSSVLYKENLGKGTPTPITPEMERVKRNQENFSSILYKENLSKGTPLPVTPEMERVKRNQENFSSVLYKENVGKGTPTPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNTQDFSDICYRGIQRKVVEMEQKRNDQDQETITGLRVWRTNPGSVFDYDPAEDNIQSRSLHMINAQAQRRSREQSRSASGLSISGGEEKSEHSEAAHLSTYSDGGVFFSAASTGYKHARTTELPQQRSSSVATQQTTVSSIPSHPSTAGKIFRAMYDYMAADADEVSFKDGDAIVNVQAIDEGWMYGTVQRTGRTGMLPANYVEAI

SEQ ID NO: 921 - protein, 557 aa, Bos taurus
MAALTQNPQFKKLKTWYEQHGSDLNLRRLFEGDRDRFNRFSLNLNTNHGHILVDYSKNLVTETVMQMLVDVAKSRGVEAARERMFTGEKINFTEDRAVLHVALRNRSNAPILVDGKDVMPEVNRVLEKMKSFCQRVRSGEWKGYSGKAITDVINIGIGGSDLGPLMVTEALKPYSSEGPRVWFVSNIDGTHIAKTLATLNPESSLFIIASKTFTTQETITNAETAKEWFLLSAKDPSAVAKHFVALSTNTAKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVNYQTGPIVWGEPGTNGQHAFYQLIHQGTKMIPCDFLIPVQSQHPIRNGLHHKILLANFLAQTEALMRGKSTEEARKELQAAGRSPEDFEKLLPHKVFEGNRPTNSIVFTKLTPFILGALIAMYEHKIFVQGIIWDINSFDQWGVELGKQLAKKIEPELDGSSPVTSHDSSTNGLINFIKQEREARS

SEQ ID NO: 922 - protein, 183 aa, Bos taurus
QRKPKITASRKLLLKSLMLAKAKECWEQEHEEREAEKKRYLAERIPALQTRGLSLSALQDLCRDLHAKVEVVDEERYDIEAKCLHNTREIKDLKLKVLDLRGKFKRPPLRRVRVSADAMLRALLGSKHKVSMDLRANLKSVKKEDTEKERPVEVGDWRKNVEAMSGMEGRKKMFDAAKSPTTQ

SEQ ID NO: 923 - protein, 1135 aa, Bos taurus
MPEAKPAAKKAPAGKDAAAKPAPKEATPQEAPAAPPTEAPPEDQSPTAEEPTGVFLKKPDSVSVETGKDTVIVAKLNGKELPAKPAVKWFKGKWLELGSKSGARFSFKESHDAASNVYTIELHITKVVLGDRGDYRIEVKAKDFCDSCAFNIDVEAPRQDSAGQSLESFKRSGEAKSDTAGELDFSGLLKKRQVVEEEKKKKKDDDDLGIPPEIWELLKGAKKSEYERIAFQYGITDLRGMLKRLKKAKVEVKKSAAFTKKLDPAYQVDRGNKIKLVVEISDPDLPLKWFKNGQEIKPSSKYVFENVGKKRILTINKCTLADDAAYEVVVKDEKCFTELFVKVEPPVLIVTPLEDQQVFVGDRVEMAVEVSEEGAQVMWLKDGVELTREDSFKARYRLKKDGKRHILIYSEVTMEDKGHYQVMTNGGQCEAELIVEEKQLEVLQDIADLTVKASEQAVFKCEVSDEKVTGKWYKNGVEVRPSKRITISHTGRFHKLVIDDVRPEDEGDYTFVPDGYALSLSAKLKFLEIKVEYVPKQEPPKIHLDCSGQTSENAIVVVAGNKLRMDVSITGEPRPVATWMKEDEVFTGTEGRVRIEQRGDISSFVIESAERGDEGRYTIKVTNPVGEDVASILLKVVDVPDPPEAVRVTSVGEDWAVLVWEPPKYDGGRPVTGYLLERKKKGSQRWMKLNFEVFTETTYESTNMIEGILYEMRVFAAPLIQQLKTLTPQPHAPFSPTSEPQHLTVEDVTDTTTTLKWRPPDKIGAGGIDGYLIEYCVEGSDEWIPANTEPVERCGFTVKNLPTGAKITFRVVGVNIAGRSQPATLAQPVTIREIVEQPKIRLPRHLRQTYVRKVGEHLNLVIPFQVRRAKGGAPIDTSHVHVRTSDFDTVFFVRQAARSDSGEYELTVQIENMKDTATVCIRVVEKAGPPQNVMVKEVWGTNALVEWQPPKDDGNSEITGYFVQKADKKTMEWFTVYERNRHTSCTVSDLIMGNEYYFRVYSENVCGLSDLPGVSKNTARIVKTGMTLKLPEYKEHDFRTPPKFLTPLPDRVVVAGYAAALNCAVRGHPKPKVVWMKNKMEIREDPKFLMTNQQGVLTLNIRRPSPFDSGTYSCRAVNELGEALAECKLEVRAPR

SEQ ID NO: 924 - protein, 2723 aa, Bos taurus
MMNNSGYSEAPGFGLGDEVDDMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGIGEVLVYIEDPEGHTEEAKVVPNNDKNRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPVMEGPHTVHVAFAGAPITRSPFPVHVAEACNPNACRASGRGLQPKGVRVKEVADFKVFTKGAGSGELKVTVKGPRGTEEPVKVREAGDGVFECEYYPVVPGKYVVTITWGGYAIPRSPFEVQVSPEAGIQKVRAWGPGLETGQVGKSADFVVEAIGTEVGTLGFSIEGPSQAKIECDDKGDGSCDVRYWPTEPGEYAVHVICDDEDIRDSPFIAHIQPAPPDCFPDKVKAFGPGLEPTGCIVDKPAEFTIDARAAGKGDLKLYAQDADGCPIDIKVIPNGDGTFRCSYVPTKPIKHTIIVSWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVHFAGAAKGEAVRDFEIIDNHDYSYTVKYTAVQQGNMAVTVTYGGDPVPKSPFVVNVAPPLDLSKVKVQGLNSKVAVGQEQAFSVNTRGAGGQGQLDVRMTSPSRRPIPCKLEPGGGAETQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKAGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGAHLVEVLYDDVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSLSSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGEETVITVDAKAAGKGKVTCTVSTPDGAELDVDVVENHDGTFDIYYTAPEPGKYVITIRFGGEHIPNSPFHVLACEAMPRVEEPPDVPQLHRPSAYPTHWATEEPVVPAEPMESMLRPFNLVIPFTVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKTEAAEIVEGEDSAYSVRFVPQEMGPHTVTVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVNVP

SEQ ID NO: 925 - protein, 248 aa, Bos taurus
MAAIAVTEAMKCKIQVLQQQADDAEERAKRLQQKVDGERWAREQAEAEVVSLNRRIQLVEEELNRAQERLATALQKLEEAEKAADESERVMKVIENQALKDEEKMELQEIQLKEAKHIAEEAHRKYEEVARKLVIIEGDLERTEERAELAQSRCRKMGEQIRLMDQHLKCLSAAEEKYSQKEDKYEEEIKILTEKLKEAETRAEFAERSVAKLEKTIDDLEDKLKCTKEEDLCTQRMLNQTLLDLNKM

SEQ ID NO: 926 - protein, 417 aa, Bos taurus
MSLSNKLTLDKLDVKGKRVVMRVDFNVPMKNNQITNNQRIKAAVPSIKYCLDSGAKSVVLMSHLGRPDGVPMPDKYSLQPVAVELKSLLGKDVLFLKDCVGPEVEKACADPAAGSVILLENLRFHVEEEGKGKDASGNKVKAEPTKIEAFRASLSKLGDVYVNDAFGTAHRAHSSMVGVNLPKKAGGFLMKKELNYFAKALESPERPFLAILGGAKVADKIQLISNMLDKVNEMIIGGGMAFTFLKVLNNMEIGTSLFDEEGSKIVKDLMSKADKNGVKITLPVDFVTADKFDENAKTGQATVASGIPAGWMGLDCGPESSKKYAEAVARAKQIVWNGPVGVFEWEAFARGTKALMDEVVKATSRGCITIIGGGDTATCCAKWNTEDKVSHVSTGGGASLELLEGKVLPGVDALSSV

SEQ ID NO: 927 - protein, 170 aa, Bos taurus
MAPKKAKRRAAAEGGSSSVFSMFDQTQIQEFKEAFTVIDQNRDGIIDKEDLRDTFAAMGRLNVKNEELDAMMKEASGPINFTVFLNMFGEKLKGADPEDVITGAFKVLDPEGKGTIKKKFLEELLTTQCDRFSQEEIKNMWAAFPPDVGGNVDYKNICYVITHGDAKDQE

SEQ ID NO: 928 - protein, 200 aa, Bos taurus
PRSQHRCPDARLSAQERTMGDEEKRHRAITARRQHLKSVMLQIAATELEKEEGRREAEKQNYLSEHCPPLHLPGSMSEVQELCRQLHAKIDAAEEEKYDMEIRVQKSTKELEDMNQKLFDLRGKFKRPPLRRVRMSADAMLKALLGSKHKVCMDLRANLKQVKKEDTEKERDLRDVGDWRKNIEEKSGMEGRKKMFETES

SEQ ID NO: 929 - protein, 249 aa, Bos taurus
MAPSRKFFVGGNWKMNGRKNNLGELINTLNAAKVPADTEVVCAPPTAYIDFARQKLDPKIAVAAQNCYKVANGAFTGEISPGMIKDLGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSARIIYGGSVTGATCKELASQPDVDGFLVGGASLKPEFVDIINAKQ

SEQ ID NO: 930 - protein, 175 aa, Bos taurus
MDIAIHHPWIRRPFFPFHSPSRLFDQFFGEHLLESDLFPASTSLSPFYLRPPSFLRAPSWIDTGLSEMRLEKDRFSVNLDVKHFSPEELKVKVLGDVIEVHGKHEERQDEHGFISREFHRKYRIPADVDPLAITSSLSSDGVLTVNGPRKQASGPERTIPITREEKPAVTAAPKK

SEQ ID NO: 931 - protein, 271 aa, Bos taurus
MSDEEVEHVEEEYEEEEEAQEEAPPPPAEVPEVHEEVHEVHEPEEVQEEEKPRPRLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKVLAERRKPLNIDHLSEDKLRDKAKELWDTLYQLETDKFEYGEKLKRQKYDITNLRSRIDQAQKHSKKAGTAPKGKVGGRWK

SEQ ID NO: 932 - protein, 419 aa, Bos taurus
MASTFSKLLTGRNASLLFATLGTGALTTGYLLNKQNVCAAAREQHKLFPPSADYPDLRKHNNCMAECLTPAIYAKLRNKVTPSGYTLDQCIQTGVDNPGHPFIKTVGMVAGDEESYEVFADLFDPVIKLRHNGYDPRVMKHPTDLDASKITQGQFDERYVLSSRVRTGRSIRGLSLPPACSRAELREVENVAITALEGLKGDLAGRYYKLSEMTEQDQQRLIDDHFLFDKPVSPLLTCAGMARDWPDARGIWHNYDKTFLIWINEEDHTRVISMEKGGNMKRVFERFCRGLKEVERLIQERGWEFMWNERLGYILTCPSNLGTGLRAGVHVRIPKLSKDPRFSKILENLRLQKRGTGGVDTAAVADVYDISNIDRIGRSEVELVQIVIDGVNYLVDCEKKLERGQDIKVPPPLPQFGKK

SEQ ID NO: 933 - protein, 470 aa, Bos taurus
MSQAYSSSQRVSSYRRTFGGAPSFPLGSPLSSPVFPRAGFGTKGSSSSVTSRVYQVSRTSGGAGGLGALRASRLGSTRVPSSYGAGELLDFSLADAVNQEFLTTRTNEKVELQELNDRFANYIEKVRFLEQQNAALAAEVNRLKGREPTRVAEIYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTFSALNFRETSPEQRGSEVHTKKTVMIKTIETRDGEVVSEATQQQHEVL

SEQ ID NO: 934 - protein, 1015 aa, Bos taurus
MENAHTKTVEEVLGHFGVNESTGLSLEQVKKLKERWGSNELPAEEGKTLLELVIEQFEDLLVRILLLAACISFVLAWFEEGEETITAFVEPFVILLILIANAIVGVWQERNAENAIEALKEYEPEMGKVYRQDRKSVQRIKAKDIVPGDIVEIAGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDKVEGDTCSLNEFTITGSTYAPIGEIHKDDKPVKCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTPGVKQKIMSVIREWGSGSDTLRCLALATHDNPLRREEMNLEDSANFIKYETNLTFVGCVGMLDPPRIEVASSVKLCRQAGIRVIMITGDNKGTAVAICRRIGIFRQDEDVTAKAFTGREFDELSPSAQREACLNARCFARVEPSHKSKIVEFLQSFDEITAMTGDGVNDAPALKKSEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAAEGGPRVSFYQLSHFLQCKEDNPDFEGVDCAVFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKPCSFSACTDGISWPFVLLIMPLVVWVYSTDTNFSDMFWS

SEQ ID NO: 935 - protein, 528 aa, Bos taurus; identical to SEQ ID NO: 788

SEQ ID NO: 936 - protein, 253 aa, Bos taurus
MSTHRLVMVRHGESTWNQENRFCGWFDAELSEKGAEEAKKAAQAIKDAKMEFDICYTSVLKRAIRTLWTILDGTDQMWLPVVRTWRLNERHYGGLTGLNKAETAAKHGEEQVKIWRRSFDIPPPPMDEKHPYYKSISKERRYAGLKAGELPTCESLKDTIARALPFWNDEIAPQIKAGKRVLIAAHGNSLRGIVKHLEGMSDQAIMELNLPTGIPIVYELDQALKPTKPMRFLGDEETVRKAMEAVAAQGKAK

SEQ ID NO: 937 - protein, 1532 aa, Bos taurus
MGHSKQIRILLLNEMEKLERTLFRLEQGFELQFRLGPTLQGKAVTVYTNYPLPGEAFNREKFRSLEWENPTEREDDSDKYCKLNLQQAGSFQYYFLQGNEKSGGGYIVVDPILRVGADNHVLPLDCVTLQTFLAKCMGPFDEWESRLMVAKESGYNMIHFTPLQTLGLSRSCYSLADQLELNPDFSRPNKKYTWTDVGQLVQKLKKEWNMLCITDVVYNHTAANSRWLQEHPESAYNLVNSPHLKPAWVLDRALWHLSCDVAEGKYKDRGVPALIENDHQMNCIRKVIWEDIFPKTQLWEFFQVDVHKAVEQFRGLLTQENRKTTRPDPDHHLKIIQDPEYRRLGCTVDMNVALATFIPHDNGPAAINECCNWFRKRIEELNSEKHQLINYHQEQAVNCLLGNVFYERLADHGPKLGPVTRKHPLVTRYFTFPFEDISLSVEESMIHVPNKACFLMAHNGWVMGDDPLRNFAEPGSDVYLRRELICWGDSVKLRYGKKPEDCPYLWAHMKKYTEITATYFQGVRLDNCHSTPLHVAEYMLDAARKLQPNLYVVAELFTGSEDLDNVFVTRLGISSLIREAMSAYDSHEEGRLVYRYGGEPVGSFVQPCLRPLVPAIAHALFMDITHDNECPIVHRSAYDALPSTTIVSMACCASGSTKGYDELVPHQISVVSEERFYTKWNPAASPSSAGEVNSQSGIIAARCAINKLHQELGAKGFIQVYVDQVDADIVAVTRHSPSIHQSVVSVSRTAFRNPKTSFYSKEVPQMCIPGKIEEVVLEARTVERNTAPYRKDANSINGIPNITVEIREHIQLNESKIVKQAGVTTKGPNEYIQEIEFENLSPGSVIIFRVSLDPHAQVAVGILRNHLTQFSPHFKSGSLAVDNADPILKIPFASIASRLTLAELNQVLYRCESEEKEDGGGCYNIPNWLPLKYAGLQGLMSVLAEIRPKNDLGHPFCDNLRSGDWMIDYVSNRLISRSGTIAEVGKWLQAMFFYLKQIPRYLIPCYFDAILIGAYTTLLDVAWKQMSSFVQNGSTFVKHLSLGSVQMCGVGRFSSLPLLSPSLTDVPCRLNEITREKEQCCVSLAAGLPHFSAGIFRCWGRDTFIALRGLLLITGRYLEARNIILAFASTLRHGLIPNLLGEGTHARYNCRDAVWWWLQCIQDYCKMVPNGLDILNCPVSRMYPADDSVPLSAGTVDQPLFEVIQEAMQRHMQGIQFRERNAGPQIDRNMKDEGFNITAGVDEETGFVYGGNRFNCGTWMDKMGESDRARNKGIPATPRDGSAVEIVGLSKSAVRWLLELSQKNIFPYHYVTVKRHGKLVRVSYDEWNRKIQENFEKLFYVSEDPSDVSEKHPNLVHKRGIYKDSYGASSPWCDYQLRPNFTIAMVVAPELFTTQKAWKALEIAEKKLLGPLGMKTLDPDDMVYCGTYDNALDNDNYNLAKGFNYHQGPEWLWPVGYFLRAKLYFSRLMGPETTAKTIFLVKNVLSRHYVHLERSPWKGLPELTNENGQYCPFSCETQAWSIAAVLETLYDL

SEQ ID NO: 938 - protein, 452 aa, Bos taurus
MAGYLRVVRSLCRASGSGSAWAPAALTAPNLQEQPRRHYADKRIKVAKPVVEMDGDEMTRIIWQFIKEKLILPHVDVQLKYFDLGLPNRDQTNDQVTIDSALATQKYSVAVKCATITPDEARVEEFKLKKMWKSPNGTIRNILGGTVFREPIICKNIPRLVPGWTKPITIGRHAHGDQYKATDFVVDRAGTFKVVFTPKDGSGPKEWEVYNFPAGGVGMGMYNTDESISGFAHSCFQYAIQKKWPLYMSTKNTILKAYDGRFKDIFQAIFEKHYKTEFDKHKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQTLEKVCVETVESGAMTKDLAGCIHGLSNVKLNEHFLNTSDFLDTIKSNLDRALGQQ

SEQ ID NO: 939 - protein, 553 aa, Bos taurus
MLSVRVAAAVARALPRRAGLVSKNALGSSFIAARNLHASNSRLQKTGTAEVSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKARRRVGLKAPGIIPRISVREPMQTGIKAVDSLVPIGRGQRELIIGDRQTGKTSIAIDTIINQKRFNDGTDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVISQHQALLSKIRTDGKISEESDAKLKEIVTNFLAGFEA

SEQ ID NO: 940 - protein, 3170 aa, Bos taurus
MRKHRHLPLVAILCLFFSGFSFTRGQQQPGRDVKNGAAADIIFLVDSSWSIGKEHFQLVREFLYDVIESLAVGDNDFRFALVQFNGNPHTEFLFNTYRSKQEVLSHVSNMSYIGGSNQTGKGLAYVMQNHLTEAAGSRASDGVPQVIVVLTHGHSEDGLALPSAELKSADVNVFAIGVEDADEAALKEIASEPLNMHVFNLENYTSLHDIVGNLVACVRSSMAPERAGGTEIPKDITAQDSADIIFLIDGSNNTGSVNFAVILDFLVNLLERLSIGTQQIRVGVVQYSDEPRTMFSLNSYSTKAQVLDAVKALGFIGGELANVGLALDFVVENHFTRAGGSRAEEGVPQVLVLISAGPSSDEIRDGVIALKQASVFSFGLGAQAASKAELQHIATNDNLVFTVPEFRSLGDVQEQLLPYIVGVAQRHIVLQPPTIVTQVIEVNKRDIVFLVDGSSKLGLTNFNAIRDFIAKVIQRLEIRQDLIQVAVAQYADTVRPEFYFNTYPSKREVINAVRKMKALDGSALYTGSALDFVRNNLFTEAAGYRAAEGVPKLLVLVTGGKSLDAVSQPAQELKRSGILAFAVGNKVADQAELEEIAFDSSLVFTATEFRPAPLQGVLPGLLGPLRTLTGTTEVRVNKRDIIFLLDGSSNVGETNFPYVRDFVMNLVNSLDVGSDHIRVGLVQFSDTPVTEFSLNTYPTKSELLAHLRQMQLQGGSVLNTGAALSYVHANHFTEAGGSRIQDHVPQLLLLLTAGQSEDSYLQAANALARAGILTFCVGTSQADRAELEEIAFNPGLVYLMDDFSSLPALPQQLIQPLTTYVSGGVEEVPLAQPESKRDILFLFDGSANLMGQFTAARDFLYKVIDELDVKPEGTRVAVAQFSDDVKVESRFDQHQNKPEILNLVKRMKLKTGKALNLGYALDYAQRYIFVKSAGSRIEDGVLQFLVLLVAGKSSDRVDTPALNLKQSGVVPFILQAKNADPAELELIVPSPAFILVAESLPKIGDLQPQIVNLLKSVQNGAPAPVSVEKDVVFLIDGSEGVRSGFPLLKEFVQRVVESLDVGPDRVRVAVVQYSDRTRPEFYLNSYMDQQSVVGAIRGLTLLGGPAPNTGAALEFVLRNILVGSAGSRIAEGVPQLLIVLTADRSGDDVRGPSVVLRRGGAVPIGIGIGNADITEMQTLSFVPDFAVVIPTFRQLGTIQQVISERVTQLSREELSRLQASVTPLTTPVVSSKRDVVFLIDGSQSAGPEFQYIRTLIERLVDYLDVGFDTTRVAVIQFSDDPRVEFLLNVHSSKDEVQNAVRRLRPKGGRQVNVGGALEYVARNIFKRPLGSRIEEGVPQFLVLISSGKSDDEVEDSAIELKQFGVAPLTIARNVDQEELVKISLSPEYVFSVNTFRELPSLEQKLLTPLTTLTAGQIQQLLASTRYPPPAVESDAADIVFLIDSSDGVKPDGIAHIRDFVIRIVRRLNVGPNKVRIGVLQFSNDVFPEFQLKTYKSQASVLDAIRRLRFKGGSPLNTGKALEFVARNYFVKSAGSRIEDGVPQHLVLFLGGKSQDDISRYSQVIKSAGIASLGVGDRNIDRTELQTITSDPRLVFTVREFRDLPSIEERMVNSFGSSGVTPAPPGVDTPSPSRPEKKKADIVFLLDGSINFRRDSFQEVLRFVSEIVDTVYEGGDSIQVGLVQYNSDPTDEFFLKDFPTKQQIIDAINKVVYKGGRHANTKVGLEHLRRNHFVPEAGSRLDQRVPQIAFVITGGKSVEDAQEASMALTQRGVKVFAVGVRNIDSEEVGKIASNSATAFRVGNVQELSELSEQVLETLHDAMHETLCPGVTDVSKACNLDVILGFDGSGDQNVFVAQKGLEPKVDTILRRISQMQKISCSGSQLPTVRVSVVALTPSGPVEAFDFAEYQPELFEKFQNMRAQHPYVLTADTLKLYQNKFRQASMDNVKVVIHFTDGVDGDLADLQRASEELRQEGVRALILVGLERVANLEQLMQLEFGRGFTYNRPLRLNLLDLDYELAEQLDNIAEKACCGIPCKCSGQRGDRGPIGSIGPKGIPGEDGYRGYPGDEGGPGERGPPGVNGTQGFQGCPGQRGVKGSRGFPGEKGELGEIGLDGLDGEDGDKGLPGTSGEKGSPGRRGDKGPKGDKGERGDVGIRGDPGNSGQDSQQRGAKGETGDIGPVGLPGRDGVSGGPGEPGKSGGFGRRGPAGAKGNQGGPGQQGPVGEQGTRGAQGPPGPTGPPGLIGEQGIPGPRGGGGTAGAPGERGRTGPLGRKGEPGDPGPKGSIGNRGPRGETGDDGRDGVGSEGRIGKKGERGFPGYPGPKGNPGEPGTDGPPGPKGIRGRRGNSGPPGIAGQKGDPGYPGPSGYKGSRGDSMDQCALVQSIKDKCPCCYGPLECPVFPTELAFALDTSEGVTQDRFSQMREVVLKILDDLTIAESNCPRGARVAVVTYNNEVTTEIRFADSKKKSVLLDKIKNLQVSLTSKQQSLETAMSFVARNTFKRVRSGFLMRKVAVFFSNKPTRATPQLREAVLKLSDAGITPLFLTSQEDRQLINALQINNTAVGHALVLPAGGDLTDFLKNVLTCHVCLDICNIDPSCGFGSWRPSFRDRRAAGSDVDIDMAFILDSSESTTPFQFNEMRKYIEYLVRQLDVSPDPKASQHFARVAVVQHAPYEAVDNASVPPVKVEFSLTDYGSKEKLLAFLGSRMTQLQGTRALGRAIDYTIENIFESAPNPRDLKIVVLMLTGEVQKQQLEEAQRAILQAKCKGYFFVILGIGRKVNVKELYSSASEPNDVFFKLVDKSTELNEEPLMRFGRLLPSFVSSKDAFYLSPDIRKQCDWFQADQPAKNLVQFGYKQINVPNNVTSSPTSKLVTTTKPVITTTKPITVVNLPASKPAATRPVDERPAAGRSVATKMDSARPVPEAAKTATARPAAAAKPAAAKPAPARPPTAARSMATRSEAPRPQAVKLAASRPGAAKPVVKAPREIHVSEVTENSAKLHWERPEPPSPYLYNLTVTSAHDQAVVLKQNLTVTDRVIGGLLPGQTYHVTVTCSLRSQVRAIYQGSFSTKKIQPPPPQTERSASSATINLVVSADRLAGSKADICKLPKDGGTCREFVLKWYYDSVTENCARFWYGGCGGNENRFNSQDECEKVCPPVPIKQPGVIAAMGT

SEQ ID NO: 941 - protein, 199 aa, Bos taurus
MAPKKPDPKKDEAKAGAKAAAAPAPAPAPPPAPEPSKEPEFDPSKIKIEFTPEQIEEFKEAFTLFDRTPKCEMKITYGQCGDVLRALGQNPTQAEVLRVLGKPKQEELNSKMMDFDTFLPMLQHISKNKDTGTYEDFVEGLRVFDKEGNGTVMGAELRHVLATLGEKLTEDEVEKLMAGQEDSNGCINYEAFVKHIMAG

SEQ ID NO: 942 - protein, 211 aa, Bos taurus
MPPKKDVPVKKPVGPPAAPKPAAKPAVGPPPSRVELPSLIPVILEKPAKIQEPPIDLSKVVIEFNKDQLEEFKEAFELYDRVGDGKIQFSQCGDVMRALGQNPTNAEVLRVLGYPKSDELKSRRVDFETFLPMLQAVAKLPDRGSYQDYLEGLRVFDKEQNGKVMGAELRHVLTTLGERMTEEEVESVLAGHEDSSGCINYEAFLKHILSV

SEQ ID NO: 943 - protein, 1561 aa, Bos taurus
MSLPFYQKLHQHYDRSYRNRDLSTTMSQYQQEKKSSAIYTHGSTAYSSRSSAAHRQESAAFSQASAASYQHQASRASEFALSSAASHKAASAYDYGYSHRLTDSSLMLDYSSKLSPQTKRAKKSLLSGEEKENLPSDYMVPIFSGRQVHVSGITDTEEQRIKEAAAYIAQRNLLASEEGVTASKQSSVSKQSSVSKQSMSTLHQEEAFEKKSRKVAIREKADQLSLKKTLEETEAFHKKLNEDNLLHAPEFVIKPRSHTVWEKENVKLHCSVAGWPEPRLTWYKNQVPINVQAHPGKYIIESRYGMHTLEINACDFEDTAQYRASAMNAKGELSAYASVVVKRYKGELDDTRFHSGASTLPPSFAVTPYGYASRFEIHFDDKFEVSFGREGETMSLGCSVVITPEIKHFQPEIQWYRNGVPVSPSKWVQTHWSGDRATLTFSHLNKEDEGLYTVRARMGEYYEQYSAYVFVRDADAEIEGAPASPLDVVCLDANKDYIIITWKQPAVDGGSPILGYFIDKCEVGTDTWSQCNDIPVKFARFPVTGLIEGRSYIFRVRAVNKVGIGLPSRVSEPVAALDPAEKARLKSRPSAPWTGQIIVTEEEPTEGVVPGPPTDLSVIEATQSYVVLSWKPPRQRGHEGILYFVEKCEAGTENWQRVNTELPVKSPRFALFDLAEGKSYRFRVRCSNSAGVGEPSEATEVTVVGDKLDIPKPPSNIIPSRNTDTSVVVTWEEPKDAKELVGYYIESSIVGSGKWEPCNNNPVKGTRFTCHGLKTGQSYIFRVRAVNAAGLSEYSQNSEAIEVKAAIAPPSPPCDITCLESFRDSMVLGWKQPDKTGGAEITGYYVNYREVIDGVPGRWREANIKAISDEAYKISNLKENMVYQFQVAAINIAGLGAPSAVSPSFKCEEWTIAVPGPPHSLKYSQVRKTSLVLQWKPPIHSGRTPVTGYFVDIKEASAREDRWRGLNQAALKHTYLKVQGLKEGESYVFRVRAINQAGVGKPSDLAGPVVAETRPGTKEVVVSVDDNGIISLNFECDQMAPSSEFTWSKDYVPTEDSPRLEVESKGNKTKMTFKDLGTEDLGIYSCDVTDTDGIASSYLIDEEELKRLLALSQEHKFPTVPVKSELAVEILEKGQVRFWMQAEKLSTNAKVNYIFNEKEIFEGPKYKMHIDRNTGIIEMFMEKLQDEDEGTYTFQVQDGRATGHSTLVLIGDVYKKLQKEAEFQRQEWIRKQGPHFAEYLSWEVTGECNVLLKCKVANIKKETSIVWYKDDREISVDEKHDFKDGICTLLITEFSKKDAGIYEVVLKDDRGKDKSRLKLVDEAFKELMTEVCKTIALSATDLKIQSTAEGIRLYSFVTYYVDDLKVNWSHNGTAIKYSDRVKSGVTGEQIWLQINEPTPNDKGKYVMELFDGKTGHQKMVDLSGQAYDEAFAEFQRLKQAAIAEKNRARVVGGLPDVVTIQEGKALNLTCIVWGDPTPEVSWLKNEKLLASDEHCNLKFEAGKTAYFTISGVRTSDSGRYGLVVKNKYGSEISDFTVSVFIPEEEARSVAEEPQKGNKKAK

SEQ ID NO: 944 - protein, 166 aa, Bos taurus
MSPKKAKKRAEGANYNVFSMFEQTQIQEFKEAFTIMDQNRDGFIDKNDLRDTFAALGRVNVKNEEIDEMLKEAPGPINFTVFLQMFGEKLKGADPEETILNAFKVFDPEGKGVLKADYIKEMLTTQAERFSKEEIDQMFAAFPPDVTGNLDYKNLVHIITHGEEKD

SEQ ID NO: 945 - protein, 194 aa, Bos taurus
MEEKLKKTKIIFVVGGPGSGKGTQCEKIVQKYGYTHLSTGDLLRAEVSSGSARGKMLSEIMEKGQLVPLETVLDMLRDAMVAKVDTSKGFLIDGYPREVQQGEEFERRIAQPTLLLYVDAGPETMTKRLLKRGETSGRVDDNEETIKKRLETYYKATEPVIAFYEKRGIVRKVNAEGSVDNVFSQVCTHLDALK

SEQ ID NO: 946 - protein, 201 aa, Bos taurus
MAERRVPFSLLRGPSWDPFRDWYPAHSRLFDQAFGLPRLPEEWSQWLSHSGWPGYVRALPAAAIEGPAYNRALSRQLSSGVSEIQQTADRWRVSLDVNHFAPEELTVKTKDGVVEITGKHEERQDEHGYISRCFTRKYTLPPGVDPTLVSSSLSPEGTLTVEAPLPKSATQSAEITIPVTFQARAQLGGPEAGKSEQPENK

SEQ ID NO: 947 - protein, 349 aa, Bos taurus
MTGKKVCIVGSGNWGSAIAKIVGGNAAQLAHFDPRVTMWVFEEDIGGRKLTEIINTQHENVKYLPGHKLPPNVVAVPDVVQAAADADILIFVVPHQFIGKICDQLKGHLKADTIGVSLIKGVDEGPKGLKLISEVIGERLGIPMSVLMGANIANEVADEKFCETTIGSKNQAHGQLLKELMQTPNFRITVVQEVDTVEICGALKNIVAVGAGFCDGLGFGDNTKAAVIRLGLMEMIAFAKLFCSGSVSSATFLESCGVADLITTCYGGRNRKVAEAFARTGKSIEQLEKEMLNGQKLQGPQTARELHSILQHKGMVDKFPLFTAVYKVCYENQPVGEFIHCLQNHPEHV

SEQ ID NO: 948 - protein, 338 aa, Bos taurus
MLSALARPAGAALRRSFSTSAQNNAKVAVLGASGGIGQPLSLLLKNSPLVSRLTLYDIAHTPGVAADLSHIETRATVKGYLGPEQLPDCLKGCDVVVIPAGVPRKPGMTRDDLFNTNATIVATLTAACAQHCPEAMICIISNPVNSTIPITAEVFKKHGVYNPNKIFGVTTLDIVRANAFVAELKDLDPARVNVPVIGGHAGKTIIPLISQCTPKVEFPQDQLTTLTGRIQEAGTEVVKAKAGAGSATLSMAYAGARFVFSLVDAMNGKEGVVECSFVKSQETDCPYFSTPLLLGKKGIEKNLGIGKVSPFEEKMIAEAIPELKASIKKGEEFVKNMK

SEQ ID NO: 949 - protein, 641 aa, Bos taurus
MAKNTAIGIDLGTTYSCVGVFQHGKVEIIANDQGNRTTPSYVAFTDTERLIGDAAKNQVALNPQNTVFDAKRLIGRKFGDPVVQSDMKHWPFRVINDGDKPKVQVSYKGETKAFYPEEISSMVLTKMKEIAEAYLGHPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTRDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISRLYQGAGGPGAGGFGAQGPKGGSGSGPTIEEVD

SEQ ID NO: 950 - protein, 145 aa, Bos taurus
MLTAEEKAAVTAFWGKVKVDEVGGEALGRLLVVYPWTQRFFESFGDLSTADAVMNNPKVKAHGKKVLDSFSNGMKHLDDLKGTFAALSELHCDKLHVDPENFKLLGNVLVVVLARNFGKEFTPVLQADFQKVVAGVANALAHRYH

SEQ ID NO: 951 - protein, 430 aa, Bos taurus
MALLHSGRFLSGVAAAFHPGLAAAASARASSWWAHVEMGPPDPILGVTEAFKRDTNSKKMNLGVGAYRDDNGKPYVLPSVRKAEAQIAAKNLDKEYLPIAGLAEFCKASAELALGENNEVLKSGRYVTVQTISGTGALRIGASFLQRFFKFSRDVFLPKPTWGNHTPIFRDAGMQLQSYRYYDPKTCGFDFTGAIEDISKIPAQSVILLHACAHNPTGVDPRPEQWKEMATVVKKNNLFAFFDMAYQGFASGDGNKDAWAVRHFIEQGINVCLCQSYAKNMGLYGERVGAFTVVCKDAEEAKRVESQLKILIRPMYSNPPINGARIASTILTSPDLRKQWLHEVKGMADRIISMRTQLVSNLKKEGSSHNWQHIIDQIGMFCYTGLKPEQVERLTKEFSIYMTKDGRISVAGVTSGNVAYLAHAIHQVTK

SEQ ID NO: 952 - protein, 606 aa, Bos taurus
MDSQRELAEELRLYQSTLLQDGLKDLLDEKKFIDCTLKAGDKSLPCHRLILSACSPYFREYFLSEIDEAKKKEVVLDNVDPAVLDLIIKYLYSASIDLNDGNVQDIFALASRFQIPSVFTVCVSYLQKRLAPGNCLAILRLGLLLDCPRLAISAREFVSDRFVQICKEEDFMQLSPQELISVISNDSLNVEKEEAVFEAVMKWVRTDKENRVKNLSEVFDCIRFRLMTEKYFKDHVEKDDIIKSNPELQKKIKVLKDAFAGKLPEPSKNTEKAGAGEVNGDVGDEDLLPGYLNDIPRHGMFVKDLILLVNDTAAVAYDPTENECYLTALAEQIPRNHSSIVTQQNQVYVVGGLYVDEENKDQPLQSYFFQLDNVASEWVGLPPLPSARCLFGLGEIDDKIYVVAGKDLQTEASLDTVLCYDPAAAKWNEVKKLPIKVYGHSVISHKGMIYCLGGKTDDKKCTNRVFIYNPKKGDWKDLAPMKIPRSMFGVAVHKGKIVIAGGVTEDGLSASVEAFDLNTNKWEVMTEFPQERSSISLVSLAGSLYAIGGFAMIQLESKEFAPTEVNDIWKYEDDKKEWAGMLKEIRYASGASCLATRLNLFKLSKL

SEQ ID NO: 953 - protein, 853 aa, Bos taurus
SDHLELQVSASGGTEDVGNLLENHFSAGDASLEEKERALRAEAAPGETRPLLHPSEGGEDGSSEKTAADGLSSDPDPDPEASLSNASASESAAPGEPAGPGAEDAGPPGAASALPPGREGEPGEEEGARELSSGEGPGQEAEGPAGSGEVPEEAAEALGEAAAGSPEPENSEDSPSQEVETGGEGSPGPGLEPEVTDGAADVDAEAAQRTEDQAEPSSISAAAAEDAAAREEEGGSREHPNEASSEEEGGEESEEESGDEEDSGDAASSEEAGGASEEEEAEKEAGEGAHAAAGSASPGEEGSPEESPEGADAQEPKEEGPQGRGVSRGCPPPPARHLDEADRDPQGGRPTAGVVGHRPQGVPGPLGASRLFLNHLSPLQRDPLRACTLEGPEEPDVCPAEEAEDVSEEAPLRDRSHIEKTLMLNEDKPADDFSVVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPYDYKPDTHRDLFLREEISLLEDLNQVIENRLENKIAFIRQHAIRVRIHALLVDRYLQTYKEKMTFFSDGELVFKDIVEDPDKFYIFKTILAKTNVSKFDLPHREAYKDFFGINPISSFKLLSQQCSYMGGCFLDKIERAITQELPSLLGSLGLGKNPGALNCDKTGCGETPKNRYKKP

SEQ ID NO: 954 - protein, 4644 aa, Bos taurus
  MOD_RES (1109)..(1109): Any amino acid
MVAGMFMPLDQLRAIYEVLFREGVMVAKKDRRPRSLHPHVPGVTNLQVMRAMASLRARGLVRETFAWRHFYWYLTNEGIAHLRQYLHLPPEIVPASLQRVRRPVAMVMPARRTPHVQAVQGPLGCPPKRGPPPTEDPAREERCVYRRKEPEEGAPEPPVVPAATPGTLARQGLEPAPPTDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPMLIDMNKVYRQTNLENLDQAFSVAERDLGVTRLLDPEDVDVPQPDEKSIITYVSSLYDAMPRVPDVQDGVKANELQLRWQEYRELVLLLLQWIRAHTAAFEERRFPSSFEEIEILWCQFLKFKETELPAKEADKNRSKGIYQSLEGAVQAGQLKVPPGYHPLDVEKEWGKLHVAILEREKQLRSEFERLERLQRIVSKLQMEAGLCEEQLNQADALLQSQDVRLLAAGKAPQRAGEVERDLDKADGMIRLLFNDVQALKDGRHPQGEQMYRRVYRLHERLVAIRTEYNLRLRGTPRHPELEDSTLRYLQDLLAWVEENQRRLDGAEWGVDLPSVEAQLGSHRGLHQSVEEFRAKIERARTDEGQLSPATRGAYRDCLGRLDLQYAKLLNSSKARLRSLESLHGFVAAATKELMWLSEKEEEEVGFDWSERNSNMAAKKEAYSALMRELELKEKKIKEIQSTGDRLLREDHPARPTVESFQAALQTQWSWMLQLCCCIEAHLKENTAYFQFFSDVREAEEQLRKLQETLHRKYTCDRSITVTRLEDLLQDAQDEKDQLNEYRGHLSGLAKRAKAIVQLTPRNPTQPTRGRVPLLAVCDYKQVEATVHKGDECQMLGPAQPFHWKVLSGSGSEAAVPSVCFLVPPPNQEALEAVARLEAQHQALVTLWHQLHTDMKSLLAWQSLSRDVQLIRSWSLVTFRTLKPEEQRQALRSLELHYQAFLRDSQDAGGFGPEDRLQAEREYGSCSRHYQQLLQSLEQGKCGQCGXLDKEPARECAQRIAEQQKAQAEVEGLGKGVARLSAEAEKVLALPEPSPAAPTLRSELELTLGKLEQVRSLSAIYLEKLKTISLVIRSTQGAEEALKAHEEQLKEAQAVPAALPELEATKAAMKKLRAQAEAQQPVFDALRDELRGAQEVGERLQQRHGERDVEVERWRERVTQLLERWQAVLAQTDVRQRELEQLGRQLRYYRESADPLGAWLQDARRRQEQIQAVPLADSQAVREQLRQEKALLEEIERHAEKVEECQRFAKQYINAIKDYELQLVTYKAQLEPVASPAKKPKVQSGSESVIQEYVDLRTRYSELSTLTSQYIRFISETLRRMEEEERLAEQQRAEERERLAEVEAALEKQRQLAEAHAQAKAQAEREAQELQRRMQEEVARREEVVVDAQQQKRSIQEELQQLRQSSEAEIQAKARQVEAAERSRLRIEEEIRVVRLQLETTERQRGGAEGELQALRARAEEAEAQKRQAQEEAERLRRQVQDETQRKRQAEAELGLRVKAEAEAAREKQRALQALEELRLQAEEAERRLRQAEAERARQVQVALETAQRSAQAELQSKHASFAEKTAQLERTLEEEHVTVVQLREEATRREQQQAEAERAREEAERELERWQLKANEALRLRLQAEEVAQQKSLAQAEAEKQKEAAEREARRRGKAEEQAVRQRELAEQELERQRQLAEGTAQQRLAAEQELIRLRAETEQGEQQRQLLEEELARLQSEAAAATQKRQELEAELAKVRAEMEVLLASKARAEEESRSSSEKSKQRLEAEAGRFRELAEEAARLRALAEEAKRQRQLAEEDAARQRAEAERVLSEKLAAISEATRLKTEAEIALKEKEAENERLRRLAEDEAFQRRRLEEQAAQHKADIEERLAQLRKASESELERQKGLVEDTLRQRRQVEEEILALKASFEKAAAGKAELELELGRIRGNAEDTLRSKEQAEQEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSMLERLRGEAEAARRAAEEAEEARERAEGEAAQSRQRVEEAERLKQAAEEQAQAQAQAQAAAEKLRKEAEQEAARRAQAEQAALRQKQAADAEMEKHKKFAEQTLRQKAQVEQELTALRLKLEETDHQKSILDQELQRLKAEVTEAARQRSQVEEELFSVRVQMEELGKLKARIEAENRALILRDKDNTQRLLQEEAEKMKQVAEEAARLSVAAQEAARLRQLAEEDLAQQRALAEKMLKEKMQAVQEATRLKAEAELLQQQKELAQEQARRLQEDKEQMAQQLAQETQGFQRTLETERQRQLEMSAEAERLRLRVAEMSRAQARAEEDAQRFRKQAEEISAKLHRTELATQEKVTLVQTLETQRQQSDRDADRLREAIAELEREKDKLKKEAELLQLKSEEMQTVQQEQLLQETQALQQSFLSEKDSLLQRERFIEEEKAKLERLFQDEVAKAQKLREEQQRQQQQMQQEKQQLLASMEEARRRQREAEEGVRRKQEELQLLEQQRQQQEQLLAEENRRLRERLEHLEEEHRAALAHSEEITAAQAAATRALPNGQDATDGPAAEPEHAFEGLRQKVPAQQLQEAGILSTEEVQRLVQGHTTVAELTQREDVRRYLQGHSSIAGLLLKPANEKLTIYAALRRQLLSPGTAVILLEAQAASGFLLDPVRNRRLTVNEAVKEGVVGPELHHKLLSAERAVTGYKDPYTGEQISLFQAMKKDLIVREHGIRLLEAQIATGGVIDPVHSHRVPVDVAYQRGYFDEEMNRVLQDPSDDTKGFFDPNTHENLTYLQLLERCVEDPETGLRLLPLTDQAAKGGELVYTDSEARDVFEKATVSAPFGKFQGKTVTIWELINSEYFTAEQRRDLLRQFRTGKVTVEKIIKIVITVIEEHEQKGQLCFQGLRALVPAAELLESGVIDWDLFRQLQLGERSVQEVAEVEAVRRALRGSGVIAGVWLEEARQKLSIYEALKKELLQPEAAVALLEAQAGTGHVIDPATSARLTVDEAVRAGLVGPELHEKLLSAEKAVTGYKDPYSGQSVSLFQALKKGLIPREQGLRLLDAQLSTGGIVDPSKSHRLPLDVACARGYLDKETSTALTAPRDDAKTYYNPRTWEPATYSQLQQQCRPDPLTGLSLLPLSEEAARARQQELYSEVQAREAFQKATVEVPVGSFQGRAVTIWELINSEYFTAEQRQELLRQFRTGKVTVEKIIKIIITIVEEVETTRRERLSFSGLRAPVPASELLASGILSSSQFEQLKDGKTSVKDLSELDSVRTLLQGSGCLAGIYLEESKEKVTIYEAMRRGLLRPSTAILLLEAQAATGFLVDPVRNQRLYVHEAVKAGVVGPELHEKLLSAEKAVTGYKDPYSGSTISLFQAMKKGLVVREHGIRLLEAQIATGGIIDPVHSHRVPVDVAYQRGYFDKEMNRVLEDPSDDTKGFFDPNTRENLTYRQLLERCVEDPETGLRLLPLKGPEKAEVVETTRVYTEEETRRAFEETQIDIPGGGSHGGSTMSLWEVMQSDLIPEEQRAQLMADFQAGRVTKERMIIIIIEIIEKTEIVRQQNLASYDYVRRRLTAEDLHEARVISRESYSLLREGTRSLREVLEAESAWRYLYGTGCVAGVYLPGSRQTLTIYQALKKGLLSAEVARLLLEAQAATGFLLDPVKGDRLTVDEAVRKGLVGPELHDRLLSAERAVTGYRDPYTEQTISLFQAMKKDLIPAEEALRLLDAQLATGGIVDPRLGFHLPLEVAYQRGYLNKDTHDQLSEPSEVRSYIDPSTDERLSYTQLLRRCRRDEASGLFLLPLSDARKLTFRGLRKQITVEELVRSHVMDEATAQRLQEGLTSIEEVSKNLQKFLEGTSSIAGVLVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVDVAYQRGLFDEEMNEILTDPSDDTKGFFDPNTEENLTYLQLMERCVTDPQTGLRLLPLKEKKRERKTSSKSSVRKRRVVIVDPETGKEMSVYEAYRKGLIDHQTYLELSEQECEWEEITISSSDGVVKSMIIDRRSGRQYDIDEAIAKSLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPNTGERFPVTEAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVSAYSKYLTCPKTKLKISYKDALDRSMVEEGTGLRLLEAATQSSKGYYSPYSVSGSGSTTGSRSGSRTGSRAGSRRGSFDATGSGFSMTFSSSSYSSSGYGRRYASGPTSSLGGPESTAA

SEQ ID NO: 955 - protein, 142 aa, Bos taurus; identical to SEQ ID NO: 764

SEQ ID NO: 956 - protein, 297 aa, Bos taurus
MPLSGTPAPNKKRKSSKLIMELTGGGQESSGLNLGKKISVPRDVMLEELSLLTNRGSKMFKLRQLRVEKFIYENHPDVFSDSSMDRFQKFIPTVGGQLGTAGQGFSYSKSSGGGQAGRSGSAGQYGSDQQHHHQGSGSGSGSGSGPGSGGAGGPGGHSGRGGALPDNQAGGEGKHITVFKTYISPWEKAMGIDPQQKVELGIDLLAYGAKAELPKYKSFNRTAMPYGGYEKASKRMTFQMPKFDLGPLLSEPLVLYNQNLSNRPSFNRTPIPWLSSGEPVDYNVDISIPLDGETEEL

SEQ ID NO: 957 - protein, 334 aa, Bos taurus
MATLKEKLIAPVAEEETRIPNNKITVVGVGQVGMACAISILGKSLTDELALVDVLEDKLKGEMMDLQHGSLFLQTPKIVADKDYSVTANSKIVVVTAGVRQQEGESRLNLVQRNVNVFKFIIPQIVKYSPDCIIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMVVESAYEVIKLKGYTNWAIGLSVADLIESMLKNLSRIHPVSTMVKGMYGIENEVFLSLPCILNARGLTSVINQKLKDEEVAQLKKSADTLWGIQKDLKDL

SEQ ID NO: 958 - protein, 413 aa, Bos taurus
MAPPSIFAEVPQAQPVLVFKLTADFREDPDPRKVNLGVGAYRTDDSQPWVLPVVRKVEQRIANDSSINHEYLPILGLAEFRTCASRLALGDDSPALQEKRVGGVQCLGGTGALRIGAEFLARWYNGTNNKDTPVYVSSPTWENHNGVFIAAGFKDIRSYHYWDAAKRGLDLQGFLNDLEKAPEFSIFVLHACAHNPTGTDPTPEQWKQIASVMKRRFLFPFFDSAYQGFASGSLEKDAWAIRYFVSEGFELFCAQSFSKNFGLYNERVGNLTVVAKEPDSILRVLSQMEKIVRITWSNPPAQGARIVARTLSDPELFNEWTGNVKTMADRILTMRSELRARLEALKTPGTWNHITEQIGMFSFTGLNPKQVEYLINEKHIYLLPSGRINMCGLTTKNLEYVATSIHEAVTKIQ

SEQ ID NO: 959 - protein, 650 aa, Bos taurus
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGMPGGFPGGGAPPSGGASSGPTIEEVD

SEQ ID NO: 960 - protein, 164 aa, Bos taurus
MEIPVSVQPSWLRRASAPLPGLSAPGRLFDQRFGEGLLEAELAALCPAALAPYYLRAPSVALPTAQVSTDPGHFSVLLDVKHFSPEEIAVKVVGDHVEVHARHEERPDEHGYIAREFHRRYRLPPGVDPAAVTSALSPEGVLSIQAAPAPAQAPLQSPPGAAAK

SEQ ID NO: 961 - protein, 252 aa, Bos taurus
MSDAEEQEYEEEQPEEEEAAEEEEEEEERPKPSRPVVPPLIPPKIPEGERVDFDDIHRKRMEKDLLELQTLIDVHFEQRKKEEEELVALKERIERRRAERAEQQRFRTEKERERQAKLAEEKMRKEEEEAKKRAEDDAKKKKVLSNMGAHFGGYLVKAEQKRGKRQTGREMKLRILSERKKPLNIDHMGEEQLREKAQELSDWIHQLESEKFDLMAKLKQQKYEINVLYNRISHAQKFRKGAGKGRVGGRWK

SEQ ID NO: 962 - protein, 499 aa, Bos taurus
MFNYERPKHFIQSQNPCGSRLQPPGPEISSYSSQTKQSSITIQPRQCTEQRYSASSTVSSHITMSSSAFPASPQQLAGSNPAQRVTATYNQSPASFLSSILPSQPDYSSSKNPSTVDSNYQQPSVGQPINVKSSQNANAKLTPKTPDHEIQGSKEALIQDLERKLKCKDSLLHNGNQRLTYEEKMARRLLGPQNAAAVFQGQNDSEAQDSAQQHNIEHARLQVPTSQVRSRSSSRGDVNDQDAIQEKFYPPRFIQVPENMSIEEGRFCRMDFKVSGLPAPDVSWYLNGRPVQSDDFHKMIVSEKGFHSLIFEVVRASDAGAYACVAKNRAGEATFTVQLDVLAKEHRRAPMFIYKPQSKKVFEGESVKLECQISAVPPPKLFWKRNNEMVQFNTDRISLYHDNSGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 963 - protein, 620 aa, Bos taurus
VTVEDFEMVCKGLYRALCIREKYMQKSFQRFPKTPSKYLRNIDGEAWVEKENFYPVFTPPMKKGEDPFRTDNLPENLGYQLKMKDGVVYVYPNEEAASKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPEEWSKLSTWFVQNRVYCPNMTWMIQVPRIYDVFRSKNFLPHFGKMLENVFMPVFEATINPQAHPDLSVFLKHITGFDSVDDESKHSGHMFSSKSPKPQDWTMEKNPSYTYYTYYMYANIMVLNSLRKERGMNTFLFRPHCGEAGALTHLMTAFMTADNISHGLNLKKSPVLQYLFFLAQIPIAMSPLSNNSLFLEYARNPFLDFLQKGLMISLSTDDPMQFHFTKEPLMEEYAIAAQVFKLSTCDMCEVARNSVLQCGISHQEKVRFLGNNYLEEGPAGNDIRKTNVAQIRMAYRYETWCYELNLIAEGIKSGE

SEQ ID NO: 964 - protein, 730 aa, Bos taurus
MSYSVTLTGPGPWGFRLQGGKDFNMPLTISRITPGSKAAQSQLSQGDLVVAIDGVNTDTMTHLEAQNKIKSASYNLSLTLQKSKRPIPISTAAPPIQSPLPVIPHQKDPALDTNSSLAAASPHPEARAGPGTPGTPELGQIFSSSFSQTPVFSSHTEASDPGPPRGGPGAKISLEGALDSLSPKAPLGSSQPRQYNNPIGLYSAETLREMAQMYQMSRRGKASGAGLLGGADYQERFNPSALKDSALSTHKPIEVKGLGGKATIIHAQYNTPISMYSQDAIMDAIAGQAQAQGSDFSGSLPIKDLTVDSASPVYQAVIKNQNKPEDEADDWARRSSNLQSRSFRILAQMTGTEYMQDPDEEALRRSRPQASTYSPAVATSPAPAAHTYSEAPAAPAPKPRVVTTASIRPSVYQPVPASTYSPSPGANYSPTPYTPSPAPAYTPSPTPAYTPSPAPTYSPSPAPAYTPSPAPSYNPTLYSGGPAESASRPPWVTDDSFSQKFAPGKTTTTVSKQSLPRGAPAYTPPPPAPQVSPLARGTVQRAERFPASSRTPLCGHCNSIIRGPFLVAMGRSWHPEEFNCAYCKASLADVCFVEEQNNVYCERCYEQFFAPVCAKCNTKIMGEVMHALRQTWHTTCFVCAACKKPFGNSLFHMEDGEPYCEKDYVNLFSTKCHGCDFPVEAGDKFIEALGHTWHDTCFICAVCHVNLEGQPFYSKKDKPLCKKHAHAINV

SEQ ID NO: 965 - protein, 218 aa, Bos taurus
MPMILGYWDIRGLAHAIRLLLEYTDTNYEERQYSVGDAPDYDRSQWLNEKFKLGLDFPNLPYLIDGTHKLTQSNAILRYIARKHNLCGETEEEMIRVDILENQVMDVRLAMARICYSPDFEKLKPGFLKEIPEKIKLFSEFLGKRPWFAGDKLTYVDFLVYDVLDMHRIFEPKCLDAFPNLKDFISRFEGLKKISAYMKSSRFLPGPLFMKLAVWGNK

SEQ ID NO: 966 - protein, 298 aa, Bos taurus
MSDQALSFLKDFLAGGVAAAISKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGAAQREFTGLGNCITKIFKSDGLRGLYQGFNVSVQGIIIYRAAYFGVYDTAKGMLPDPKNVHIIVSWMIAQTVTAVAGLVSYPFDTVRRRMMMQSGRKGADIMYTGTVDCWRKIAKDEGPKAFFKGAWSNVLRGMGGAFVLVLYDEIKKFV

SEQ ID NO: 967 - protein, 334 aa, Bos taurus
MSEPIRVLVTGAAGQIAYSLLYSIGNGSVFGKDQPIILVLLDITPMMGVLDGVLMELQDCALPLLKDVIATDKEEIAFKDLDVAILVGSMPRRDGMERKDLLKANVKIFKCQGAALDKYAKKSVKVIVVGNPANTNCLTASKSAPSIPKENFSCLTRLDHNRAKAQIALKLGVTSDDVKNVIIWGNHSSTQYPDVNHAKVKLQGKEVGVYEALKDDSWLKGEFITTVQQRGAAVIKARKLSSAMSAAKAICDHVRDIWFGTPEGEFVSMGIISDGNSYGIPDDLLYSFPVTIKDKTWKVVEGLPINDFSREKMDLTAKELAEEKETAFEFLASA

SEQ ID NO: 968 - protein, 247 aa, Bos taurus
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQIESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 969 - protein, 283 aa, Bos taurus
MAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDVDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 970 - protein, 448 aa, Bos taurus
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 971 - protein, 1027 aa, Bos taurus
MRLPRALLPLLLQACWASAQDDPVASRAIAFQDCPVDLFFVLDTSESVALRLKPYGALVDKVKSFTKRFIDNLNDRYYRCDRNLVWNAGALHYSDEVEIIRGLTRMPSGRDELKSSVDAVKYFGKGTYTDCAIKKGLEELLVGGSHLKENKYLVVVTDGHPLEGYKEPCGGLEDAVNEAKHLGIKVFSVAITPDHLEPRLSIIATDHTYRRNFTAADWGQSRDAEEVISQTIDTITDMIKNNVEQVCCSFECQPARGPPGPRGDPGYEGERGKPGLPGEKGEAGDPGRPGDLGPVGYQGMKGEKGSRGEKGSRGPKGYKGEKGKRGMDGVDGMKGETGFPGLPGCKGSPGFDGIQGPPGPKGDPGAFGLKGQKGEPGADGEPGRPGSTGPPGDEGEPGEPGPPGEKGEAGDEGNAGPDGAPGERGGPGERGPRGTPGARGPRGDPGEAGPQGDQGREGPVGVPGDPGEAGPIGPKGYRGDEGPPGTEGPKGAPGPAGPPGDPGLMGERGEDGPPGNGTEGFPGFPGYPGSRGPPGINGTKGYPGLKGDEGEAGDPGEDNNDIAARGAKGAKGYRGPEGPQGPPGHVGPPGPDECEILDIIMKMCSCCECKCGPIDILFVLDSSESIGLQNFEIAKDFIVKVIDRLSKDELVKFEPGQSHAGVVQYSHNQMQEHVDLRDPNIRNAQDLKEAIKKLQWMGGGTFTGEALQYTRSRLLPPTPNNRIALVITDGRSDTQRDTTPLSVLCGPDIQVVSVGIKDVFGLAAGSDQLNVISCQGLAPQGRPGISLVKENYAELLDDGFLKNITAQICIDKKCPDYSCPITFSSPADITILLDGSASVGSHNFDITKRFAKRLAERFLTASRTDPGQDVRVAVVQYSGTGQQRPERAALQFLQNYTVLANTVDSMDFFNDATDVMDALGYVTRFYREASSNAAKKRLLLFSDGNSQGATPAAIEKAVQEAQRAGVEIFAVVVGRQVNEPHVRVLVTGKAAEYDVVFGERHLFRVPSYQALLRGVFYQTVSRKVALD

SEQ ID NO: 972 - protein, 136 aa, Bos taurus
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 973 - protein, 189 aa, Bos taurus
MASKRALVILAKGAEEMETVIPVDVMRRAGIKVTVAGLAGKDPVQCSRDVVICPDASLEDAKKEGPYDVVVLPGGNLGAQNLSESAAVKEILKEQEKRKGLIAAICAGPTALLAHEIGFGSKVTTHPLAKDKMMNGSHYSYSENRVEKDGLILTSRGPGTSFEFALKIVEVLVGKEVADQVKAPLVLKD

SEQ ID NO: 974 - protein, 224 aa, Bos taurus
MPGGLLLGDEAPNFEANTTIGRIRFHDYLGDSWGILFSHPRDFTPVCTTELGRAAKLAPEFAKRNVKMIALSIDSVEDHLAWSKDINAYNGEEPTEKLPFPIIDDKNRDLAIQLGMLDPAEKDEKGMPVTARVVFIFGPDKKLKLSILYPATTGRNFDEILRVIISLQLTAEKRVATPVDWKNGDSVMVLPTIPEEEAKKLFPKGVFTKELPSGKKYLRYTPQP

SEQ ID NO: 975 - protein, 255 aa, Bos taurus
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 976 - protein, 325 aa, Bos taurus
MFLQSRVSRLLAQLRAAGQLLGAPRPWPGPSPGATRTRSSACGPPASLSAHHPRARTSAGVGAWGAAAVGRRAGVRTWAPLAMAAKVDLSTSTDWKEAKSFLKGLSDKQREEHYFCRDFVRLKKIPTWKETAKGVTVKVEEPKYKKDKQLNEKISLFRGDITKLEVDAIVNAANSSLLGGGGVDGCIHRAAGPLLTDECRTLQNCETGKAKITCGYRLPAKYVIHTVGPIAHGEPSASQAAELRSCYLSSLDLLLEHRLRSAAFPCISTGVFGYPNEAAAEVVLTALREWLEQHKDKVDRLIICVFLEKDENIYRERLPHYFPVA

SEQ ID NO: 977 - protein, 480 aa, Bos taurus
MAASAVCRAAGAGTRVLLRTRRSPALLRSSDLRGTATYAQALQSVPETQVSQLDNGLRVASEQSSQPTCTVGVWIDAGSRYESEKNNGAGYFVEHLAFKGTKNRPGNALEKEVESMGAHLNAYSTREHTAYYIKALSKDLPKAVELLADIVQNCSLEDSQIEKERDVILQELQENDTSMRDVVFNYLHATAFQGTPLAQSVEGPSENVRKLSRADLTEYLSRHYKAPRMVLAAAGGLEHRQLLDLAQKHFSGLSGTYDEDAVPTLSPCRFTGSQICHREDGLPLAHVAIAVEGPGWAHPDNVALQVANAIIGHYDCTYGGGAHLSSPLASIAATNKLCQSFQTFNICYADTGLLGAHFVCDHMSIDDMMFVLQGQWMRLCTSATESEVLRGKNLLRNALVSHLDGTTPVCEDIGRSLLTYGRRIPLAEWESRIAEVDARVVREVCSKYFYDQCPAVAGFGPIEQLPDYNRIRSGMFWLRF

SEQ ID NO: 978 - protein, 493 aa, Bos taurus
PAMSAAPGLLHQELSCPLCLQLFDAPVTAECGHSFCRACLSRVAGEPAADGTVLCPSCQAPTRPQALSTNLQLARLVEGLAQVPQGHCEEHLDPLSIYCEQDRALVCGVCASLGSHRGHRLLPAAEAHARLKERLSSSIFICKKRMRDKKPGVGQNTWVLGEEEGFVWFVHAEEDIFIQLPTLRTRETLAALEGSLDREAERVRGEAGVALRRELGSLNSYLEQLRQMEKVLEEVADKPQTEFLMKYCLVTSSWTLSQEKALKKYCKPNPNRRALNQDDFKFQVWRKMFRALMPVAARQELTFDPSTAHPSLVLSNSGRCVECSEQKAPPAGEDPRQFDKAVAVVTHQLLSEGEHYWEVEVGDKPRWALGVIGAQAGRRGRLHAVPSQGLWLLGLRDGKILEAHVEAKEPRALRTPERRPTRIGIYLSFGDGVLSFYDASDPDALELLFAFHERLPGPVYPFFDVCWHDKGKNAQPLLLVGPEPPGPFRLGGP

SEQ ID NO: 979 - protein, 103 aa, Bos taurus [sequence omitted]

SEQ ID NO: 980 - protein, 106 aa, Bos taurus
MTTDQQAEARSYLSEEMIAEFKAAFDMFDADGGGDISVKELGTVMRMLGQTPTKEELDAIIEEVDEDGSGTIDFEEFLVMMVRQMKEDAKGKTEEELAECFRIFDR

SEQ ID NO: 981 - protein, 129 aa, Bos taurus
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHKAKSK

SEQ ID NO: 982 - protein, 126 aa, Bos taurus
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 983 - protein, 199 aa, Bos taurus
MSSGNAKIGHRAPQFKATAVMPDGQFKDISLADYKGKYVVFFFYPLDFTFVCPTEIIAFSDRAEEFKKLNCQVIGASVDSHFCHLAWINTPKKQGGLGPMNIPLISDPKRTIAQDYGVLKADEGISFRGLFIIDDKGILRQITINDLPVGRSVDETLRLVQAFQFTDKHGEVCPAGWKPGSDTIKPDVQKSKEYFSKQK

SEQ ID NO: 984 - protein, 213 aa, Bos taurus
MAALAVSGLSQQVRCFSTSVVRPFAKLVRPPVQIYGIEGRYATALYSAASKQNKLEQVEKELLRVGQILKEPKMAASLLNPYVKRSVKVKSLSDMTAKEKFSPLTSNLINLLAENGRLTNTPAVISAFSTMMSVHRGEVPCTVTTASALDEATLTELKTVLKSFLSKGQVLKLEVKIDPSIMGGMIVRIGEKYVDMSAKTKIQKLSRAMREIL

SEQ ID NO: 985 - protein, 210 aa, Bos taurus
MPPYTIVYFPVQGRCEAMRMLLADQGQSWKEEVVAMQSWLQGPLKASCLYGQLPKFQDGDLTLYQSNAILRHLGRTLGLYGKDQQEAALVDMVNDGVEDLRCKYVSLIYTNYEAGKEDYVKALPQHLKPFETLLSQNKGGQAFIVGDQISFADYNLLDLLRIHQVLAPSCLDSFPLLSAYVARLNSRPKLKAFLASPEHMNRPINGNGKQ

SEQ ID NO: 986 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 987 - protein, 234 aa, Bos taurus
MSNYSVSLVGPAPWGFRLQGGKDFNMPLTISSLKDGGKASQANVRIGDVVLSIDGISAHGMTHLEAQNKIKGCTGSLNMTLQRASATPKLEPVPVQKPTVTSVCAETAQELAEGQRRGSQGDSKQQNGKIPPKRPPRKHIMDRNTEFYHIPTHSDASKKRLIEDTEDWRPRTGTTQSRSFRILAQITGTEHLKESEADNTKKAKEKIPLHVFSPKYTKLRDWHHEVSARALNVQ

SEQ ID NO: 988 - protein, 274 aa, Bos taurus
MLSVAARSGPFAPVLSATSRGVAGALRPLVQAAVPATSESPVLDLKRSVLCRESLRGQAAGRPLVASVSLNVPASVRYSHTDIKVPDFSDYRRPEVLDSTKSSKESSEARKGFSYLVTATTTVGVAYAAKNVVSQFVSSMSASADVLAMSKIEIKLSDIPEGKNMAFKWRGKPLFVRHRTKKEIDQEAAVEVSQLRDPQHDLERVKKPEWVILIGVCTHLGCVPIANAGDFGGYYCPCHGSHYDASGRIRKGPAPLNLEVPSYEFTSDDMVIVG

SEQ ID NO: 989 - protein, 280 aa, Bos taurus; identical to SEQ ID NO: 608

SEQ ID NO: 990 - protein, 316 aa, Bos taurus
MPQNVVLPGPAPWGFRLSGGIDFNQPLVITRITPGSKAAAANLCPGDVILAIDGFGTESMTHADAQDRIKAAGHQLCLKIDRAEARLWSPQVTEDGKAHPFKINLESEPQEFKPIGAAHNRRAQPFVAAANIDDKRQVVSASYNSPIGLYSTSNIQDALHGQLRGLIPSSPQNEPTASVPPESDVYRMLHDNRNEPTQPRQSGSFRVLQELVNDGADDRPAGTRSVRAPVTKVHGGAGGTQKMPFCDKCGSGIVGAVVKARDKYRHPECFVCADCNLNLKQKGYFFVEGELYCETHARARMRPPEGYDTVTLYPKA

SEQ ID NO: 991 - protein, 339 aa, Bos taurus; identical to SEQ ID NO: 727

SEQ ID NO: 992 - protein, 453 aa, Bos taurus
MKLLTRAGSLSRFYSLKVAPKVKATEAPAGVPPHPQDLEFTRLPNGLVIASLENYAPASRIGLFIKAGSRYENSNNLGTSHLLRLASSLTTKGASSFKITRGIEAVGGKLSVTSTRENMAYTVECLRDDVDILMEFLLNVTTAPEFRRWEVAALQPQLRIDKAVALQNPQAHVIENLHAAAYRNALANSLYCPDYRIGKVTPVELHDYVQNHFTSARMALIGLGVSHPVLKQVAEQFLNIRGGLGLSGAKAKYHGGEIREQNGDSLVHAALVAESAAIGSAEANAFSVLQHVLGAGPHVKRGSNATSSLYQAVAKGVHQPFDVSAFNASYSDSGLFGFYTISQAASAGDVIKAAYNQVKTIAQGNLSNPDVQAAKNKLKAGYLMSVESSEGFLDEVGSQALAAGSYTPPSTVLQQIDAVADADVINAAKKFVSGRKSMAASGNLGHTPFIDEL

SEQ ID NO: 993 - protein, 455 aa, Bos taurus
MLSRSRCASRAFSRSLSAFQKGNCPLVRRSLPGISLCQGPGYPDSRKTVINSSNIFSVRFFRTTAVCKDDVITVKTPAFAESVTEGDVRWEKAVGDTVAEDEVVCEIETDKTSVQVPSPANGVIEALLVPDGGKVEGGTPLFTLRKTGAAPAKAKPAAAPAAAAPKAEPTVSAVPPPPAAPIPTQMPPVPSPSQPLTSKPVSAVKPTAAPPRAEAGAGVGLRSEHREKMNRMRQRIAQRLKEAQNTCAMLTTFNEIDMSNIQEMRARHKDAFLKKHNLKLGFMSAFVKASAFALQEQPVVNAVIDDATKEVVYRDYIDISVAVATPRGLVVPVIRNVETMNYADIERTISELGEKARKNELAIEDMDGGTFTISNGGVFGSLFGTPIINPPQSAILGMHAIVDRPVVIGGKVEVRPMMYVALTYDHRLIDGREAVTFLRKIKAAVEDPRVLLLDL

SEQ ID NO: 994 - protein, 463 aa, Bos taurus
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 995 - protein, 466 aa, Bos taurus
MALLTAAARLFGAKNASCLVLAARHASASSTNLKDILADLIPKEQTRVKAFRQQHGKTVVGQITVDMMYGGMRGMKGLVYETSVLDPDEGIRFRGYSIPECQKLLPKAKGGEEPLPEGLFWLLVTGQIPTEEQVSWLSQEWAKRAALPSHVVTMLDNFPTNLHPMSQLSAAVTALNSESTFARAYSEGINRTKYWELIYEDSMDLIAKLPCVAAKIYRNLYREGSSIGAIDPKLDWSHNFTNMLGYTDAQFTELMRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPQDPMFKLVAQLYKIVPNILLEQGKAKNPWPNVDAHSGVLLQYYGMTEMNYYTVLFGVSRALGVLAQLIWSRALGFPLERPKSMSTDGLMKFVDSKSG

SEQ ID NO: 996 - protein, 647 aa, Bos taurus
MWRVCARRAQNAAPRAGFGARWTAFREEPGAPCVTPQAGSALARCSSKTPGYGRVRALCGWSPVSRATPRNRVLLQLWGSPSRRWYSLPPHQKVPLPSLSPTMQAGTIARWEKKEGEKINEGELIAEVETDKATVGFESVEECYMAKILVAEGTRDVPVGAIICITVDKPEDVEAFKNYTLDSSAAPAPPAAPAPTPAAPAPSPTPSAQAPGSSYPTHMQVLLPALSPTMTMGTVQRWEKKVGEKLNEGDLLAEIETDKATIGFEVQEEGYLAKILIPEGTRDVPLGTPLCIIVEKEADIPAFADYRPAEVTDLKPPAPPPIPSPAAPVPPAPQPVAPPPSAPRPAAPAGPKGRVFVSPLAKKLAAEKGIDLTQVKGTGPDGRIIKKDIDSFVPTKAAPTPAAAVPPPSPGVAPVPTGVFTDIPISNIRRVIAQRLMQSKQTIPHYYLSIDVNMGEVLLVRKELNKMLEGKSKISVNDFIIKASALACLKVPEANSSWMDTVIRQNHVVDISVAVSTPAGLITPIVFNAHIKGLETIANDVVSLATKAREGKLQPHEFQGGTFTISNLGMFGIKNFSAIINPPQACILAIGASEDRLVPADNEKGFDVASMMSVTLSCDHRVVDGAVGAQWLAEFRKYLEKPITMLL

SEQ ID NO: 997 - protein, 673 aa, Bos taurus
MAKPAQGAKYRGSIRDFPDFNPSQDAETLYNAMKGFGSDKEAILELITSRSNRQRQEICQNYKSLYGKDLIADLKYELTGKFERLIVGLMRPPAYADAKEIKDAISGIGTDEKCLIEILASRTNEQIHQLVAAYKDAYERDLEADITGDTSGHFRKMLVVLLQGTREEDDVVSEDLVQQDVQDLYEAGELKWGTDEAQFIYILGNRSKQHLRLVFDEYLKTTGKPIEASIRGELSGDFEKLMLAVVKCIRSTAEYFAERLFKAMKGLGTRDNTLIRIMVSRSELDMLDIREIFRTKYEKSLYSMIKNDTSGEYKKTLLKLCGGDDDAAGQFFPEAAQVAYQMWELSAVARVELKGTVRPAGDFNPDADAKALRKAMKGLGTDEDTIIDIIAHRSNAQRQQIRQTFKSHFGRDLMADLKSELSGDLARLILGLMMPPAHYDAKQLKKAMEGAGTDEKALIEILATRTNAEIQAINKAYKEDYHKSLEDALSSDTSGHFKRILISLATGNREEGGEDRERAREDAQVAAEILEIADTTSGDKSSLETRFMMILCTRSYPHLRRVFQEFIKMTNYDVEHTIKKEMSGDVRDVFVAIVQSVKNKPLFFADKLYKSMKGAGTDEKTLTRIMVSRSEIDLLNIRREFIEKYDKSLHQAIEGDTSGHFLKALLAICGGED

SEQ ID NO: 998 - protein, 780 aa, Bos taurus
MAPYSLLVSRLQKALGARQYHVASVLCQRAKVAMSHFEPNEYIRYDLLEKNINIVRKRLNRPLTLSEKIVYGHLDDPANQEIERGKTYLRLRPDRVAMQDATAQMAMLQFISSGLPKVAVPSTIHCDHLIEAQLGGEKDLRRAKDINQEVYNFLATAGAKYGVGFWRPGSGIIHQIILENYAYPGVLLIGTDSHTPNGGGLGGICIGVGGADAVDVMAGIPWELKCPKVIGVKLTGSLSGWTSPKDVILKVAGILTVKGGTGAIVEYHGPGVDSISCTGMATICNMGAEIGATTSVFPYNHRMKKYLSKTGRADIANLADEFKDHLVPDSGCHYDQLIEINLSELKPHINGPFTPDLAHPVAEVGSVAEKEGWPLDIRVGLIGSCTNSSYEDMGRSAAVAKQALAHGLQCKSQFTITPGSEQIRATIERDGYAQILRDVGGIVLANACGPCIGQWDRKDIKKGEKNTIVTSYNRNFTGRNDANPETHAFVTSPEIVTALAIAGTLKFNPETDFLTGKDGKKFKLEAPDADELPRAEFDPGQDTYQHPPKDSSGQQVDVSPTSQRLQLLEPFDKWDGRDLEDLQILIKVKGKCTTDHISAAGPWLKFRGHLDNISNNLLIGAINVENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIKGLKDFAPGKPLTCIIKHPNGTQETILLNHTFNETQIEWFRAGSALNRMKELQK

SEQ ID NO: 999 - protein, 733 aa, Bos taurus
MPEETQAQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESDDKPEIEDVGSDEEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDSSAAVTEEMPPLEGDDDTSRMEEVD

SEQ ID NO: 1000 - protein, 1442 aa, Bos taurus
MTLPHSPGGVGEPRPPQAMQVHRREHRREEEQKEERQHSLQMDSSMRKRTFRSRGSEEEYQFSAADYALAAALALTASSETTWEAQLRRQTSTVELEERGQKRVGFGNDWERTEIAFLRTQWLLRQRRDRKALRRRTEEKVREAKELRELCSGRGPWFWIPLRSHAVWEHTTVLLTCTVQGSPPPQVTWYKNDVRIDPRLFPAGKYRITNNYGLLTLEIRRCTIEDAATYTVKVKNAYGQASSFAKVLVRTYLGKDAGFDSEMFKRLMFGPSVDFTSVLKPVFAREKETFSLKCLFSEDVLDAEQNIQWFRDGRLLRSSGRRQILYADRQAVLKVACAYKEDEGLYTVQVPSPFGLQEQSAYVFVRDAAAEKPGVPGSPLNVRCLNVNRDCLILTWTPPSDTRGNPITGYSIELCQGESEEWVPCHQAPGGTCRCPIQGLIEGQSYRFRVRAINRAGSSVPSKASEPVVMGDRDEAQRKTEIPFDMGKSITVSTDDFDDFVTIPSPPTNVHGSEIREAYVVLAWEEPRPRGKAPLTYFLEKSVIGSGTWEAVNSEAPVKSPRFALLDLEKGKSYVFRVRAINQYGMSDPSEPSEPIALRGKPATLPPPTQVQAFRDTQTSVSLTWDPVKDSPELLGYYIYSREAGSSEWRTVNNKPIQGSRFTIPGLRTGKEYEFCIRSVSEAGVGESSAVTEPIRVKQALATPSAPYDFALLNCGKNEMVIGWKPPKRRGGGKILGYFLDQHDSEELDWHEVNQQPVPTQICKVSNLHEGHFYEFRARAVNWAGVGELSAPSKLFECKEWTMPQPGPPYDLRVSEVRATSLMLAWEPPLYRGAGPVTGYRISVQEEGSEQWKPVTPDLISDTHLRISDLQPGKTYMFQVQAVNSAGPGQPSMPTDPVLLEDKPDAREIEVGVDDEGFIYMAFEAPEAPDSAEFQWSKDYKGPPDPERVKVEEEANKSKIILKDPGLEDLGTYSVVVTDADEDISASHTLTEDELNKLKKLSHEIRNPVIKLISGWNVEILEQGEVRLWLEVEKLSPAAELHLIFNEKEIFSSPNRKINFVREKGLVEVIIQHLTEDDKGSYTAQLQDGKAKNQITLALVDDEFDKLLRAADAKRRDWKRKQGPYFVEPLQWKVTDDCQVLLTCKVTNTKKETRFQWFFQKREFPAGQYDPQTGAGLLCIEELSKEDQGVYRAQVSDDRGEDDTILDLRDEALDAIFTELGRIGALSATPLKRSGVRDSARGRVANRDSARAQALMNDEWMSGEKRLESGDRVRAGTTLDEIWLHILDPKDSDKGKYILEITAGKEVRQLSADLSGQAFEDAMAEHQRLKALAIIEKNRAKVVRGLPDVATIMEDKTLCLTCVVSGDPAPEIYWLKNDQPVTFLDRYHMDVKGTEVTITIERVNSEDSGRYGVFVKNKYGSETGQVTISVFKHGEEEKVLKM

SEQ ID NO: 1001 - protein, 705 aa, Gallus gallus
MKLILCTVLSLGIAAVCFAAPPKSVIRWCTISSPEEKKCNNLRDLTQQERISLTCVQKATYLDCIKAIANNEADAISLDGGQAFEAGLAPYKLKPIAAEVYEHTEGSTTSYYAVAVVKKGTEFTVNDLQGKTSCHTGLGRSAGWNIPIGTLLHRGAIEWEGIESGSVEQAVAKFFSASCVPGATIEQKLCRQCKGDPKTKCARNAPYSGYSGAFHCLKDGKGDVAFVKHTTVNENAPDQKDEYELLCLDGSRQPVDNYKTCNWARVAAHAVVARDDNKVEDIWSFLSKAQSDFGVDTKSDFHLFGPPGKKDPVLKDLLFKDSAIMLKRVPSLMDSQLYLGFEYYSAIQSMRKDQLTPSPRENRIQWCAVGKDEKSKCDRWSVVSNGDVECTVVDETKDCIIKIMKGEADAVALDGGLVYTAGVCGLVPVMAERYDDESQCSKTDERPASYFAVAVARKDSNVNWNNLKGKKSCHTAVGRTAGWVIPMGLIHNRTGTCNFDEYFSEGCAPGSPPNSRLCQLCQGSGGIPPEKCVASSHEKYFGYTGALRCLVEKGDVAFIQHSTVEENTGGKNKADWAKNLQMDDFELLCTDGRRANVMDYRECNLAEVPTHAVVVRPEKANKIRDLLERQEKRFGVNGSEKSKFMMFESQNKDLLFKDLTKCLFKVREGTTYKEFLGDKFYTVISSLKTCNPSDILQMCSFLEGK

SEQ ID NO: 1002 - protein, 703 aa, Gallus gallus
MKLILCTVLSLGIAAVCFAAPPKSVIRWCTISSPEEKKCNNLRDLTQQERISLTCVQKATYLDCIKAIANNEADAISLDGGQVFEAGLAPYKLKPIAAEVYEHTEGSTTSYYAVAVVKKGTEFTVNDLQGKTSCHTGLGRSAGWNIPIGTLIHRGAIEWEGIESGSVEQAVAKFFSASCVPEWELSSSILPRLRTTMSVRCWFFNISPASSTHSCLKDGKGDVAFVKHTTVNENAPDQKDEYELLCLDGSRQPVDNYKTCNWARVAAHAVVARDDNKVEDIWSFLSKAQSDFGVDTKSDFHLFGPPGKKDPVLKDLLFKDSAIMLKRVPSLMDSQLYLGFEYYSAIQSMRKDQLTPSPRENRIQWCAVGKDEKSKCDRWSVVSNGDVECTVVDETKDCIIKIMKGEADAVALDGGLVYTAGVCGLVPVMAERYDDESQCSKTDERPASYFAVAVARKDSNVNWNNLKGKKSCHTAVGRTAGWVIPMGLIHNRTGTCNFGESGRTGCSFHSNLLSAFSTLCQGSGIPPERCVASSHEKYFGYTGALRCLVEKGDVAFVQHSTVEENTGGKNKADWAKNLQMDDFELLCTDGRRANVMDYRECNLAEVPTHAVVVRPEKANKIRDLLERQEKRFGVNGSEKSKFMMFESQNKDLLFKDLTKCLFKVREGTTYKEFLGDKFYTVISSLKTCNPSDILQMCSFLEGK

SEQ ID NO: 1003 - protein, 2108 aa, Gallus gallus
MEIKKERSFWIFCLIWSFCKGKEPVQIVQVSTVGRSECTTWGNFHFHTFDHVKFTFPGTCTYVFASHCNDSYQDFNIKIRRSDKNSHLIYFTVTTDGVILEVKETGITVNGNQIPLPFSLKSILIEDTCAYFQVTSKLGLTLKWNWADTLLLDLEETYKEKICGLCGNYDGNKKNDLILDGYKMHPRQFGNFHKVEDPSEKCPDVRPDDHTGRHPTEDDNRCSKYKKMCKKLLSRFGNCPKVVAFDDYVATCTEDMCNCVVNSSHSDLVSSCICSTLNQYSRDCVLSKGDPGEWRTKELCYQECPSNMEYMECGNSCADTCADPERSKICKAPCTDGCFCPPGTILDDLGGKKCVPRDSCPCMFQGKVYSSGGTYSTPCQNCTCKGGHWSCTSLPCSGSCSIDGGFHITTFDNKKFNFHGNCHYVLAKNTDDTFVVIGEIIQCGTSKTMTCLKNVLVTLGRTTIKICSCGSIYMNNFIVKLPVSKDGITIFRPSTFFIKILSSTGVQIRVQMKPVMQLSITVDHSYQNRTSGLCGNFNNIQTDDFRTATGAVEDSAAAFGNSWKTRASCFDVEDSFEDPCSNSVDKEKFAQHWCALLSNISSTFAACHSVVDPSVYIKRCMYDTCNAEKSEVALCSVLSTYSRDCAAAGMTLKGWRQGICDPSEECPETMVYNYSVKYCNQSCRSLDEPDPLCKVQIAPMEGCGCPEGTYLNDEEECVTPDDCPCYYKGKIVQPGNSFQEDKLLCKCIQGRLDCIGETVLVKDCPAPMYYFNCSSAGPGAIGSECQKSCKTQDMHCYVTECVSGCMCPDGLVLDGSGGCIPKDQCPCVHGGHFYKPGETIRVDCNTCTCNKRQWNCTDSPCKGTCTVYGNGHYMSFDGEKFDFLGDCDYILAQDFCPNNMDAGTFRIVIQNNACGKSLSICSLKITLIFESSEIRLLEGRIQEIATDPGAEKNYKVDLRGGYIVIETTQGMSFMWDQKTTVVVHVTPSFQGKVCGLCGDFDGRSRNDFTTRGQSVEMSIQEFGNSWKITSTCSNINMTDLCADQPFKSALGQKHCSIIKSSVFEACHSKVNPIPYYESCVSDFCGCDSVGDCECFCTSVAAYARSCSTAGVCINWRTPAICPVFCDYYNPPDKHEWFYKPCGAPCLKTCRNPQGKCGNILYSLEGCYPECSPDKPYFDEERRECVSLPDCTSCNPEEKLCTEDSKDCLCCYNGKTYPLNETIYSQTEGTKCGNAFCGPNGMIIETFIPCSTLSVPAQEQLMQPVTSAPLLSTEATPCFCTDNGQLIQMGENVSLPMNISGHCAYSICNASCQIELIWAECKVVQTEALETCEPNSEACPPTAAPNATSLVPATALAPMSDCLGLIPPRKFNESWDFGNCQIATCLGEENNIKLSSITCPPQQLKLCVNGFPFMKHHDETGCCEVFECQCICSGWGNEHYVTFDGTYYHFKENCTYVLVELIQPSSEKFWIHIDNYYCGAADGAICSMSLLIFHSNSLVILTQAKEHGKGTNLVLFNDKKVVPDISKNGIRITSSGLYIIVEIPELEVYVSYSRLAFYIKLPFGKYYNNTMGLCGTCTNQKSDDARKRNGEVTDSFKEMALDWKAPVSTNRYCNPGISEPVKIENYQHCEPSELCKIIWNLTECHRVVPPQPYYEACVASRCSQQHPSTECQSMQTYAALCGLHGICVDWRGQTNGQCEATCARDQVYKPCGEAKRNTCFSREVIVDTLLSRNNTPVFVEGCYCPDGNILLNEHDGICVSVCGCTAQDGSVKKPREAWEHDCQYCTCDEETLNISCFPRPCAKSPPINCTKEGFVRKIKPRLDDPCCTETVCECDIKTCIINKTACDLGFQPVVAISEDGCCPIFSCIPKGVCVSEGVEFKPGAVVPKSSCEDCVCTDEQDAVTGTNRIQCVPVKCQTTCQQGFRYVEKEGQCCSQCQQVACVANFPFGSVTIEVGKSYKAPYDNCTQYTCTESGGQFSLTSTVKVCLPFEESNCVPGTVDVTSDGCCKTCIDLPHKCKRSMKEQYIVHKHCKSAAPVPVPFCEGTCSTYSVYSFENNEMEHKCICCHEKKSHVEKVELVCSEHKTLKFSYVHVDECGCVETKCPMRRT

SEQ ID NO: 1004 - protein, 388 aa, Gallus gallus
MDSISVTNAKFCFDVFNEMKVHHVNENILYCPLSILTALAMVYLGARGNTESQMKKVLHFDSITGAGSTTDSQCGSSEYVHNLFKELLSEITRPNATYSLEIADKLYVDKTFSVLPEYLSCARKFYTGGVEEVNFKTAAEEARQLINSWVEKETNGQIKDLLVSSSIDFGTTMVFINTIYFKGIWKIAFNTEDTREMPFSMTKEESKPVQMMCMNNSFNVATLPAEKMKILELPYASGDLSMLVLLPDEVSGLERIEKTINFDKLREWTSTNAMAKKSMKVYLPRMKIEEKYNLTSILMALGMTDLFSRSANLTGISSVDNLMISDAVHGVFMEVNEEGTEATGSTGAIGNIKHSLELEEFRADHPFLFFIRYNPTNAILFFGRYWSP

SEQ ID NO: 1005 - protein, 147 aa, Gallus gallus; identical to SEQ ID NO: 814

SEQ ID NO: 1006 - protein, 210 aa, Gallus gallus
MAMAGVFVLFSFVLCGFLPDAAFGAEVDCSRFPNATDKEGKDVLVCNKDLRPICGTDGVTYTNDCLLCAYSIEFGTNISKEHDGECKETVPMNCSSYANTTSEDGKVMVLCNRAFNPVCGTDGVTYDNECLLCAHKVEQGASVDKRHDGGCRKELAAVSVDCSEYPKPDCTAEDRPLCGSDNKTYGNKCNFCNAVVESNGTLTLSHFGKC

SEQ ID NO: 1007 - protein, 472 aa, Gallus gallus
MRTARQFVQVALALCCFADIAFGIEVNCSLYASGIGKDGTSWVACPRNLKPVCGTDGSTYSNECGICLYNREHGANVEKEYDGECRPKHVTIDCSPYLQVVRDGNTMVACPRILKPVCGSDSFTYDNECGICAYNAEHHTNISKLHDGECKLEIGSVDCSKYPSTVSKDGRTLVACPRILSPVCGTDGFTYDNECGICAHNAEQRTHVSKKHDGKCRQEIPEIDCDQYPTRKTTGGKLLVRCPRILLPVCGTDGFTYDNECGICAHNAQHGTEVKKSHDGRCKERSTPLDCTQYLSNTQNGEAITACPFILQEVCGTDGVTYSNDCSLCAHNIELGTSVAKKHDGRCREEVPELDCSKYKTSTLKDGRQVVACTMIYDPVCATNGVTYASECTLCAHNLEQRTNLGKRKNGRCEEDITKEHCREFQKVSPICTMEYVPHCGSDGVTYSNRCFFCNAYVQSNRTLNLVSMAAC

SEQ ID NO: 1008 - protein, 1454 aa, Gallus gallus
MWLKFILAILLLHAAAGKEPEPQYVLMVPAVLQSDSPSQVCLQFFNLNQTISVRVVLEYDTINTTIFEKNTTTSNGLQCLNFMIPPVTSVSLAFVSFTAKGTTFDLKERRSVMIWNMESFVFVQTDKPIYKPGQSVMFRVVALDFNFKPVQEMYPLIAVQDPQNNRIFQWQNVTSEINIVQIEFPLTEEPILGNYKIIVTKKSGERTSHSFLVEEYVLPKFDVTVTAPGSLTVMDSELTVKICAVYTYGQPVEGKVQLSVCRDFDSYGRCKKSPVCQSFTKDLDTDGCLSHILSSKVFELNRIGYKRNLDVKAIVTEKGTGLQLTATQSISITQVMSSLQFENVDHHYRRGIPYFGQIKLVDKDNSPISNKVIQLFVNNKNTHNFTTDINGIAPFSIDTSKIFDPELSLKALYKTSDQCHSEGWIEPSYPDASLSVQRLYSWTSSFVRIEPLWKDMSCGQKRMITVYYILNTEGYEHINIVNFYYVGMAKGKIVLTGEIKVNIQADQNGTFMIPLVVNEKMAPALRLLVYMLHPAKELVADSVRFSIEKCFKNKVQLQFSEKQMLTTSNVSLVIEAAANSFCAVRAVDKSMLLLKSETELSAETIYNLHPIQDLQGYIFNGLNLEDDPQDPCVSSDDIFHKGLYYRPLTSGLGPDVYQFLRDMGMKFFTNSKIRQPIVCTRETVRPPSYFLNAGFTASTHHVKLSAEVAREERGKRHILETIREFFPETWIWDIILINSTGKASVSYTIPDTITEWKASAFCVEELAGFGMSVPATLTAFQPFFVDLTLPYSIIHGEDFLLRANVFNYLNHCIKINVLLLESLDYQAKLISPEDDGCVCAKIRKSYVWNIFPKGTGDVLFSITAETNDDEACEEEALRNIRIDYRDTQIRALLVEPEGIRREETQNFLICMKDDVISQDVAIDLPTNVVEGSPRPSFSVVGDIMGTAIQNVHQLLQMPFGNGEQNMVLFAPNIYVLDYLDKTRQLSEDMKSKTIGYLVSGYQKQLSYKHPDGSYSTFGIRDKEGNTWLTAFVYKSFAEASRFIYIDDNVQAQTLIWLARKQKTDGCFQSTGILVNNAMKGGVENELSLSAYITIALLEAGHSVSHTVIRNAFYCLETASEKNITDIYTQALVAYAFCLAGKAEICESFLRELQKSAKEVDGSKYWEQNQRSAPEKSHLLDHVQSTDVEITSYVLLALLYKPNRSQEDLTKASAIVQWIIRQQNSYGGFASMQDTVVALQALAAYGAATYNSVTQNVIKINSKNTFEKVFTVNNENRLLLQQTPLPQVPGKYSLTVNGTGCVLIQTALRYNIHLPEGAFGFSLSVQTSNASCPRDQPGKFDIVLISSYTGKRSSSNMVIIDVKMLSGFVPVKSSLDQLIDDHTVMQVEYKKNHVLLYLGNILQKRRKEVTFSVEQDFVVTHPKPAPVQIYDYYETEEYAVAEYMSLCRGVVEEMG

SEQ ID NO: 1009 - protein, 935 aa, Gallus gallus
LKGFFSIPVTFSSVYAPTSTLIVYVIFPNGKTIADSAVFSVSMCFRNKAELSFSVPKILPGSEVNLHLQAAPGSTCAVWAVDQTVFLLKPEKELSHSMIYGLFPSIPSTYSGYPHQVSEDDNSCGFQNSDQPDVFTAFRGEVSSASVLFFFFFFLQEMGLKIMSNTNIRKPRLCLTTQSTTMMQERAGHLMTSTYQPTMFSPVSSPEEKVHKYFTKTWLWDLYSVGPSGKQTVTVTVPNTITGWKAGMFCTGHNGFGLAPTSSLLVFKPFSVELTLPSSVIQGETFILKATVLSYLQQCMKIQVTMEEFPQFQLKSCEGCVYSSCLCAGEVKTFLWSVTAERLGFTNITLSTEAIATKELCGKEIPFVPNQGQKDTITKLLLVRPEGVLIEKAHSSILCPKKGSPAEESVSLTLPPNTVEGSVRATVSVTGDLMGTALQNLDHLVQMPHGCGEQNMVLFAPIVYMLQYLEKTRQLTPEIKERATGFLRNGYQIQLQYQHPDGSFSEFGTKDEYGNTWLTAFVVKCFAQAKPYIFLDDRSIQAAFNWLEFHQLPNGCFRDVGQLFHTAMKGGMDGEVLLAAYITAAYMERGDTPESTVVRKALGCIIPSLPKATSTYTQALLAYTFALAKDPQRTQELLDILDEKAIRAGGQIHWSQTPSKAHSTSLWSQPLSVDVELTAYVLLALLSKPNVTEADFTIASGIVAWLTRQQNAYGGFASTQDTVVALQALAKYAALTHNTKGVAEVRVRSQRGSGRKFQVSYHNRLLVQEMALREIPGKFSVQAHGSCCVFTRTVLRYNIPFPQVSKSFALQVKTKPDNCTEDDAYSVTLYVNVRYTGKRAISNMVIVEVSLLSGFVLAARSGMSVRGLEYPVRRTEKTQAGVAIYLDKLSHVSETYVLHLEREIEVTNLKPGQVRVYDYYHPEEQALADYNVSCI

SEQ ID NO: 1010 - protein, 232 aa, Gallus gallus
QIKDLLVSSSTDLDTTLVLVNAIYFKGMWKTAFNAEDTREMPFHVTKQESKPVQMMCMNNSFNVATLPAEKMKILELPFASGDLSMLVLLPDEVSDLERIEKTINFEKLTEWTNPNTMEKRRVKVYLPQMKIEEKYNLTSVLMALGMTDLFIPSANLTGISSAESLKISQAVHGAFMELSEDGIEMAGSTGVIEDIKHSPESEQFRADHPFLFLIKHNPTNTIVYFGRYWSP

SEQ ID NO: 1011 - protein, 203 aa, Gallus gallus
MEKALHFDSIAGLGGSTQTKCGKSVNIHLLFKELLSDITASKANYSLRIANRLYAEKSRPILPIYLKCVKKLYRAGLETVNFKTASDQARQLINSWVEKQTEGQIKDLLVSSSTDLDTTLVLVNAIYFKGMWKTAFNAEDTREMPFHVTKEESKPVQMMCMNNSFNVATLPAEKMKILELPFASGDLSMLVLLPDEVSGLERI

SEQ ID NO: 1012 - protein, 426 aa, Gallus gallus
PPTLPTELSAAGSKYIDTEVENAINGVKQMKTLMDKTSKEHQAMLHTLEETKRRKEEAVKLALEKEKQLAEKQEVCNETMLSLWEECKPCLKHTCMRVYSKICHSGSGLVGRQLEELLNRSSPFSIWVNGERIDALLDREQRQERRFEDLEERFGLMEDGVEDIFQDSTQLYGPAFPFFRTPPFGGFREAFVPPVQRVRLVPPRRRLSRELHPFLQHPVHGFHRLFEMTQRMLDGGHGAWDHLLGGFESESRNFSTDRMVCREIRRNSAGCLRMRDECEKCREILAVDCSQTDPVQSQLREQFEDALRLAERFTRRYDDLLSAFQAEMLNTSSLLDQLNRQFGWVSRLGNLTQGTDGFLQVTTVFSKTPNLEDPSAPADTQVTVQLFDSEPLSLTVPGDISWDDPRFMEIVAEQALQHFKQNNTIE

SEQ ID NO: 1013 - protein, 405 aa, Gallus gallus
MGALLALLDPVQPTRAPDCGGILTPLGLSYLAEVSKPHAEVVLRQDLPKEPQTCSLAPWSPAGDRNRITSVKVADLWLSVVPEAGLRLGIEVELRVAPLHAVPMPVRISIRADLHVDMGPDGNLQLLTSACRPTVQAQSTREAESKSSRSILDKVVDVDKLCLDVSKLLLFPNEQLMSLTALFPVTPNCQLQYLPLAAPVFSKQGIALSLQTTFQVAGAVVPVPVSPVPFSMPELASTSTSHLILALSEHFYTSLYFTLETAALGPGTPSSVLPFAGQRQCHCQLGGLWLQGAAGRHCPVCEPLPVTKHSCLWKTAELSCWATAVLPDAELSLAASNVGLVRAALLEELFLAPVCQQVPAWMDDVLREGVHLPHLSHFTYTDVNVVVHKDYVLVPCKLKLRSTMA

SEQ ID NO: 1014 - protein, 114 aa, Gallus gallus
NETCVVKNSSKIHVFRHNSTLTHEDGQVVSMAELIHSDKDLFILKHFKDNHVGLSLSARTAEVTKEQLEEFEAQLRCHGFKLEEAFITSPKDACPAAGEETGEGSAATAEPQLG

SEQ ID NO: 1015 - protein, 440 aa, Gallus gallus
MGALLALLDPVQPTRAPDCGGILTPLGLSYLAEVSKPHAEVVLRQDLMPKEPQTCSLAPWSPAGTELPAVKVADLWLSVIPEAGLRLGIEVELRIAPLHTVPMPVRISIRADLHVDMGPDGNLQLLTSACRPTVQAQSTREAESKSSRSILDKVVDVDKLCLDVSKLLLFPNEQLMSLTALFPVTPNCQLQYLALAAPVFSKQGIALSLQTTFQVAGAVVPVPVSPVPFSMPELASTSTSHLILALSEHFYTSLYFTLERAGAFNMTIPSMLTTATLAQKITQVGSLYHEDLPITLSAALRSSPRVVLEEGRAALKLFLTVHIGAGSPDFQSFLSVSADVTRAGLQLSVSDTRMMISTAVIEDAELSLAASNVGLVRAALLEELFLAPVCQQVPAWMDDVLREGVHLPHMSHFTYTDVNVVVHKDYVLVPCKLKLRSTMA

SEQ ID NO: 1016 - protein, 831 aa, Gallus gallus
AQLLLGRLCAEREKAKSLRHYLVVIPAHLRYPSIQVACLHITCYEAKIQVKLVLERFAGHDLLVQKNIQKEKTFMCTKFWVAPPADGTEEIATVRLIITGQGVNIEEKKNVLIHKANSGTFIQMDKPIYKPGQTVKFRIVTLDEDFIAFNDSISVFLQDPKNNRIEQWLNVVPQEGIADLSFQLSDEPLLGTYVINVTNRKIYDSFTVEEYVLPKFEVIFEAPVKIYALDKTFPLRVCGRYTYGKAVQGMVYVSLCQKISQFLPSASKPDLCQEFYNQTDNMGCFFTNVTLSFSQDLRYYRDSIVAEASLLEDGTEIQVNASHKLLISKIGGMALFDDVNSYYHAGEMYRGKIKVIDYKGKMLKYKKVLLVVSFGEQQFQQKYLTGDTGTASFSLNTTAWNSTSVSLEASVLHQDMDREPGTVDLNYMRASHFIRPFYSTSRSFLSIVHVPEMMPCGKKQAIQVDFRIYQEDLEHGPKRVIFSYLVTGKSGIVHAGQKTVWVGLPRMLKGFFSIPVTFSSVYAPTSTLIVYVIFPNGKTIADSAVFSVSMCFRNKAELSFSVPKILPGSEVNLHLQAAPGSTCAVWAVDQTVFLLKPEKELSHSMIYGLFPSIPSTYSGYPHQVSEDDNSCGFQNSDQPDVFTAFRGEVSSASVLFFFFFFLQEMGLKIMSNTNIRKPRLCLTTQSTTMMQERAGHLMTSTYQPTMFSPVSSPEEKVHKYFTKTWLWDLYSVGPSGKQTVTVTVPNTITGWKAGMFCTGHNGFGLAPTSSLLVFKPFSVELTLPSSVIQGETFILKATVLSYLQQCMKIQVTMEEFPQFQQLLMCWRTERL

SEQ ID NO: 1017 - protein, 1185 aa, Gallus gallus
CSTWGGGHFSTFDKYQYDFTGTCNYIFATVCDESSPDFNIQFRRGLDKKIARIIIELGPSVIIVEKDSISVRSVGVIKLPYASNGIQIAPYGRSVRLVAKLMEMELVVMWNNEDYLMVLTEKKYMGKTCGMCGNYDGYELNDFVSEGKLLDTYKFAALQKMDDPSEICLSEEISIPAIPHKKYAVICSQLLNLVSPTCSVPKDGFVTRCQLDMQDCSEPGQKNCTCSTLSEYSRQCAMSHQVVFNWRTENFCSVGKCSANQIYEECGSPCIKTCSNPEYSCSSHCTYGCFCPEGTVLDDISKNRTCVHLEQCPCTLNGETYAPGDTMKAACRTCKCTMGQWNCKELPCPGRCSLEGGSFVTTFDSRSYRFHGVCTYILMKSSSLPHNGTLMAIYEKSGYSHSETSLSAIIYLSTKDKIVISQNELLTDDDELKRLPYKSGDITIFKQSSMFIQMHTEFGLELVVQTSPVFQAYVKVSAQFQGRTLGLCGNYNGDTTDDFMTSMDITEGTASLFVDSWRAGNCLPAMERETDPCALSQLNKISAETHCSILTKKGTVFETCHAVVNPTPFYKRCVYQACNYEETFPYICSALGSYARTCSSMGLILENWRNSMDNCTITCTGNQTFSYNTQACERTCLSLSNPTLECHPTDIPIEGCNCPKGMYLNHKNECVRKSHCPCYLEDRKYILPDQSTMTGGITCYCVNGRLSCTGKLQNPAESCKAPKKYISCSDSLENKYGATCAPTCQMLATGIECIPTKCESGCVCADGLYENLDGRCVPPEECPCEYGGLSYGKGEQIQTECEICTCRKGKWKCVQKSRCSSTCNLYGEGHITTFDGQRFVFDGNCEYILAMDGCNVNRPLSSFKIVTENVICGKSGVTCSRSISIYLGNLTIILRDETYSISGKNLQVKYNVKKNALHLMFDIIIPGKYNMTLIWNKHMNFFIKISRETQETICGLCGNYNGNMKDDFETRSKYVASNELEFVNSWKENPLCGDVYFVVDPCSKNPYRKAWAEKTCSIINSQVFSACHNKVNRMPYYEACVRDSCGCDIGGDCECMCDAIAVYAMACLDKGICIDWRTPEFCPVYCEYYNSHRKTGSGGAYSYGSSVNCTWHYRPCNCPNQYYKYVNIEGCYNCSHDEYFDYEKEKCMPCAMQPTSVTLPTATQPTSPSTSSASTVLTETTNPPV

SEQ ID NO: 1018 - protein, 152 aa, Gallus gallus; identical to SEQ ID NO: 569

SEQ ID NO: 1019 - protein, 238 aa, Gallus gallus
MLRFAITLFAVITSSTCQQYGCLEGDTHKANPSPEPNMHECTLYSESSCCYANFTEQLAHSPIIKVSNSYWNRCGQLSKSCEDFTKKIECFYRCSPHAARWIDPRYTAAIQSVPLCQSFCDDWYEACKDDSICAHNWLTDWERDESGENHCKSKCVPYSEMYANGTDMCQSMWGESFKVSESSCLCLQMNKKDMVAIKHLLSESSEESSSMSSSEEHACQKKLLKFEALQQEEGEERR

SEQ ID NO: 1020 - protein, 178 aa, Gallus gallus
MRTLALSLALALLCLLHTEAAATVPDRSEVAGKWYIVALASNTDFFLREKGKMKMVMARISFLGEDELEVSYAAPSPKGCRKWETTFKKTSDDGELYYSEEAEKTVEVLDTDYKSYAVIFATRVKDGRTLHMMRLYSRSREVSPTAMAIFRKLARERNYTDEMVAVLPSQEECSVDEV

SEQ ID NO: 1021 - protein, 738 aa, Gallus gallus
MKSSENVLYLLLVHAALSLERVRWCTMSNQELSKCKDMSNAFTGAGILPPLECMEGESAANCTQMIKDYLADAVTLDGRWIYQAGKEYGLKPVVGEVYDQEIGTSYYAVAVVRKGSNITINSLKGVRSCHTGINRTAGWNVPVGYLIDSGRLPAMGCDLPKAVSDYFSASCVPGTNSASYPTSLCQLCKGDSSGQNKCQGNSQEQYYDYSGAFRCLAEGAGEVAFVKHSTVPENTDGRTLSTWAQQFRSKDFQLLCRNGSTADVTEWRTCHLARVPARAVVVRPDTDGTAVFQLLNQGQQRFNGVGAQFQMFDSTAYGAQNLMFRDSTTKLIAVTSQNYQAWLGDEYLHAMQALSCDPNTLPESLNWCVVSTEEIWKCGEMGTAFRSKNLKPEIQCISAKTKEECMEMIQKKEIDVVALGGADIYIAGKTYGLVPAAGESFSAEDNNNAYYAVALVKRNPSNAFTINDLKGKKSCHTGLGRTAGWNIPIGMLVKKGFINPRDCNIPQAVSEFFSASCVPSAEQGNYPSTLCQLCIGDNNGNNKCSASSQERYYSYNGAFRCLAEDAGDVAFVKHSTVFENTDGKNTESWAHDLKSSGFQLLCRNGARAEVTQFAQCHLARVPAQAIMVHPDTNIFALYGLLDKAQEYFGNNSNRNGFKMFDSSAFQGKDLIFKDSAVKIVPVEERRTYAEWLGSEYVESLEGMQTPQCSGAGNKLVQQHLLVITFVPFIILGQLQGLG

SEQ ID NO: 1022 - protein, 63 aa, Gallus gallus
MRFLYLIFSVFLLVSLATPGYGLVLKYCPKIGYCSNTCSKTQIWATSHGCKMYCCLPASWKWK

SEQ ID NO: 1023 - protein, 221 aa, Gallus gallus
PDMGCRAACVLAVLLAGLVPLGQGQEREKVKCYDSVRGTIYDYGALTIDGDEYIPFRKYAGKMVLFVNVATYSILGSLPAELNALQNELGPYGLVVLGFPSNQFGKQEPGQNSEILPALKYVRPGGGFVPNFQLFQKGDVNGAKEQKVYSFLKNSCPPVAEEFGNPKNLFWEPLRNHDIKWNFEKFLVGTDGVPVMRWYHRANIATVKNDIIAYMRQQRGQ

SEQ ID NO: 1024 - protein, 139 aa, Gallus gallus
MAGARGCVVLLAAALMLVGAVLGSEDRSRLLGAPVPVDENDEGLQRALQFAMAEYNRASNDKYSSRVVRVISAKRQLVSGIKYILQVEIGRTTCPKSSGDLQSCEFHDEPEMAKYTTCTFVVYSIPWLNQIKLLESKCQ

SEQ ID NO: 1025 - protein, 183 aa, Gallus gallus
MKVLTPAALILLFFFYTVDARTREYTSVITVPNGGHWGKWGIRQFCHSGYANGFALKVEPSQFGRDDTALNGIRLRCLDGSVIESLVGKWGTWTSFLVCPTGYLVSFSLRSEKSQGGGDDTAANNIQFRCSDEAVLVGDGLSWGRFGPWSKRCKICGLQTKVESPQGLRDDTALNNVRFFCCK

SEQ ID NO: 1026 - protein, 190 aa, Bos taurus
MMKSFFLVVTILALTLPFLGAQEQNQEQPIRCEKDERFFSDKIAKYIPIQYVLSRYPSYGLNYYQQKPVALINNQFLPYPYYAKPAAVRSPAQILQWQVLSNTVPAKSCQAQPTTMARHPHPHLSFMAIPPKKNQDKTEIPTINTIASGEPTSTPTTEAVESTVATLEDSPEVIESPPEINTVQVTSTAV

SEQ ID NO: 1027 - protein, 222 aa, Bos taurus; identical to SEQ ID NO: 780

SEQ ID NO: 1028 - protein, 178 aa, Bos taurus
MKCLLLALALTCGAQALIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLVCQCLVRTPEVDDEALEKFDKALKALPMHIRLSFNPTQLEEQCHI

SEQ ID NO: 1029 - protein, 708 aa, Bos taurus
MKLFVPALLSLGALGLCLAAPRKNVRWCTISQPEWFKCRRWQWRMKKLGAPSITCVRRAFALECIRAIAEKKADAVTLDGGMVFEAGRDPYKLRPVAAEIYGTKESPQTHYYAVAVVKKGSNFQLDQLQGRKSCHTGLGRSAGWIIPMGILRPYLSWTESLEPLQGAVAKFFSASCVPCIDRQAYPNLCQLCKGEGENQCACSSREPYFGYSGAFKCLQDGAGDVAFVKETTVFENLPEKADRDQYELLCLNNSRAPVDAFKECHLAQVPSHAVVARSVDGKEDLIWKLLSKAQEKFGKNKSRSFQLFGSPPGQRDLLFKDSALGFLRIPSKVDSALYLGSRYLTTLKNLRETAEEVKARYTRVVWCAVGPEEQKKCQQWSQQSGQNVTCATASTTDDCIVLVLKGEADALNLDGGYIYTAGKCGLVPVLAENRKSSKHSSLDCVLRPTEGYLAVAVVKKANEGLTWNSLKDKKSCHTAVDRTAGWNIPMGLIVNQTGSCAFDEFFSQSCAPGADPKSRLCALCAGDDQGLDKCVPNSKEKYYGYTGAFRCLAEDVGDVAFVKNDTVWENTNGESTADWAKNLNREDFRLLCLDGTRKPVTEAQSCHLAVAPNHAVVSRSDRAAHVKQVLLHQQALFGKNGKNCPDKFCLFKSETKNLLFNDNTECLAKLGGRPTYEEYLGTEYVTAIANLKKCSTSPLLEACAFLTR

SEQ ID NO: 1030 - protein, 1332 aa, Bos taurus
MTADELVFFVNGKKVVEKNADPETTLLAYLRRKLGLRGTKLGCGEGGCGACTVMLSKYDRLQDKIIHFSANACLAPICTLHHVAVTTVEGIGSTKTRLHPVQERIAKSHGSQCGFCTPGIVMSMYTLLRNQPEPTVEEIEDAFQGNLCRCTGYRPILQGFRTFAKNGGCCGGNGNNPNCCMNQKKDHTVTLSPSLFNPEEFMPLDPTQEPIFPPELLRLKDVPPKQLRFEGERVTWIQASTLKELLDLKAQHPEAKLVVGNTEIGIEMKFKNQLFPMIICPAWIPELNAVEHGPEGISFGAACALSSVEKTLLEAVAKLPTQKTEVFRGVLEQLRWFAGKQVKSVASLGGNIITASPISDLNPVFMASGTKLTIVSRGTRRTVPMDHTFFPSYRKTLLGPEEILLSIEIPYSREDEFFSAFKQASRREDDIAKVTCGMRVLFQPGSMQVKELALCYGGMADRTISALKTTQKQLSKFWNEKLLQDVCAGLAEELSLSPDAPGGMIEFRRTLTLSFFFKFYLTVLKKLGKDSKDKCGKLDPTYTSATLLFQKDPPANIQLFQEVPNGQSKEDTVGRPLPHLAAAMQASGEAVYCDDIPRYENELFLRLVTSTRAHAKIKSIDVSEAQKVPGFVCFLSADDIPGSNETGLFNDETVFAKDTVTCVGHIIGAVVADTPEHAERAAHVVKVTYEDLPAIITIEDAIKNNSFYGSELKIEKGDLKKGFSEADNVVSGELYIGGQDHFYLETHCTIAIPKGEEGEMELFVSTQNAMKTQSFVAKMLGVPVNRILVRVKRMGGGFGGKETRSTLVSVAVALAAYKTGHPVRCMLDRNEDMLITGGRHPFLARYKVGFMKTGTIVALEVDHYSNAGNSRDLSHSIMERALFHMDNCYKIPNIRGTGRLCKTNLSSNTAFRGFGGPQALFIAENWMSEVAVTCGLPAEEVRWKNMYKEGDLTHFNQKLEGFSVPRCWDECLKSSEYYARKSEVDKFNKENCWKKRGLCIIPTKFGISFTVPFLNQAGALIHVYTDGSVLVSHGGTEMGQGLHTKMVQVASKALKIPISKIYISETSTNTVPNSSPTAASVSTDIYGQAVYEACQTILKRLEPFKKKNPDGSWEDWVMAAYQDRVSLSTTGFYRTPNLGYSFETNSGNAFHYFTYGVACSEVEIDCLTGDHKNLRTDIVMDVGSSLNPAIDIGQVEGAFVQGLGLFTLEELHYSPEGSLHTRGPSTYKIPAFGSIPTEFRVSLLRDCPNKKAIYASKAVGEPPLFLGASVFFAIKDAIRAARAQHTNNNTKELFRLDSPATPEKIRNACVDKFTTLCVTGAPGNCKPWSLRV

SEQ ID NO: 1031 - protein, 1661 aa, Bos taurus
MKPTSGPSLLLLLLASLPMALGNPMYSMITPNILRLESEETVVLEAHGGQGTIQVSVTVHDFPAKKQVLSNENTQLNSNNGYLSTVTIKIPASKELKSDKGHKFVTVVATFGNVQVEKVVLISLQSGYLFIQTDKTIYTPGSTVLYRVFTVDHKLLPVGQTVFITIETPDGIPVKRDSKSSQNQFGILTLSWNIPELVNMGVWKIKAYYEDSPQQVFSAEFEVKEYVLPSFEVQLEPEEKFYYIDDPDGLKVNIIARFLYGEQVDGTAFVIFGVQDGDRRISLTHSLTRVPINDGNGEAILKRQVLLNGVQPSRADALVGKSIYVSATVILQSGSDMVEAERTGIPIVTSPYQIHFTKTPKFFKPAMPFDLMVYVTNPDGSPARHIPVVTQGSNVQSLTQDDGVAKLSINTQNKRDPLTITVRTKKDNIPEGRQATRTMQALPYNTQGNSNNYLHLSVPRVELKPGETLNVNFHLRTDPGEQAKIRYYTYMIMNKGKLLKVGRQYREPGQDLVVLPLTITSDFIPSFRLVAYYTLINAKGQREVVADSVWVDVKDSCMGTLVVKNGGKEEKHHRPGQQITLKIEADQGARVGLVAVDKGVFVLNKKNKLTQRKIWDVVEKADIGCTPGSGRNYAGVFTDAGLTLKTSQGLETQQRADPQCPQPATRRRRSVQLMEKRMDKAGQYSSDLRKCCEDGMRDNPMKFPCQRRAQFILQGDACVKAFLDCCEYITQLRQQHSRDGALELARSDLDDDIIPEEDIISRSQFPESWLWTVIEDLKQADKNGISTKLMNVFLKDSITTWEILAVSLSDKKGICVADPYEVTVMQDFFIDLRLPYSVVRNEQVEIRAILYNYREAENLKVRVELLYNPAFCSLATAKKRHQQTITIPARSSVAVPYVIVPLKIGLHEVEVKAAVYNHFISDGVKKTLKVVPEGVRVNKTVAVRTLNPEHLGQGGVQREEVPAADLSDQVPDTESETKILLQGTPVAQMTEDAIDGERLKHLIQTPSGCGEQNMIGMTPTVIAVHYLDSTDQWEKFGLEKRQESLELIRKGYTQQLAFRQKSSAYAAFQYRPPSTWLTAYVVKVFALAANLIAIDSKDLCETVKWLILEKQKPDGIFQEDGPVIHQEMIGGFRDTREKDVSLTAFVLIALHEAKDICEAQVNSLGRSIAKAGDFLENHYRELRRPYTVAIAAYALALLGKLEGDRLTKFLNTAKEKNRWEEPNQKLYNVEATSYALLALLARKDYDTTPPVVRWLNEQRYYGGGYGSTQATFMVFQALAQYQKDVPDHKELNLDVSIQLPSRNSAVRHRILWESASLLRSEETKENERFTVKAEGKGQGTLSVVTVYHAKLKGKVSCKKFDLRVSIRPAPETVKKPQDAKGSMILDICTKYLGDQDATMSILDISMMTGFSPDVEDLKTLSTGVDRYISKYEMNRDSNKNTLIIYLDKVSHTVEDCLSFKVHQYFNVGLIQPGAVKVYSYYNLDETCIRFYHPDKEDGMLSKLCHKDTCRCAEENCFMHHTEKEVTLEDRLDKACEPGVDYVYKTRLIQKKLEDDFDEYIMVIENIIKSGSDEVQVKQERKFISHIKCREALKLKEGAHYLVWGVSSDLWGEKPKISYIIGKDTWVELWPEAEECQDEENQKQCEDLANFTENMVVFGCPN

SEQ ID NO: 1032 - protein, 427 aa, Bos taurus; identical to SEQ ID NO: 847

SEQ ID NO: 1033 - protein, 526 aa, Bos taurus
MAVFPNSCLAGCLLIFILLQLPKLDSAPFDVIGPQEPILAVVGEDAELPCRLSPNVSAKGMELRWFREKVSPAVFVSREGQEQEGEEMAEYRGRVSLVEDHIAEGSVAVRIQEVKASDDGEYRCFFRQDENYEEAIVHLKVAALGSDPHISMKVQESGEIQLECTSVGWYPEPQVQWRTHRGEEFPSMSESRNPDEEGLFTVRASVIIRDSSMKNVSCCIRNLLLGQEKEVEVSIPASFFPRLTPWMVAVAVILVVLGLLTIGSIFFTWRLYKERSRQRRNEFSSKEKLLEELKWKRATLHAVDVTLDPDTAHPHLFLYEDSKSVRLEDSRQKLPEKPERFDSWPCVMGREAFTSGRHYWEVEVGDRTDWAIGVCRENVMKKGFDPMTPENGFWAVELYGNGYWALTPLRTPLPLAGPPRRVGVFLDYESGDIFFYNMTDGSHIYTFSKASFSGPLRPFFCLWSCGKKPLTICPVTDGLEGVMVVADAKDISKEIPLSPMGEDSASGDIETLHSKLIPLQPSQGVP

SEQ ID NO: 1034 - protein, 757 aa, Bos taurus
MSRLFLACLLAIFPVVSMKSPIFGPEEVTSVEGRSVSIKCYYPPTSVNRHTRKYWCRQGAQGRCTTLISSEGYVSDDYVGRANLTNFPESGTFVVDISHLTHKDSGRYKCGLGISSRGLNFDVSLEVSQDPAQASHAHVYTVDLGRTVTINCPFTRANSEKRKSLCKKTIQDCFQVVDSTGYVSNSYKDRAHISILGTNTLVFSVVINRVKLSDAGMYVCQAGDDAKADKINIDLQVLEPEPELVYGDLRSSVTFDCSLGPEVANVPKFLCQKKNGGACNVVINTLGKKAQDFQGRIVSVPKDNGVFSVHITSLRKEDAGRYVCGAQPEGEPQDGWPVQAWQLFVNEETAIPASPSVVKGVRGGSVTVSCPYNPKDANSAKYWCHWEEAQNGRCPRLVESRGLIKEQYEGRLALLTEPGNGTYTVILNQLTDQDTGFYWCVTDGDTRWISTVELKVVQGEPSLKVPKNVTAWLGEPLKLSCHFPCKFYSFEKYWCKWSNRGCSALPTQNDGPSQAFVSCDQNSQVVSLNLDTVTKEDEGWYWCGVKEGPRYGETAAVYVAVESRVKGSQGAKQVKAAPAGAAIQSRAGEIQNKALLDPSFFAKESVKDAAGGPGAPADPGRPTGYSGSSKALVSTLVPLALVLVAGVVAIGVVRARHRKNVDRISIRSYRTDISMSDFENSRDFEGRDNMGASPEAQETSLGGKDEFATTTEDTVESKEPKKAKRSSKEEADEAFTTFLLQAKNLASAATQNGPTEA

SEQ ID NO: 1035 - protein, 712 aa, Bos taurus; identical to SEQ ID NO: 845

SEQ ID NO: 1036 - protein, 153 aa, Bos taurus; identical to SEQ ID NO: 859

SEQ ID NO: 1037 - protein, 447 aa, Bos taurus
MASVAVEPQLSVVTRVANLPLVSSTYDLVSSAYISRKDQYPYLKSLCEMAEKGMKTITSVAVTSALPIIQKLEPQIAVANTYACKGLDRIEEKLPILNQPTNQVVANAKGAMTGAKDAVTTTVTGAKDSVASTITGVVDRTKGAVTGSVEKTKSVVSGSINTVLRSRVMQLMSSGVENALTKSELLVDQYLPLTKDELEKEAKKVEGFDMVQKPSYYVRLGSLSTKLRSRAYQQALCRVEEAKRKGQETISQLHSAFNLSELARKNVHNANQKIQDAQDKLYLSWLEWKRSIGYDDTDESHCAEHIESRTLAIARNLTQQLQTMCHTLLSNIQGLPQNIQDRANHLGVMAGDIYSVFRNAASFKEVSDGLLASSKGQLQKMKESLDDVMDYLVNNTPLNWLALDFSITDFTSETDEIPDIIALEEEDGPNHSHANGPEPSQGKMLNN

SEQ ID NO: 1038 - protein, 478 aa, Bos taurus
MESKALLLLALSVCLQSLTVSRGGLVAADRITGGKDFRDIESKFALRTPEDTAEDTCHLIPGVTESVANCHFNHSSKTFVVIHGWTVTGMYESWVPKLVAALYKREPDSNVIVVDWLSRAQQHYPVSAGYTKLVGQDVAKFMNWMADEFNYPLGNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEALRVIAERGLGDVDQLVKCSHERSVHLFIDSLLNEENPSKAYRCNSKEAFEKGLCLSCRKNRCNNMGYEINKVRAKRSSKMYLKTRSQMPYKVFHYQVKIHFSGTESNTYTNQAFEISLYGTVAESENIPFTLPEVSTNKTYSFLLYTEVDIGELLMLKLKWISDSYFSWSNWWSSPGFDIGKIRVKAGETQKKVIFCSREKMSYLQKGKSPVIFVKCHDKSLNRKSG

SEQ ID NO: 1039 - protein, 534 aa, Bos taurus
MSQLLERMTSVLWLALASYILTLSSTEQQGYRNSTNTGSYEKDLDCGAPGTPEAQLCFDPCQNYTLLNEPFRSTENTEDIQGCDSDKHGWYRFVGDGGVRMPEDCVPTFRCQTSAPLWLNGTHPGLGEGIVNRTACAHWSGNCCLWKTEVLVKACPGPYYVYRLEGTPQCSLRYCTDPATAEDKCDRTCRPEEECRLVSGTWGCFCRQDLNVSDVHSLQPQLDCGDTEIKVSLDKCLLGSLGFGDEVHAYLRDGNWNCSSLRQSEEENWISVTNPTQAGACGNILERNQTHAIYINTLSLVNDFIIRDTILSINFQCAYPLDMKVSLQMALQPIVSSLNITVDGEGEFTVRMALFQDQDYTSPYEGTAVMLSVESMLYVGTILERGDTSRFNLVLKNCYATPTEDKTDPVKYFIIRNSCPNQRDSTISVEENGVSAESRFSVQMFKFAGNYDLVFLHCEVSLCDFIKEECQPSCSRSQLRSEGVAIDPARVLDLGPITRKGAQSLGVMSGTPNTAGFLVAWPLVLLPVLLAGLF

SEQ ID NO: 1040 - protein, 704 aa, Bos taurus
MRPAVRALLACAVLGLCLADPERTVRWCTISTHEANKCASFRENVLRILESGPFVSCVKKTSHMDCIKAISNNEADAVTLDGGLVYEAGLKPNNLKPVVAEFHGTKDNPQTHYYAVAVVKKDTDFKLNELRGKKSCHTGLGRSAGWNIPMAKLYKELPDPQESIQRAAANFFSASCVPCADQSSFPKLCQLCAGKGTDKCACSNHEPYFGYSGAFKCLMEGAGDVAFVKHSTVFDNLPNPEDRKNYELLCGDNTRKSVDDYQECYLAMVPSHAVVARTVGGKEDVIWELLNHAQEHFGKDKPDNFQLFQSPHGKDLLFKDSADGFLKIPSKMDFELYLGYEYVTALQNLRESKPPDSSKDECMVKWCAIGHQERTKCDRWSGFSGGAIECETAENTEECIAKIMKGEADAMSLDGGYLYIAGKCGLVPVLAENYKTEGESCKNTPEKGYLAVAVVKTSDANINWNNLKDKKSCHTAVDRTAGWNIPMGLLYSKINNCKFDEFFSAGCAPGSPRNSSLCALCIGSEKGTGKECVPNSNERYYGYTGAFRCLVEKGDVAFVKDQTVIQNTDGNNNEAWAKNLKKENFEVLCKDGTRKPVTDAENCHLARGPNHAVVSRKDKATCVEKILNKQQDDFGKSVTDCTSNFCLFQSNSKDLLFRDDTKCLASIAKKTYDSYLGDDYVRAMTNLRQCSTSKLLEACTFHKP

SEQ ID NO: 1041 - protein, 234 aa, Bos taurus; identical to SEQ ID NO: 483

SEQ ID NO: 1042 - protein, 389 aa, Bos taurus
  MOD_RES (263)..(263): Any amino acid
GESHPRVFPLVSCVSSPSDESTVALGCLARDFVPNSVSFSWKFNNSTVSSERFWTFPEVLRDGLWSASSQVVLPSSSAFQGPDDYLVCEVQHPKGGKTVGTVRVIATKAEVLSPVVSVFVPPRNSLSGDGNSKSSLICQATDFSPKQISLSWFRDGKRIVSGISEGQVETVQSSPITFRAYSMLTITERDWLSQNVYTCQVEHNKETFQKNVSSSCDVAPPSPIGVFTIPPSFADIFLTKSAKLSCLVTNLASYDGLNISWSXGFAPADVFVQWLQRGEPVTKSKYVTSSPAPEPQDPSVYFVHSILTVAEEDWSKGETYTCVVGHEALPHMVTERTVDKSTDLLLEEEICADAQDGELDGLWTTISIFITLFLLSVCYSATVTLFKVG

SEQ ID NO: 1043 - protein, 457 aa, Bos taurus
SPEGESLPRVFPLVSCMSSPSDESTVALGCLAQDFMPNSVSFSWKFNNSTVSSERFWTFPAVLRDGLWSASSQVVLPSSSTFQGPDDYLVCEVQHPKGGKTVGTVRVVTPKAEVLSPIVSVFVPPRNSLSGDGNSKSSLICQATDFSPKQISLSWFRDGKRIVSGISEGQVETVQSSPITFRAYSMLTITEKDWLSQNVYTCQVEHNKETFQKNVSSSCDAAPPSPIGVFTIPPSFADIFLTKSAKLSCLVTNLASYDGLNISWSRQNGKALETHTYFERHLNDTFSARGEASVCSEDWESGEEFTCTVAHSDLPFPEKNAVSKPKDVAMKPPSVYLLPPTREQLSLRESASVTCLVKGFAPADVFVQWLQRGEPVTKSKYVTSSPAPEPQDPSVYFVHSILTVAEEDWSKGETYTCVVGHEALPHMVTERTVDKSTGKPTLYNVSLVLSDTASTCY

SEQ ID NO: 1044 - protein, 299 aa, Bos taurus; identical to SEQ ID NO: 857

SEQ ID NO: 1045 - protein, 472 aa, Bos taurus
MGCNRNCGLIAGAVIGAVLAVFGGILMPVGDMLIEKTIKKEVVLEEGTIAFKNWVKTGTDVYRQFWIFDVQNPDEVTVNSSKIKVKQRGPYTYRVRYLAKENITQDPETHTVSFLQPNGAIFEPSLSVGTEDDTFTILNLAVAAAPQLYPNTFMQGILNSFIKKSKSSMFQNRTLKELLWGYTDPFLNLVPYPITTTIGVFYPYNNTADGIYKVFNGKDDISKVAIIDTYKGRKNLSYWSSYCDLINGTDAASFPPFVEKTRVLQFFSSDICRSIYAVFGAEINLKGIPVYRFILPSFAFASPFQNPDNHCFCTEKIISKNCTLYGVLDIGKCKEGKPVYISLPHFLHGSPELAEPIESLSPNEEEHSTYLDVEPITGFTLRFAKRLQVNMLVKPAKKIEALKNLKHNYIVPILWLNETGTIGDEKAEMFRNQVTGKINLLGLVEIVLLSVGVVMFIAFMISYCACRSKRVN

SEQ ID NO: 1046 - protein, 474 aa, Bos taurus
MPPSGPRAALFLLPSLLLLRAVLAVPLERGAPKEENPATESPDTGLYYHRYLQEVINVLETDGHFREKLQAANAEDIKSGKLSRELDFVSHHVRTKLDELKRQEVSRLRMLLKAKMDAQQEPNIQLDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEDDDMREMEEERLRMREHVMKNVDTNQDRLVTLEEFLASTQRKEFGDTGEGWEQGKAGVPLPMAPVLTLQTVEMHPAYTEEELRRFEEELAAREAELNAKAQRLSQETEALGRSQGRLEAQKRELQQAVLQMEQRKQQQQSHNNPAPGPEGQLKFHPDTDDVPVPAPAGDQKDVDASEKKVPEQTPEPPQLDSQHL

SEQ ID NO: 1047 - protein, 724 aa, Bos taurus
MLRRSIPRGGWSRWTPWLLTSPRIFCLSLIVLLGQVGLLQGHPQCLDYRPPFQPLQHLEFCSDYESFGCCDQRKDHRIAARYWDIMEYFDLKGHELCGGYIKDILCQECSPYAAHLYDAENPRTPLRNLPGLCSDYCSAFHSNCHSAIALLTNDRRFQESPGKDGTRFCHLLNLPDKDYCFPNILRSDHLNRNLGTVAEDRRGCLQLCLAEVANRLRNPVAMVHAGDGTHRFFVAEQVGVVWVYLPDGSRLEQPFLDLKSLVLTTPWIGDERGFLGLAFHPRFRRNRKFYIYYSCLGKKRVEKIRISEMKVSRADPNKADPKSERVILEIEEPASNHNGGQLLFGLDGYMYIFTGDGGQAGDPFGKFGNAQNKSSLLGKVLRIDVNGAGSGGKRYRVPMDNPFVSEPGAHPAIYAYGIRNMWRCAVDRGDPITHQGRGRMFCGDVGENRFEEVDIIVKGGNYGWRAKEGFECYDKKLCQNASLDDILPIYAYGHAVGKSVTGGYVYRGCESPNLNGLYIFGDFMSGRLMALQEDRKTKKWKKQDICLGSTESCAFPGLISTHSKFIISFGEDEAGELYFLATSYPSAYAPHGSIYKFVDPSRRAPPGKCKYKPVPVKTRSKRVQFRPLAKMVLDLLKEQSEKAARKLSSATLASSPNRASSQKDSFKKPASPTSSRKTSPGPGAKKRARVWSPGPQGKRKGIPKRPSGIARQAAQHRRAGRSLP

SEQ ID NO: 1048 - protein, 233 aa, Bos taurus
MAWTPLLLPLLTLCAGHLASSQLTQPPAVSVSLGQTASITCQGDDLELLSAHWYQQKPGQAPVLVIYADDNLASGIPDRFSGSKSDTTATLTIRGAQAEDEADYYCQSADPVSLCDLFGGGTRVTVLGQPKSPPSVTLFPPSKEELSANKATLVCLISDFYPGSVTVAWKADGSTITRNVKTTRASKQSNSKYAASSYLSLTDSDWKSKGSYSCEVTHEGSTVTKTVKTSACS

SEQ ID NO: 1049 - protein, 326 aa, Bos taurus
ASTTAPKVYPLASRCGDTSSSTVTLGCLVSSYMPEPVTVTWNSGALKSGVHTFPAVLQSSGLYSLSSMVTVPASTSGQTFTCNVAHPASSTKVDKAVGVSIDCSKCHNQPCVREPSVFIFPPKPKDTLMITGTPEVTCVVVNVGHDNPEVQFSWFVDDVEVHTARTKPREEQFNSTYRVVSALPIQHQDWTGGKEFKCKVNNKGLSAPIVRIISRSKGPAREPQVYVLDPPKEELSKSTLSVTCMVTGFYPEDVAVEWQRNRQTESEDKYRTTPPQLDTDRSYFLYSKLRVDRNSWQEGDTYTCVVMHEALHNHYTQKSTSKSAGK

SEQ ID NO: 1050 - protein, 443 aa, Bos taurus; identical to SEQ ID NO: 848

SEQ ID NO: 1051 - protein, 107 aa, Bos taurus
QAVLTQPSSVSGSLGQRVSITCSGSSSNVGRGNYVNWFQQIPGSAPRTLIYGATSRASGVPDRFSGSRSGNTATLTISSLQAEDEADYFCAAYDSSSNNGTVLQARG

SEQ ID NO: 1052 - protein, 242 aa, Bos taurus
MALFTVVLFLAAVWLPFFPAKGQDRRFADLSNTLKNVQTEIVNKHNDLRRGVSPPPSNMLKMQWNTTAAANANWANKCLFHSKKEDRDSGTRNCGENLFMSSYPSTWSNAIQSWYDEVHDFVFEVGPKSPQAVIGHFTQIVWYSSFLIGCGVAYCPKQSLKYLYVCQYCPAGNIVGRQHVPYQKGTPCGSCPNHCDNGLCTNSCEYEDTYSNCASLKETWTCASDFVKTNCKAACNCQGKIY

SEQ ID NO: 1053 - protein, 655 aa, Bos taurus
MSSNSYEVSIPMSKKLNGIPETTSKDLQTLTEGAVLSFHNICYRVKVKTGFLLCRKTIEKEILANINGVMKPGLNAILGPTGGGKSSLLDILAARKDPHGLSGDVLINGAPRPANFKCNSGYVVQDDVVMGTLTVRENLQFSAALRLPTTMTSYEKNERINKVIQELGLDKVADSKVGTQFIRGVSGGERKRTSIAMELITDPSILFLDEPTTGLDSSTANAVLLLLKRMSKQGRTIIFSIHQPRYSIFKLFDSLTLLASGRLMFHGPAQEALGYFGAIGFRCEPYNNPADFFLDIINGDSSAVVLNREDIGDEANETEEPSKKDTPLIEKLAEFYVNSSFFKETKVELDKFSGDQRRKKLPSYKEVTYATSFCHQLKWISRRSFKNLLGNPQASIAQLIVTVFLGLVIGAIFYDLKNDPAGIQNRAGVLFFLTTNQCFSSVSAVELLVVEKKLFIHEYISGYYRVSSYFFGKLLSDLLPMRMLPSIIFTCITYFLLGLKPKVEAFFIMMLTLMMVAYSASSMALAIAAGQSVVSIATLLMTISFVFMMIFSGLLVNLKTVVPWLSWLQYLSIPRYGYAALQHNEFLGQNFCPGLNVTTNNTCSYAICTGEEFLTNQGIDISPWGLWKNHVALACMIVIFLTIAYLKLLFLKKFS

SEQ ID NO: 1054 - protein, 2512 aa, Bos taurus
MEEVVITGMSGKLPESENLEEFWANLIGGVDMVTDDDRRWKAGLYGLPRRSGKLKDLSRFDASFFGVHPKQAHNMDPQLRLLLEVTYEAIVDAGINPASIRGTNTGVWVGVSGSEASEALSRDPETLVGYSMVGCQRAMLANRLSFFFDFKGPSITLDTACSSSLLALQRAYQAIQRGECAMAIVGGVNILLKPNTSVQFMKLGMLSPEGTCKSFDASGNGYCRAEAVMAILLTKKSLARRVYATILNAGTNTDGCKEKGVTFPSGEAQEQLISSLYKPAGLDPETLEYVEAHGTGTKVGDPQELNGIVQALCGTRQSPLRIGSTKSNMGHPEPASGLAALAKVLLSLEHGLWAPNLHFHNPNPKIPALQDGRLQVVDRPLPVLGGNVGINSFGFGGSNVHVILQPNSQPLPPPAPHAALPRLLRASGRTLEGVQGLLELGLQHSQNLAFVSMLNDIAAPSPAAMPFRGYAVLGSQGGSQEVQQVLAGKRPLWFICSGMGTQWRGMGLSLMRLSRFRDSILRSDEAVKPLGLQVSQLLLSTDEAIFDDMVISFVSLTAIQIALIDLLTSMGLQPDGIIGHSLGEVACGYADGCISQEEAILSAYWRGQCIKEANIPPGAMAAVGLTWEECKQRCPPGIVPACHNCIDTVTISGPQASMLEFVQQLKQEGVFAKEVRTGGMAFHSYFMDAIAPMLLQQLKKVIREPQPRSPRWLSTSIPETQWQESLARTFSAEYNVNNLVSPVLFQEALWRVPEDAVVLEIAPHALLQAVLKRGLKSSCTIIPLMKKDHRDNLEFFLSNVGQLYLTGIDVNPNGLFPPVEFPAPRGTPLISPHIKWDHSQTWDVPTAEDFPSGSSSSSATIYKIDINPESPDHYLVDHCIDGRIIFPGTGYLCLVWKTLARALDQNMEHTPVVFEDVTLHQAVILPKTGIVLLEVRLLEASCTFEVSENGNLIASGKVYQWEDPNPKLFDNRYGPDPATPVDPTTAIHLCRGDVYKELQLQGFNYGPYFQGILEASSEGNTGQLLWKDNWVTFMDTMLQMSILAPSKRSLRLPTRITAIYIHPATHQQKLYTLQDKTQVADVVINRCLDTTVAGGIYISRIHTSVAPRHQQEQLVPILEKFCFTPHVETGCLAGNLALQEELQLCVGLAQALQTRVAQQGIKMVVPGLDGAQAPQEAPQQGLPRLLATACQLQLNGNLQMEMGQILAQERALLCDDPLLSGLLNSPALKACVDTALENMTSLKMKVVLAGDGQLYSRIPTLLNTQPLLELDYTATDRHPQALEAAQAKLQQLDITQGQWDPSDPAPSNLGGANLVVCNYALASLGDPATAVGNMVAALKEGGFLLLHTLLRGHPLGETVTFLTCPEPQQGQRHLLSQDEWERLFAGASLYLVALKKSFYGSVLFLCRRLAPLDSPIFLPVEDTSFQWVDSLKNILADSSSRPVWLMAVGCTTSGVVGLVNCLRKEPDGHRIRCVLVSNLNSTSPIPETDPKSLELQKVLQSDLVMNVYRDGAWGAFRHFPLEQDKPEEQTEHAFINVLTRGDLSSIRWVCSPLRHSQPTAPGFQLCTIYYASLNFRHHAGHGQAVPRRHPRNWASRNCLLGMEFSGRDASGKRVMGLVPAEGLATSTLVPQSFLWDVPSNWTLEEAASVPVVYSTAYYALMVRGRMQPGETVLIHSGSGGVGQAAIAIALSLGCRVFTTVGSAEKRAYLQSRFPQLNETSFANSRDTSFEQHVLWHTAGKGADLVLNSLAEEKLQASVRCLAQHGRFLEIGKFDLSKNHPLGMAIFLKNVTFHGILLDSLFEENNTMWQEVSTLLKAGIREGVVQPLKRTVFPRTQAEDAFRYMAQGKHIGKVVLQVREEEQEAVLHGTKPTQMVALCKTFCPAHKSYIITGGLGGFGLELAHWLVERGAQKLVLTSRSGIRTGYQARQVHEWRRQGVQVLVSTSDVSALDGTRSLITEAAQLGPVGGIFNLAVVLRDAMLDNQTPEFFQDVNKPKYNGTLNLDRVTREACPELDYFVVFSSVSCGRGNAGQTNYGFANSTMERICEKRRHDGLPGLAVQWGAIADVGLLMELKGTKDKAIGGTLPQRITSCMEVLDLFLNQPHPVLSSFVLAEKATSRGPSGSHQDLVKAVTHILGIRDLATVNLDSSLSDLGLDSLMGVEVRQMLEREHNLLLSMREIRQLTIHKLQEISAQAGTADELTDSTPKFGSPAQSQTQLNLSTLLVNPEGPTLTRLNSVQSSERPLFLVHPIEGSTTVFHSLAAKLSIPTYGLQCTGAAPLDSIQSLATYYIECIRQVQPEGPYRIAGYSYGACVAFEMCSQLQAQQNAGPTNNSLFLFDGSHTFVMAYTQSYRAKLNPGCEAEAEAEAMCFFMQQFTEAEHSRVLEALLPLGDLEARVAATVELIVQSHAGLDRHALSFAARSFYHKLRAAEEYTPRATYHGNVTLLRAKMGSAYQEGLGADYNLSQVCDGKVSVHIIEGDHRTLLEGSGLESILSIIHSSLAEPRVSVREG

SEQ ID NO: 1055 - protein, 247 aa, Bos taurus
SESETSPSIFPLSLGNNDPAGQVVIGCLVQGFFPSAPLSVTWNQNGDSVSVRNFPAVLAGSLYTMSSQLTLPASLCPKGQSVTCQVQHLSKASKTVAVPCIIQDSSSCCVPNCEPSLSVQPPALEDLLLGSNASLTCTLSGLKSAEGASFTWNPTGGKTAVQGSPKRDSCGCYSVSSVLPGCADPWNSGQTFSCSVTHPESRSSLTATIKKDLGNTFPQVHLLPPPSSWPLNELVTLTCLVRGFQPQ

SEQ ID NO: 1056 - protein, 693 aa, Bos taurus
MAPWPELENSQPTSEKYTVKADGEQSAKPEKAKETEKDDTGTPITKIELVPSHSTATLIEEPTEVEDPWDLPELKDTGLKWSERDTKGKILCVFQGIGKFILLLVFLYFFVCSLDVLSSAFQLVGGKVAGKFFNNNSIMSNPLAGMVIGVLVTVLVQSSSTSTSIVVSMVASSLLPVHAAIPIIMGANIGTSITNTIVALMQAGDRKEFRRAFAGATVHDFFNWLSVLVLLPLEAATGYLERLTNLVVESFHFKNGEEAPELLKVITDPFTKLIIQLDKSILNQIAMNDESVQNKSMIKIWCKTFTNVTERNVTVPSPENCTSPSLCWTDGLYTWTIKNVTYKENIAKCQHIFVNFNLSDAIVGTILLITSLLILCTCLILIVKLLGSVLRGQVAAVIKKTINTDFPYPFSWVTGYLAILVGAGMTFIVQSSSVFTSAMTPLIGIGVISIQRAYPLTLGANIGTTTTAILAALASPGSTLKSSLQIALCHFFFNISGIILWYPIPFTRLPIRLAKGLGNISSKYRWFAIVYLIVFFLLIPLAVFGLSLIGWPVLVGVASPIVLVILLVVVLKILQSFCPGSLPQKLRSWDFLPFWMRSLEPWDKLITSLTSCFQMRCCCCCRVCCRLCCGLCGCSKCCRCTKCSEDLEEGKDEPVKSPEAFNNLAMDKEAQDGVTKSEVDASGTKIVSSVTAL

SEQ ID NO: 1057 - protein, 116 aa, Bos taurus
QAVLTQPPSVSGSLGQRVTISCTGSSSNIGGGNCVGWYQQIPGSAPKTLIYRSTSRPSGVPDRFSGSRSGNTATLTISSLQAEDEADYYCATYESSSYHGTVLQGKGNLEYSTMFK

SEQ ID NO: 1058 - protein, 133 aa, Bos taurus
MVDAFVGTWKLVDSKNFDDYMKSLGVGFATRQVGNMTKPTTIIEVNGDTVIIKTQSTFKNTEISFKLGVEFDETTADDRKVKSIVTLDGGKLVHVQKWNGQETSLVREMVDGKLILTLTHGTAVCTRTYEKQA

SEQ ID NO: 1059 - protein, 202 aa, Bos taurus; identical to SEQ ID NO: 855

SEQ ID NO: 1060 - protein, 234 aa, Bos taurus; identical to SEQ ID NO: 856

SEQ ID NO: 1061 - protein, 241 aa, Bos taurus
MAWQMTQLLLLALVAAAWGAQAPRTPRARTDLLNVCMDAKHHKAEPGPEDSLHEQCSPWRKNACCSVNTSIEAHKDISYLYRFNWDHCGKMEPACKRHFIQDTCLYECSPNLGPWIREVNQRWRKERVLGVPLCKEDCQSWWEDCRTSYTCKSNWHKGWNWTSGYNQCPVKAAHCRFDFYFPTPAALCNEIWSHSYKVSNYSRGSGRCIQMWFDPFQGNPNEEVARFYAENPTSGSTPQGI

SEQ ID NO: 1062 - protein, 411 aa, Bos taurus
MRAERTSFLLALGLLVAGIRSVHCLPENVVVKDQHRRVDGHTLASSNTDFAFSLYKQLALKNPNKNVILSPLSVSIALAFLSLGARGSTLTEILEGLKFNLTEIQEKEIHHSFQHLLQALNQPSNQLQLSVGNAMFVQEELKLLDKFIEDAQVLYSSEAFPTNFRDSEAARSLINDYVKNKTQGKIEELFKYLSPRTELVLVNYIYFKAQWKTPFDPKHTEQAEFHVSDNKTVEVPMMTLDLETPYFRDEELGCTLVELTYTSNDSALFILPDEGKMRDLEAKLTPETLTRWRNSLQPRRIHELYLPKFSIKSNYELNDILSQLGIRKIFANADLSGITGTADLVVSQVVHGAALDVDEEGTEGVAATGIGIERTFLRIIVRVNRPFLIAVVLKDTQSIIFLGKVTNPSEA

SEQ ID NO: 1063 - protein, 414 aa, Bos taurus
MSQKIQGGSVVEMQGDEMTRIIWELIKEKLIFPYVELDLHSYDLGIENRDATNDQVTKDAAEAIKKYNVGVKCATITPDEKRVEEFKLKQMWKSPNGTIRNILGGTVFREAIICKNIPRLVSGWVKPIIIGRHAYGDQYRATDFVVPGPGKVEISYTPSDGSPKTVYLVHNFTESGGVAMGMYNQDKSIEDFAHSSFQMALSKNWPLYLSTKNTILKKYDGRFKDIFQEIYDKQYKSEFEAQNIWYEHRLIDDMVAQAMKSEGGFIWACKNYDGDVQSDSVAQGYGSLGMMTSVLVCPDGKTVEAEAAHGTVTRHYRMYQKGQETLTNPIASIFAWTRGLAHRAKLDNNKELSFFAKALEEVCIETIEAGFMTKDLAACIKGLPNVQRSDYLNTFEFMDKLGENLQLKLAQAKL

SEQ ID NO: 1064 - protein, 496 aa, Bos taurus
MSCVLTGVVPLGLVLLLCGAQGFFLPNVTQLEKLLSKYQGDQPHSRTRRAISRADREEILTLHNKLRGQVSPPASNMEYMTWDEELEKSAVAWARECIWEHGPTSLLVSIGQNLAVHWGRPRSPGSHVQSWYDEVKDYTYPYPHECNPWCPERCSGPMCTHYTQIVWATTNRIGCAVNTCPRMNVWGDVWENAVYLVCNYFPKGNWIGEAPYKTGQPCSECPGKYRGGCKNNLCYQETYGQETETDDMNEVEAAPIPDEKHVWVTPRVIKPKKPKKDSPVNYMTQVVKCDTKMKDKCKGSTCNRYQCPAGCLHSGAKIFGTLFYESASSICRAAIHYGILDDRGGLVDVTRNGKVPFFVKSERNGVQSLSKYKASSSFTVSKVKVQDLDCYTTVAQLCPYEKPGTHCPRVRCPAHCKDEPSYWAPVFGSNIYADTSSICKTAVHAGVIRNESGGYVDVMPVDKKKTYVASLRNGVQSESLRTPRDGKAFRIFAVRQ

SEQ ID NO: 1065 - protein, 567 aa, Bos taurus; identical to SEQ ID NO: 844
  MOD_RES (86)..(86): Any amino acid

SEQ ID NO: 1066 - protein, 102 aa, Bos taurus
MRLSVTALLVTLALCYYEANAIVCPTFAADLTEFFYFPDLLYRLSLAKYNAPPEAVAAKMEVKQCTDRFSVKNRLIITNILGKILLNCTVTDVKAVLNPSSA

SEQ ID NO: 1067 - protein, 118 aa, Bos taurus; identical to SEQ ID NO: 853

SEQ ID NO: 1068 - protein, 140 aa, Bos taurus; identical to SEQ ID NO: 557

SEQ ID NO: 1069 - protein, 148 aa, Bos taurus
MVMVLSPLLLVFILGLGLTPVAPAQDDYRYIHFLTQHYDAKPKGRNDEYCFNMMKNRRLTRPCKDRNTFIHGNKNDIKAICEDRNGQPYRGDLRISKSEFQITICKHKGGSSRPPCRYGATEDSRVIVVGCENGLPVHFDESFITPRH

SEQ ID NO: 1070 - protein, 157 aa, Bos taurus; identical to SEQ ID NO: 505

SEQ ID NO: 1071 - protein, 190 aa, Bos taurus
MSRRYTPLAWVLLALLGLGAAQDCGSIVSRGKWGALASKCSQRLRQPVRYVVVSHTAGSVCNTPASCQRQAQNVQYYHVRERGWCDVGYNFLIGEDGLVYEGRGWNTLGAHSGPTWNPIAIGISFMGNYMHRVPPASALRAAQSLLACGAARGYLTPNYEVKGHRDVQQTLSPGDELYKIIQQWPHYRRV

SEQ ID NO: 1072 - protein, 226 aa, Bos taurus
MPVKGGTKCIKYLLFGFNFIFWLAGIAVLSVGLWLRFDSQTKSIFEQENNDSSFYTGVYILIGAGALMMLVGFLGCCGAVQESQCMLGLFFSFLLVIFAIEVAAAIWGYSHKEEVIKEVQKFYEDTYNKLKNKDEPQRETLKAIHIALDCCGLTGVPEQFLTDTCPPKNLIDSLKTRPCPEAIDEIFRSKFHIIGAVGIGIAVVMIFGMVFSMILCCAIRRNRDMV

SEQ ID NO: 1073 - protein, 389 aa, Bos taurus
MPGASLQRACRLLVAVCALHLGVTLVYYLAGRDLRRLPQLVGVHPPLQGSSHGAAAIGQPSGELRLRGVAPPPPLQNSSKPRSRAPSNLDAYSHPGPGPGPGSNLTSAPVPSTTTRSLTACPEESPLLVGPMLIEFNIPVDLKLVEQQNPKVKLGGRYTPMDCISPHKVAIIIPFRNRQEHLKYWLYYLHPILQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKCRMIRHSRDKKNEPNPQRFDRIAHTKETMLSDGLNSLTYMVLEVQRYPLYTKITVDIGTPS

SEQ ID NO: 1074 - protein, 468 aa, Bos taurus
QFPTDYDEGQDDRPKVGLGARGHRPYDKKKEEAPSLRPVPPPISGGGYRARPATATVGQKKVERKPPDADGCLHADPDLGVLCPTGCKLQDTLVRQERPIRKSIEDLRNTVDSVSRTSSSTFQYITLLKNMWKGRQNQVQDNENVVNEYSSHLEKHQLYIDETVKNNIPTKLRVLRSILENLRSKIQKLESDVSTQMEYCRTPCTVTCNIPVVSGKECEKIIRNEGETSEMYLIQPEDSSKPYRVYCDMKTEKGGWTVIQNRQDGSVDFGRKWDPYKQGFGNIATNAEGKKYCGVPGEYWLGNDRISQLTNMGPTKLLIEMEDWKGDKVTALYEGFTVQNEANKYQLSVSKYKGTAGNALIEGASQLVGENRTMTIHNSMFFSTYDRDNDGWKTTDPRKQCSKEDGGGWWYNRCHAANPNGRYYWGGAYTWDMAKHGTDDGVVWMNWQGSWYSMKKMSMKIRPYFPEQ

SEQ ID NO: 1075 - protein, 481 aa, Bos taurus
MVTSTGTLPSLLLGTLLTFTSGALGANPGLVVRITDQGLEYVAQEELLALQSKLHKVTLPDFNGDVRIKHFGSVDYRFHSLNIQSCKLLGSALKLLPNQGLHFSISDSFIQVTGDWKVRKRILRLDGSFDVKVKGITISVNLLLDSEPSGRPKVAVSSCSSHIRDVEVHISGDLGWLLNLFHNQIESRFRRVLESKICEIIEDSVTSELQPYLQTLPVTTEIDHLAGLDYSLMGAPQATAQMLDVMFKGEIFSRDDRFPVAFLAPVMNLPEEHSRMVYFAISDYAFNTASLVYHKAGFLNFTITDDVIPPDSSIRQNTKSFRAFVPRIARLYPNTNLELQGAVISAPCLNFSPGNLSTAAQMEIEAFVLLPNSVKEPVFRLSVATNVSAMLTFNTSKITGFLEPGKIQVELKESKVGRFNVELLEALLNYYLLNNFYPKVNDKLAEGFPLPLLRKIQLYDPILQIHKDFLFLGTNVRYLRV

SEQ ID NO: 1076 - protein, 580 aa, Bos taurus
MTPDIQAPFLSLLLLFPVLTVANVPTLTTSDSINPRRTTPVSTTQSSPTSSPTKETSWSTTTTLLTASSPAPSPAASPGHDGASTPTSSPAPSPAASPGHDGASTPTSSPAPSPAASPGHDGASTPTSSPAPSPAASPGHDGASTPTSSPAPSPAASPGHNGTSSPTGSPAPSPAASPGHDGASTPTSSPAPSPAASPGHNGTSSPTGSPAPSPAASPGHDGASTPTSSPAPSPAASPGHNGTSSPTGSPAPSPTASPGHDSAPSLTSSPAPSPTASPGQHGASSPTSSDTSSMTTRSMSSSMVTSAHKGTSSRATMTPVSKGTPSSVPSSETAPTAASHITRTAASSPSIALSTSSNPKTSQQLSVRVSLYFLSFRITNLQFNSSLENPQTSYYQELQRSIWGLILQIYKQRDFLGLSEIKFRPGSVVVELTLAFREGTTAEWVKAQFSQLEAHAASYNLTISGVSVYSAPFPSSAQAGSGVPGWGIALLVLVCVLVALAIIYLIALVVCQCGRKKCEQLDVFPTLDAYHPMSEYSTYHTHGRYVPPGSTKRSPYEEVSAGNGGSNLSYTNLAATSANL

SEQ ID NO: 1077 - protein, 495 aa, Glycine max
MAKLVFSLCFLLFSGCCFAFSSREQPQQNECQIQKLNALKPDNRIESEGGLIETWNPNNKPFQCAGVALSRCTLNRNALRRPSYTNGPQEIYIQQGKGIFGMIYPGCPSTFEEPQQPQQRGQSSRPQDRHQKIYNFREGDLIAVPTGVAWWMYNNEDTPVVAVSIIDTNSLENQLDQMPRRFYLAGNQEQEFLKYQQEQGGHQSQKGKHQQEEENEGGSILSGFTLEFLEHAFSVDKQIAKNLQGENEGEDKGAIVTVKGGLSVIKPPTDEQQQRPQEEEEEEEDEKPQCKGKDKHCQRPRGSQSKSRRNGIDETICTMRLRHNIGQTSSPDIYNPQAGSVTTATSLDFPALSWLRLSAEFGSLRKNAMFVPHYNLNANSIIYALNGRALIQVVNCNGERVFDGELQEGRVLIVPQNFVVAARSQSDNFEYVSFKTNDTPMIGTLAGANSLLNALPEEVIQHTFNLKSQQARQIKNNNPFKFLVPPQESQKRAVA

SEQ ID NO: 1078 - protein, 605 aa, Glycine max
MMRARFPLLLLGLVFLASVSVSFGIAYWEKENPKHNKCLQSCNSERDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFY

SEQ ID NO: 1079 - protein, 621 aa, Glycine max
MMRARFPLLLLGVVFLASVSVSFGIAYWEKQNPSHNKCLRSCNSEKDSYRNQACHARCNLLKVEEEEECEEGQIPRPRPQHPERERQQHGEKEEDEGEQPRPFPFPRPRQPHQEEEHEQKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFY

SEQ ID NO: 1080 - protein, 563 aa, Glycine max
MGKPFTLSLSSLCLLLLSSACFAISSSKLNECQLNNLNALEPDHRVESEGGLIQTWNSQHPELKCAGVTVSKLTLNRNGLHLPSYSPYPRMIIIAQGKGALGVAIPGCPETFEEPQEQSNRRGSRSQKQQLQDSHQKIRHFNEGDVLVIPPGVPYWTYNTGDEPVVAISLLDTSNFNNQLDQTPRVFYLAGNPDIEYPETMQQQQQQKSHGGRKQGQHQQEEEEEGGSVLSGFSKHFLAQSFNTNEDIAEKLQSPDDERKQIVTVEGGLSVISPKWQEQQDEDEDEDEDDEDEQIPSHPPRRPSHGKREQDEDEDEDEDKPRPSRPSQGKREQDQDQDEDEDEDEDQPRKSREWRSKKTQPRRPRQEEPRERGCETRNGVEENICTLKLHENIARPSRADFYNPKAGRISTLNSLTLPALRQFQLSAQYVVLYKNGIYSPHWNLNANSVIYVTRGQGKVRVVNCQGNAVFDGELRRGQLLVVPQNFVVAEQAGEQGFEYIVFKTHHNAVTSYLKDVFRAIPSEVLAHSYNLRQSQVSELKYEGNWGPLVNPESQQGSPRVKVA

SEQ ID NO: 1081 - protein, 491 aa, Glycine max
MGKPFFTLSLSSLCLLLLSSACFAITSSKFNECQLNNLNALEPDHRVESEGGLIETWNSQHPELQCAGVTVSKRTLNRNGLHLPSYSPYPQMIIVVQGKGAIGFAFPGCPETFEKPQQQSSRRGSRSQQQLQDSHQKIRHFNEGDVLVIPPGVPYWTYNTGDEPVVAISLLDTSNFNNQLDQNPRVFYLAGNPDIEHPETMQQQQQQKSHGGRKQGQHQQQEEEGGSVLSGFSKHFLAQSFNTNEDTAEKLRSPDDERKQIVTVEGGLSVISPKWQEQEDEDEDEDEEYEQTPSYPPRRPSHGKHEDDEDEDEEEDQPRPDHPPQRPSRPEQQEPRGRGCQTRNGVEENICTMKLHENIARPSRADFYNPKAGRISTLNSLTLPALRQFGLSAQYVVLYRNGIYSPHWNLNANSVIYVTRGKGRVRVVNCQGNAVFDGELRRGQLLVVPQNFVVAEQGGEQGLEYVVFKTHHNAVSSYIKDVFRAIPSEKV

SEQ ID NO: 1082 - protein, 481 aa, Glycine max
MAKLVLSLCFLLFSGCCFAFSFREQPQQNECQIQRLNALKPDNRIESEGGFIETWNPNNKPFQCAGVALSRCTLNRNALRRPSYTNAPQEIYIQQGSGIFGMIFPGCPSTFEEPQQKGQSSRPQDRHQKIYHFREGDLIAVPTGFAYWMYNNEDTPVVAVSLIDTNSFQNQLDQMPRRFYLAGNQEQEFLQYQPQKQQGGTQSQKGKRQQEEENEGGSILSGFAPEFLEHAFVVDRQIVRKLQGENEEEEKGAIVTVKGGLSVISPPTEEQQQRPEEEEKPDCDEKDKHCQSQSRNGIDETICTMRLRHNIGQTSSPDIFNPQAGSITTATSLDFPALSWLKLSAQFGSLRKNAMFVPHYNLNANSIIYALNGRALVQVVNCNGERVFDGELQEGQVLIVPQNFAVAARSQSDNFEYVSFKTNDRPSIGNLAGANSLLNALPEEVIQQTFNLRRQQARQVKNNNPFSFLVPPKESQRRVVA

SEQ ID NO: 1083 - protein, 516 aa, Glycine max
MGKPFFTLSLSSLCLLLLSSACFAITSSKFNECQLNNLNALEPDHRVESEGGLIETWNSQHPELQCAGVTVSKRTLNRNGSHLPSYLPYPQMIIVVQGKGAIGFAFPGCPETFEKPQQQSSRRGSRSQQQLQDSHQKIRHFNEGDVLVIPLGVPYWTYNTGDEPVVAISPLDTSNFNNQLDQNPRVFYLAGNPDIEHPETMQQQQQQKSHGGRKQGQHRQQEEEGGSVLSGFSKHFLAQSFNTNEDTAEKLRSPDDERKQIVTVEGGLSVISPKWQEQEDEDEDEDEEYGRTPSYPPRRPSHGKHEDDEDEDEEEDQPRPDHPPQRPSRPEQQEPRGRGCQTRNGVEENICTMKLHENIARPSRADFYNPKAGRISTLNSLTLPALRQFGLSAQYVVLYRNGIYSPDWNLNANSVTMTRGKGRVRVVNCQGNAVFDGELRRGQLLVVPQNPAVAEQGGEQGLEYVVFKTHHNAVSSYIKDVFRVIPSEVLSNSYNLGQSQVRQLKYQGNSGPLVNP

SEQ ID NO: 1084 - protein, 504 aa, Glycine max
MAMRTKLSLAIFFFFLLALFSNLAFGKCKETEVEEEDPELVTCKHQCQQPQQYTEGDKRVCLQRCDRYHRMKQEREKQIQEETREKKEEESREREEEQQEQHEEQDENPYIFEEDKDFETRVETEGGRIRVLKKFTEKSKLLQGIENFRLAILEARAHTFVSPRHFDSEVVFFNIKGRAVLGLVSESETEKITLEPGDMIHIPAGTPLYIVNRDENDKLFLAMLHIPVSVSTPGKFEEFFGPGGRDPESVLSAFSWNVLQAALQTPKGKLEKLFDQQNEGSIFAISREQVRALAPTKKSSWWPFGGESKPQFNIFSKRPTISNGYGRLTEVGPDDDEKSWLQRLNLMLTFTNITQRSMSTIHYNSHATKIALVIDGRGHLQISCPHMSSRSSHSKHDKSSPSYHRISSDLKPGMVFVVPPGHPFVTIASNKENLLMICFEVNARDNKKFTFAGKDNIVSSLDNVAKELAFNYPSEMVNGVFDRKESFFFPFELPREERGRRADA

SEQ ID NO: 1085 - protein, 857 aa, Glycine max
MLGGLLHRGHKIKGTVVLMRKNVLDVNSVTSVGGIIGQGLDLVGSTLDTLTAFLGRSVSLQLISATKADANGKGKLGKATFLEGIITSLPTLGAGQSAFKINFEWDDGSGIPGAFYIKNFMQTEFFLVSLTLEDIPNHGSIHFVCNSWIYNAKLFKSDRIFFANQTYLPSETPAPLVKYREEELHNLRGDGTGERKEWERIYDYDVYNDLGDPDKGENHARPVLGGNDTFPYPRRGRTGRKPTRKDPNSESRSNDVYLPRDEAFGHLKSSDFLTYGLKSVSQNVLPLLQSAFDLNFTPREFDSFDEVHGLYSGGIKLPTDIISKISPLPVLKEIFRTDGEQALKFPPPKVIQVSKSAWMTDEEFAREMLAGVNPNLIRCLKDFPPRSKLDSQVYGDHTSQITKEHLEPNLEGLTVDEAIQNKRLFLLDHHDPIMPYLRRINATSTKAYATRTILFLKNDGTLRPLAIELSLPHPQGDQSGAFSQVFLPADEGVESSIWLLAKAYVVVNDSCYHQLVSHWLNTHAVVEPFIIATNRHLSVVHPIYKLLHPHYRDTMNINGLARLSLVNDGGVIEQTFLWGRYSVEMSAVVYKDWVFTDQALPADLIKRGMAIEDPSCPHGIRLVIEDYPYAVDGLEIWDAIKTWVHEYVFLYYKSDDTLREDPELQACWKELVEVGHGDKKNEPWWPKMQTREELVEACAIIIWTASALHAAVNFGQYPYGGLILNRPTLSRRFMPEKGSAEYEELRKNPQKAYLKTITPKFQTLIDLSVIEILSRHASDEVYLGERDNPNWTSDTRALEAFKRFGNKLAQIENKLSERNNDEKLRNRCGPVQMPYTLLLPSSKEGLTFRGIPNSISI

SEQ ID NO: 1086 - protein, 524 aa, Glycine max
MGMRTKLSLAIFFFFLLALFSNLAFGKCKETEVEEEDPELVTCKHQCQQQQQYTEGDKRVCLQSCDRYHRMKQEREKQIQEETREKKEEESREREEEQQEQHEEQDENPYIFEEDKDFETRVETEGGRIRVLKKFTEKSKLLQGIENFRLAILEARAHTFVSPRHFDSEVVFFNIKGRAVLGLVSESETEKITLEPGDMIHIPAGTPLYIVNRDENDKLFLAMLHIPVSVSTPGKFEEFFAPGGRDPESVLSAFSWNVLQAALQTPKGKLENVFDQQNEGSIFRISREQVRALAPTKKSSWWPFGGESKPQFNIFSKRPTISNGYGRLTEVGPDDDEKSWLQRLNLMLTFTNITQRSMSTIHYNSHATKIALVIDGRGHLQISCPHMSSRSSHSKHDKSSPSYHRISSDLKPGMVFVVPPGHPFVTIASNKENLLMICFEVNARDNKKFTFAGKDNIVSSLDNVAKELAFNYPSEMVNGVFLLQRFLERKLIGRLYHLPHKDRKESFFFPFELPREERGRRADA

SEQ ID NO: 1087 - protein, 506 aa, Glycine max
MDHLKPRVSLLFLTDLTMATRAKLSLAIFLFFLLALISNLALGKLKETEVEEDPELVTCKHQCQQQRQYTESDKRTCLQQCDSMKQEREKQVEEETREKEEEHQEQHEEEEDENPYVFEEDKDFSTRVETEGGSIRVLKKFTEKSKLLQGIENFRLAILEARAHTFVSPRHFDSEVVLFNIKGRAVLGLVRESETEKITLEPGDMIHIPAGTPLYIVNRDENEKLLLAMLHIPVSTPGKFEEFFGPGGRDPESVLSAFSWNVLQAALQTPKGKLERLFNQQNEGSIFKISRERVRALAPTKKSSWWPFGGESKAQFNIFSKRPTFSNGYGRLTEVGPDDEKSWLQRLNLMLTFTNITQRSMSTIHYNSHATKIALVMDGRGHLQISCPHMSSRSDSKHDKSSPSYHRISADLKPGMVFVVPPGHPFVTIASNKENLLIICFEVNVRDNKKFTFAGKDNIVSSLDNVAKELAFNYPSEMVNGVFERKESLFFPFELPSEERGRRAVA

SEQ ID NO: 1088 - protein, 865 aa, Glycine max
MFSVPGVSGILNRGGGHKIKGTVVLMRKNVLDFNSVADLTKGNVGGLIGTGLNVVGSTLDNLTAFLGRSVALQLISATKPLANGKGKVGKDTFLEGIIVSLPTLGAGESAFNIQFEWDESMGIPGAFYIKNYMQVEFYLKSLTLEDVPNQGTIRFVCNSWVYNTKLYKSVRIFFANHTYVPSETPAALVGYREEELKNLRGDGKGERKEHDRIYDYDVYNDLGNPDHGENFARPILGGSSTHPYPRRGRTGRYPTRKDQNSEKPGEVYVPRDENFGHLKSSDFLAYGIKSLSQYVLPAFESVFDLNFTPNEFDSFQDVRDLHEGGIKLPTEVISTIMPLPVVKELFRTDGEQVLKFPPPHVIQVSKSAWMTDEEFAREMVAGVNPCVIRGLQEFPPKSNLDPTIYGEQTSKITADALDLDGYTVDEALASRRLFMLDYHDVFMPYIRRINQTYAKAYATRTILFLRENGTLKPVAIELSLPHPAGDLSGAVSQVILPAKEGVESTIWLLAKAYVVVNDSCYHQLMSHWLNTHAVIEPFIIATNRHLSALHPIYKLLTPHYRDTMNINALARQSLINADGIIEKSFLPSKHSVEMSSAVYKNWVFTDQALPADLIKRGVAIKDPSAPHGLRLLIEDYPYAVDGLEIWAAIKTWVQEYVSLYYARDDDVKPDSELQQWWKEAVEKGHGDLKDKPWWPKLQTIEELVEICTIIIWTASALHAAVNFGQYPYGGFILNRPTSSRRLLPEKGTPEYEEMVKSHQKAYLRTITSKFQTLVDLSVIEILSRHASDEVYLGQRDNPHWTSDSKALQAFQKFGNKLKEIEEKLARKNNDQSLSNRLGPVQLPYTLLHPNSEGLTCRGIPNSISI

SEQ ID NO: 1089 - protein, 357 aa, Glycine max
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKVITMLDFIFISFKDKT

SEQ ID NO: 1090 - protein, 216 aa, Glycine max
MKSTIFFLFLFCAFTTSYLPSAIADFVLDNEGNPLENGGTYYILSDITAFGGIRAAPTGNERCPLTVVQSRNELDKGIGTIISSPYRIRFIAEGHPLSLKFDSFAVIMLCVGIPTEWSVVEDLPEGPAVKIGENKDAMDGWFRLERVSDDEFNNYKLVFCPQQAEDDKCGDIGISIDHDDGTRRLVVSKNKPLVVQFQKLDKESLAKKNHGLSRSE

SEQ ID NO: 1091 - protein, 839 aa, Glycine max
MFSAGHKIKGTVVLMPKNELEVNPDGSAVDNLNAFLGRSVSLQLISATKADAHGKGKVGKDTFLEGINTSLPTLGAGESAFNIHFEWDGSMGIPGAFYIKNYMQVEFFLKSLTLEAISNQGTIRFVCNSWVYNTKLYKSVRIFFANHTYVPSETPAPLVSYREEELKSLRGNGTGERKEYDRIYDYDVYNDLGNPDKSEKLARPVLGGSSTFPYPRRGRTGRGPTVTDPNTEKQGEVFYVPRDENLGHLKSKDALEIGTKSLSQIVQPAFESAFDLKSTPIEFHSFQDVHDLYEGGIKLPRDVISTIIPLPVIKELYRTDGQHILKFPQPHVVQVSQSAWMTDEEFAREMIAGVNPCVIRGLEEFPPKSNLDPAIYGDQSSKITADSLDLDGYTMDEALGSRRLFMLDYHDIFMPYVRQINQLNSAKTYATRTILFLREDGTLKPVAIELSLPHSAGDLSAAVSQVVLPAKEGVESTIWLLAKAYVIVNDSCYHQLMSHWLNTHAAMEPFVIATHRHLSVLHPIYKLLTPHYRNNMNINALARQSLINANGIIETTFLPSKYSVEMSSAVYKNWVFTDQALPADLIKRGVAIKDPSTPHGVRLLIEDYPYAADGLEIWAAIKTWVQEYVPLYYARDDDVKNDSELQHWWKEAVEKGHGDLKDKPWWPKLQTLEDLVEVCLIIIWIASALHAAVNFGQYPYGGLIMNRPTASRRLLPEKGTPEYEEMINNHEKAYLRTITSKLPTLISLSVIEILSTHASDEVYLGQRDNPHWTSDSKALQAFQKFGNKLKEIEEKLVRRNNDPSLQGNRLGPVQLPYTLLYPSSEEGLTFRGIPNSISI

SEQ ID NO: 1092 - protein, 338 aa, Glycine max
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 1093 - protein, 388 aa, Glycine max
MSDPTLAQPHLVEVHTTLETVVTTHNHNHRPSINASGEKKKIVGVFYKGNEYAKLNPNFVGCVEGALGIREWLESQGHQYIVTDDKEGPDSELEKHIPDAHVIISTPFHPAYVTAERIKKAQKLELLLTAGIGSDHVDLKAAAAAGLTVAEVTGSNVVSVAEDELMRILILMRNFLPGYHQAVKGEWNVAGIAHRAYDLEGKTVGTVGAGRIGKLLLQRLKPFNCNLLYFDRLRIDPELEKEIGAKFEEDLDAMLPKCDVIVINTPLTEQTRGLFDKNRIAKCKKGVLIVNNARGAIADTQAIADACSSGHVAGYSGDVWFPQPAPKDHPWRYMPNHAMTPHISGTTIDAQLRYAAGVKDMLDRHFKGEDFPEQNYIVKEGQLASQYR

SEQ ID NO: 1094 - protein, 340 aa, Glycine max
MASDKKIRIGINGFGRIGRLVARVALQRNDVELVAVNDPFITTDYMTYMFKYDTVHGQWKHFDVKVKDSKTLLFGEKPVTVFGIRNPEEIPWGEVGADYVVESTGVFTDKDKAAAHLKGGAKKVVISAPSKDAPMFVVGVNEKEYKPELDIVSNASCTTNCLAPLAKVINDRFGIVEGLMTTVHAITATQKTVDGPSNKDWRGGRAASFNIIPSSTGAAKAVGKVLPALNGKLTGMSFRVPTVDVSVVDLTVRLEKPATYEQIKSAIKEESEGKLKGILGYTEDDVVSTDFVGDNRSSIFDAKAGISLNDNFVKLVSWYDNEWGYSSRVIDLIVHIASVA

SEQ ID NO: 1095 - protein, 426 aa, Glycine max
MYPIHLAYLPITAVFYSSTAFLKPYLSPTSATSYSNHFLFSRSHGYANNHHTLTVFFSFSTLHSVSSDVIFLLLSFLIFVLFSNELHGSGKVKIGINGFGRIGRLVARVALQRDDVELVAVNDPFITTDYMTYMFKYDSVHGHWKHHDVTVKDEKTLLFGDKPVTVFGHRNPEEIPWKSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 1096 - protein, 338 aa, Glycine max
MGKVKIGINGFGRIGRLVARVALQRDDVELVAVNDPFITTDYMTYMFKYDSVHGHWKHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDNRSSIFDAKAGIALNKNFVKLVSWYDNEWGYSSRVIDLLVIVAKKSF

SEQ ID NO: 1097 - protein, 439 aa, Glycine max
MMRVRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALY

SEQ ID NO: 1098 - protein, 389 aa, Glycine max
MSDPTLAQQHLVKVHTTTHETVVTTHNHNQTPSINASGEKKKIVGVFYKGNEYAKLNPNFVGCVEGALGIREWLESQGHQYIVTDDKEGPDSELEKHIPDAHVIISTPFHPAYVTAERIKKAKNLELLLTAGIGSDHVDLKAAAAAGLTVAEVTGSNVVSVAEDELMRILILMRNFLPGYHQAVNGEWNVAGIAHRAYDLEGKTVGTVGAGRIGKLLLQRLKPFSCNLLYFDRLRIDPELEKEIGAKFEEDLDAMLPKCDVIVINTPLTEQTRGLFDKNRIAKCKKGVLIVNNARGAIADTQAIADACSSGHVAGYSGDVWFPQPAPKDHPWRYMPNHAMTPHISGTTIDAQLRYAAGVKDMLDRHFKGEDFPEQNYIVKEGQLASQYR

SEQ ID NO: 1099 - protein, 226 aa, Glycine max
MTTQVPPHSVQVHTTTHRYEAGVVPPGARFEPPRYEAGVKAPSIYHSERGPTTSQVLAVLAGLPVGGILLLLAGLTLAGTLTGLAVATPLFVLFSPVLVPATVAIGLAVAGFLTSGAFGLTALSSFSWILNYIRETQPASENLAAAAKHHLAEAAEYVGQKTKEVGQKTKEVGQDIQSKAQDTREAAARDAREAAARDAREAAARDAKVEARDVKRTTVTATTATA

SEQ ID NO: 1100 - protein, 223 aa, Glycine max
MTTVPPHSVQVHTTTHRYEAGVVPPARFEAPRYEAGIKAPSSIYHSERGPTTSQVLAVVAGLPVGGILLLLAGLTLAGTLTGLVVATPLFIIFSPVLIPATVAIGLAVAGFLTSGVFGLTALSSFSWILNYIRETQPASENLAAAAKHHLAEAAEYVGQKTKEVGQKTKEVGQDIQSKAQDTREAAARDARDAREAAARDARDAKVEARDVKRTTVTATTATA

SEQ ID NO: 1101 - protein, 584 aa, Glycine max
MIARFPLLPLLLLGIVFLASVSVSLQVKPPSHHECLQSCESETDPYKRKACKLSCKFVPEHGEQQHEEEEREREHPQPHPPHEERGRRERGRQEGEKEEKEQDERELQPRPFPRPEEHEGEQWKGRHRHEDPEERARMRLREAERIEREREEQRVREEEEKLRRREKKEQREEKEEEGQGSEDSHSKRQNNPFHFSSNRFQTLFKNQHGHLRVLQRFDQRSPQLENLRDYRVVELMAKPNTLFLPHHADADFLLLVLSGRALINLVKPDDRDPYYLDRGYAQRIPAGTTVYLVNPDKKKDLRVIKLAIPVNKPGNFEDFFLSSTQDQQSYLQGFSENILEASFNTKFEEINRVLFGGEGRRHQQEGVILELSKEQIRELSKRAKSSSRSTNSFDYEPFYLRGSQISSNNFGKFYEITPEKNPQLRDFDILLNTVDINEGGLLLPHYNSKAIVILMVTEGEANIELVGLKEQQQGEETREVRKYRAELSEDDIFVIPAAYPFVVNATSNLNFVAFGINAENNQRNFLAGSKDNVIRQIQKQVKELAFPAGSAQDIENLIKNQRESYFADAQPLQKEEGKKGSFVF

SEQ ID NO: 1102 - protein, 358 aa, Glycine max
MSHFKGKYHDELIANAAYIGTPGKGILAADESTGTIGKRLASISVENIESNRRALRELLFTAPGVLQYLSGVILFEETLYQSTAAGKPFVNVLKEAGVLPGIKVDKGTVELAGTNGETTTQGLDGLGQRCAKYYEAGARFAKWRAVLKIGPNEPSELSIHENAYGLARYAVICQENGLVPIVEPEILVDGPHDIHKCAAVTERVLAACYKALNDHHVLLEGTLLKPNMVTPGSQSAKVSPQVVAEHTVRALQRTVPAAVPAVVFLSGGQSEEEASVNLNAINQVNGKKPWSLSFSFGRALQQSTLKAWGGKEENVKKAQEALLVRAKANSEATLGTYKGNSQLADGASESLHVSNYSY

SEQ ID NO: 1103 - protein, 427 aa, Glycine max
MASILHYFLALSLSCSFLFFLSDSVTPTKPINLVVLPVQNDGSTGLHWANLQKRTPLMQVPVLVDLNGNHLWVNCEQQYSSKTYQAPFCHSTQCSRANTHQCLSCPAASRPGCHKNTCGLMSTNPITQQTGLGELGEDVLAIHATQGSTQQLGPLVTVPQFLFSCAPSFLVQKGLPRNTQGVAGLGHAPISLPNQLASHFGLQRQFTTCLSRYPTSKGAIIFGDAPNNMRQFQNQDIFHDLAFTPLTITLQGEYNVRVNSIRINQHSVFPLNKISSTIVGSTSGGTMISTSTPHMVLQQSVYQAFTQVFAQQLPKQAQVKSVAPFGLCFNSNKINAYPSVDLVMDKPNGPVWRISGEDLMVQAQPGVTCLGVMNGGMQPRAEITLGARQLEENLVVFDLARSRVGFSTSSLHSHGVKCADLFNFANA

SEQ ID NO: 1104 - protein, 380 aa, Glycine max
MSSTVGQTIKCKAAIAWEAGKPLVIEEVEVAPPQAGEVRLKILYTSLCHTDVYFWDAKGQTPLFPRIFGHEASGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVGLAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGQSIRCIIRMQE

SEQ ID NO: 1105 - protein, 377 aa, Glycine max
MADAEDIQPLVVDNGTGMVKAGFAGDDAPRAVFPSIIGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTEYLVKILTERGYSFSTSAEKEIVRDVKEKLAYVALDFEQEMETTKSSSAVEKSYELPDGQVITIGSERFRCPEVLFQPSLIGMEATGIHETTYNSIMKCDVDIRKDLYGNIVLSGGSTMFPGIADRMSKEIGALAPSSMKIKVVAPPERKYSVWIGGSILASLSTFQQMWISKGEYDESGPAIVHRKCF

SEQ ID NO: 1106 - protein, 371 aa, Glycine max
MRAAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 1107 - protein, 433 aa, Glycine max
MASILHYFLALSLSFSFLFFLSDSVPIPQHHTNPTKPINLLVLPVQNDASTGLHWANLQKRTPLMQVPVLVDLNGNHLWVNCEQHYSSKTYQAPFCHSTQCSRANTHQCLSCPAASRPGCHKNTCGLMSTNPITQQTGLGELGQDVLAIHATQGSTQQLGPLVTVPQFLFSCAPSFLLQKGLPRNIQGVAGLGHAPISLPNQLASHFGLQHQFTTCLSRYPTSKGALIFGDAPNNMQQFHNQDIFHDLAFTPLTVTPQGEYNVRVSSIRINQHSVFPPNKISSTIVGSSGGTMISTSTPHMVLQQSLYQAFTQVFAQQLEKQAQVKSVAPFGLCFNSNKINAYPSVDLVMDKPNGPVWRISGEDLMVQAQPGVTCLGVMNGGMQPRAEVTLGTRQLEEKLMVFDLARSRVGFSTSSLHSHGVKCGDLFNFANA

SEQ ID NO: 1108 - protein, 349 aa, Glycine max
MSSSTVGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGVSFNID

SEQ ID NO: 1109 - protein, 763 aa, Glycine max
MASHIVGYPRMGPKRELKFALESFWDGKSSAEDLQKVSSDLRASIWKQMADAGIKYIPSNTFSHYDQVLDATATLGAVPPRYGWTGGEIGFDTYFSMARGNATVPAMEMTKWFDTNYHFIVPELGPDVNFTYASHKAVDEYKEAKALGVDTVPVLVGPVTYLLLSKPAKGVEKSFSLLSLLPKVLAVYKEVIADLKAAGASWIQFDEPTLVLDLESHKLQAFTDAYAELAPALSGLNVLVETYFADIPAEAYKTLTSLNGVTAYGFDLVRGTNTLDLIKGGFPSGKYLFAGVVDGRNIWANDLAASLTTLQGLEGIVGKDKLVVSTSSSLLHTAVDLVNETKLDDEIKSWLAFAAQKIVEVNALAKALSGHKDEAFFSGNAAALASRKSSPRVTNEAVQKAAAALKGSDHRRATNVSARLDSQQKKLNLPILPTTTIGSFPQTVELRRVRREFKANKISEEEYVKSIKEEIRKVVELQEELDIDVLVHGEPERNDMVEYFGEQLSGFAFTVNGWVQSYGSRCVKPPIIYGDVSRPKPMTVFWSSLAQSFTKRPMKGMLTGPVTILNWSFVRNDQPRSETTYQIALSIKDEVEDLEKAGITVIQIDEAALREGLPLRKSEQAHYLDWAVHAFRITNVGVQDTTQIHTHMCYSNFNDIIHSIIDMDADVITIENSRSDEKLLSVFREGVKYGAGIGPGVYDIHSPRIPPTEEIADRINKMLAVLEKNILWVNPDCGLKTRKYTEVKPALTNMVAAAKLIRNELAK

SEQ ID NO: 1110 - protein, 285 aa, Glycine max
MATSKLKTQNVVVSLSLTLTLVLVLLTSKANSAETVSFSWNKFVPKQPNMILQGDAIVTSSGKLQLNKVDENGTPKPSSLGRALYSTPIHIWDKETGSVASFAASFNFTFYAPDTKRLADGLAFFLAPIDTKPQTHAGYLGLFNENESGDQVVAVEFDTFRNSWDPPNPHIGINVNSIRSIKTTSWDLANNKVAKVLITYDASTSLLVASLVYPSQRTSNILSDVVDLKTSLPEWVRIGFSAATGLDIPGESHDVLSWSFASNLPHASSNIDPLDLTSFVLHEAI

SEQ ID NO: 1111 - protein, 158 aa, Glycine max
MTKFTILLISLLFCIAHTCSASKWQHQQDSCRKQLQGVNLTPCEKHIMEKIQGRGDDDDDDDDDNHILRTMRGRINYIRRNEGKDEDEEEEGHMQKCCTEMSELRSPKCQCKALQKIMENQSEELEEKQKKKMEKELINLATMCRFGPMIQCDLSSDD

SEQ ID NO: 1112 - protein, 805 aa, Glycine max
MATDRLTRVHSLRERLDETLTANRNEILALLSRIEAKGKGILQHHQVIAEFEEIPEENRQKLTDGAFGEVLRSTQEAIVLPPWVALAVRPRPGVWEYLKVNVHALVVEELQPAEYLHFKEELVDGSSNGNFVLELDFEPFNAAFPRPTLNKSIGNGVQFLNRHLSAKLFHDKESLHPLLEFLRLHSVKGKTLMLNDRIQNPDALQHVLRKAEEYLGTVPPETPYSEFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAIGTTCGQRLEKVFGTEHSHILRVPFRTEKGIVRQWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPPTETSRRLTSFHPEIEELLYSSVENEEHICVLKDRSKPIIFTMARLDRVKNITGLVEWYGKNAKLRELVNLVVVAGDRRKESKDLEEKAEMKKMYGLIETYKLNGQFRWISSQMNRVRNGELYRVICDTKGAFVQPAIYEAFGLTVVEAMTCGLPTFATCNGGPAEIIVHGKSGFHIDPYHGDRAADLLVDFFEKCKLDPTHWETISKAGLQRIEEKYTWQIYSQRLLTLTGVYGFWKHVSNLDRRESRRYLEMFYALKYRKLAESVPLAVE

SEQ ID NO: 1113 - protein, 447 aa, Glycine max
MGKEKVHISIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLSFTLGVKQMICCCNKMDATTPKYSKARYDEIVKEVSSYLKKVGYNPDKIPFVPISGFEGDNMIERSTNLDWYKGPTLLDALDQISEPKRPSDKPLRLPLQDVYKIGGIGTVPVGRVETGVLKPGMVVTFAPTGLTTEVKSVEMHHESLTEAHPGDNVGFNVKNVAVKDLKRGYVASNSKDDPAKEAANFTAQVIIINHPGQIGNGYAPVLDCHTSHIAVKFAELMTKIDRRSGKELEKEPKFLKNGDAGFVKMIPTKPMVVETFSEYPPLGRFAVRDMRQTVAVGVIKNVEKKDPTGAKVTKAAQKKK

SEQ ID NO: 1114 - protein, 525 aa, Glycine max
MPKFFHSIFRGTMAGRVSTCFFFVFALSLLLPFQISAEESSEKEFVLTLDHSNFHDTVSKHDFIVVEFYAPWCGHCKKLAPEYEKAASILSSHDPPVVLAKIDANEEKNKDLASQYDVRGYPTIKILRNGGKNVQEYKGPREADGIVDYLKKQSGPASTEIKSADEATAFIGENKVAIVGVFPKFSGEEFDNFSALAEKLRSDYDFGHTLNAKHLPRGESSVSGPVVRLFKPFDELFVDFQDFNVEALEKFVEESSTPVVTVFNNDPSNHPFVAKFFNSPNAKAMLFINFTAEGAESFKSKYREAAEQHKQQGVSFLVGDVESSQGAFQYFGLKEEQVPLIIIQHNDGKKFFKPNLEADHIPTWLKAYKDGNVAPFVKSEPIPEANDEPVKVVVGNSLEDIVFKSGKNVLLEFYAPWCGHCKQLAPILDEVAISYQSDADVVIAKLDATANDIPSETFDVQGYPTVYFRSASGKLSQYEGGRTKEDIIEFIEKNRDKPAQQEQGQDKPAQQEQGQDEQEKGKDEL

SEQ ID NO: 1115 - protein, 377 aa, Glycine max
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYTFTTSAEREIVRDMKEKLAYIALDYEQELETAKTSSAVEKSYELPDGQVITIGAERFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 1116 - protein, 444 aa, Glycine max
MATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 1117 - protein, 234 aa, Glycine max
METHKNGEPTTGTYLRDTATSAIQNFAPINKIHQHLCAFHFYSYDMSRQVEAHHFCAHQNEEMRQCLIYDSPEKKARLIGLEYIISENLYLTLPDQEKRLWHSHLYEVKSGLFFMPKVPALIQRPDMETVCTTYGKVFHFWQVDKGHSLPFGIPQLMMALTRDGQIYDHLLQSSAERMGIDYEEERKAREYMTGPVHGIHPLANGGGKGLELRLREVELKHDPSPPSVKARILF

SEQ ID NO: 1118 - protein, 419 aa, Glycine max
MALILHATKANKNAFKTLIAAEYSGVQVELAPNFEMGVSNRTPEFLKMNPIGKVPVLETPDGPVFESNAIARYVARLKGDNALFSSSAIDNAHIDQWIDFSSLEIDANIMKLYLPRLGFAPYLPPVEEGANSALKRAFEALNTHLASNTYLVGHSVTLADIITTCNLYLGFSQLLVKSFTSEFPHVERYFWTLVNQPNFRKILGQVKQTESVPPIPSAAKKPSQPKESKPKPKDEPKKAAKPEPKQEAEPEEEAPKPKPKNPLDLLPPSKMILDDWKRLYSNTKTNFREVAIKGFWDMYDPEGYSLWFCDYKYNDENTVSFVTLNKVGGFLQRMDLARKYAFGKMLVIGSQAPFKVKGLWLFRGQEIPKFVIDECYDMELYDWTKVDISDETQKERVNQMIEDFEPFEGESLLDAKCFK

SEQ ID NO: 1119 - protein, 379 aa, Glycine max
MGFLVLLLFSLLGLSSSSSISTHRSILDLDLTKFTTQKQVSSLFQLWKSEHGRVYHNHEEEAKRLEIFKNNLNYIRDMNANRKSPHSHRLGLNKFADITPQEFSKKYLQAPKDVSQQIKMANKKMKKEQYSCDHPPASWDWRKKGVITQVKYQGGCGSGWAFSATGAIEAAHAIATGDLVSLSEQELVDCVEESEGCYNGWHYQSFEWVLEHGGIATDDDYPYRAKEGRCKANKIQDKVTIDGYETLIMSDESTESETEQAFLSAILEQPISVSIDAKDFHLYTGGIYDGENCTSPYGINHFVLLVGYGSADGVDYWIAKNSWGEDWGEDGYIWIQRNTGNLLGVCGMNYFASYPTKEESETLVSARVKGHRRVDHSPL

SEQ ID NO: 1120 - protein, 83 aa, Glycine max; identical to SEQ ID NO: 652

SEQ ID NO: 1121 - protein, 245 aa, Glycine max
MASTDKSPDPTPAKGPDPTPGKPMSVGQHVIDKSAMMVQSLDPIKQMSQHVCSFAIYSHDMSRQIETHHYCSRLHQNFIQCAVYDSDESKARLLGVEYIVPADVFEAFPPEEQKLWHSHAYEIKSGLLVNPRVPEVVAMPELENLAQTYGKFWCTWQVDRGDRLPMGAPALMMSPQAASPGLVRAELVLERDAKYNFSSKSLKSSRLEIPEPEMINPLADYWKQHGKGFVIDIEETEMKLRPPFP

SEQ ID NO: 1122 - protein, 294 aa, Glycine max
MASNKESKFPAQSQKTQPGKEHVMNPLPQATNPDHKAANKLQGKVALVTGGDSGIGRAVCLCFAKEGATVAFTYVKGHEDRDKDDTLKMLLEAKTSGADNPLAIAADIGFDENCKQVIDLVVKEYGRLDVLVNNAAEQHLTNSVEEITQQQLERVFGTNIFSQFFLVKHALKHMKEGSCIINSTSVNAYNGNPEALDYTATKGAIVAFTRGLSQQLASRGIRVNGVAPGPVWTPIQPASKPAEMIQNLGCEVPMNRVAQPCEIAPCYLFLATCQDSSYFTGQVLHPNGGMVVNA

SEQ ID NO: 1123 - protein, 570 aa, Glycine max
MAAIATIFVSIIPTSPSPFLTRLTSRLHFAAFPLRSPTRKLMSHTLARATLGLTHPSNIETPKISFGAKDVDVTEWKGDILAVGVTEKDLARDANSKFENVILSKIDSKLGGLLAEASSEEDFSGKVGQSTVLRITGLGSKRVGLIGLGQSPSTPAPFKSLGEAIVAAAKSSQASSVAVALASSEGLSAQSKLSTAYAIASGAVLGLFEDNRYKSEAKKSTLRSIDFIGLGTGPELEKKLKYAGDVSSGIIFGRELVNSPANVLTPGVLAEEAAKIASTYSDVFTAKILNSEQCAELKMGSYLGVAAASANPPHFIHLCYKPLSGPVNVKLALVGKGLTFDSGGYNIKTGPGCSIELMKFDMGGSAAVLGTAKALGQIKPLGVEVHFIVAACENMISGTGMRPGDIVTASNGKTIEVNNTDAEGRLTLADALVYACNQGVEKIIDLATLTGACVVALGPSIAGVFTPCDDLAKEVFEASDVSGEKLWRLPLEESYWETMKSGVADMLNTGGRQGGAIVAALFLKQFVDEKVQWMHIDMAGPVWNDKKRSATGFGIATLVEWVLKNASNAN

SEQ ID NO: 1124 - protein, 701 aa, Glycine max
MLVLSSEHYKWRSPRRKLNKTAIRPSRKERKGDMIMARSFSRGSLLPLAIVSLVCLFVISIAKEEATKLGTVIGIDLGTTYSCVGVYKNGHVEIIANDQGNRITPSWVAFTDSERLIGEAAKNLAAVNPERTIFDVKRLIGRKFEDKEVQRDMKLVPYKIVNKDGKPYIQVKIKDGETKVFSPEEISAMILTKMKETAEAFLGKKINDAVVTVPAYFNDAQRQATKDAGVIAGLNVARIINEPTAAAIAYGLDKKGGEKNILVFDLGGGTFDVSILTIDNGVFEVLATNGDTHLGGEDFDQRIMEYFIKLIKKKHGKDISKDSRALGKLRREAERAKRALSSQHQVRVEIESLFDGVDFSEPLTRARFEELNNDLFRKTMGPVKKAMEDAGLQKSQIDEIVLVGGSTRIPKVQQLLKDYFDGKEPNKGVNPDEAVAYGAAVQGSILSGEGGEETKDILLLDVAPLTLGIETVGGVMTKLIPRNTVIPTKKSQVFTTYQDQQTTVSIQVFEGERSLTKDCRLLGKFELSGIPPAPRGTPQIEVTFEVDANGILNVKAEDKGTGKSEKITITNEKGRLSQEEIERMVREAEEFAEEDKKVKERIDARNSLETYVYNMKNQIGDKDKLADKLESDEKEKIETAVKEALEWLDDNQSVEKEEYEEKLKEVEAVCNPIISAVYQRSGGAPGGGASGEEDDDSHDEL

SEQ ID NO: 1125 - protein, 503 aa, Glycine max
MAGTVSTCFFFVFLLSLLLPFQISAEESSEKEFVLTLDHSNFHDTVSKHDFIVVEFYAPWCGHCKKLAPEYEKAASILSSHDPPIVLAKVDANEEKNKDLASQYDVKGFPTINILRNGGKNVQEYKGPREADGIVDYLKKQSGPASTEIKSADEATAFIGENKVAIVGVFPKFSGEEFDNFSALAEKLRSDYDFGHTLNAKLLPRGESSVSGPVVRLFKPFDELFVDFQDFNVEALEKFVEESSTPVVTVFNNEPSNHPFVVKFFNSPNAKAMLFINFTAEGAEAIKSKYREAAEQYKQQGVSFLVGDVESSQGAFQYFGLKEEQVPLIIIQHNDGKKFFKPNLEADHIPTWLKAYKDGHVAPFVKSEPIPETNDEPVKVVVGASLEDIVFKSGKNVLLEFYAPWCGHCKQLAPILDEVAISYQNEADVVIAKLDATANDIPSETFDVQGYPTVYFRSASGKLSQYDGGRTKEDIIEFIEKNRDKPAQQEQGKDEQEQGKDEL

SEQ ID NO: 1126 - protein, 559 aa, Glycine max
MASRRFVSSLIRSSLRRSQSKPSISASASRLTSSNRASPHGYLLNRVAEYATAAAAATAPPSAPPPGKKEVSGGGKITDEFTGKGSIGQVCQVIGAVVDVRFDEGLPPIMTALEVLDHSSRLVLEVAQHLGEGVVRTIAMDATEGVVRGWRVLNTGSPITVPVGRATLGRIINVIGEPIDDKGEINTEHYLPIHREAPAFVEQETAQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFVDNIFRFTQANSEVSALLGRIPSAVGYQPTLSTDLGALQERITTTKKGSITSVQAIYVPADDLTDPAPATTFAHLDATTVLSRQISELGIYPAVDPLDSTSRMLSPLILGADHYETARGVQKVLQNYKNLQDIIAILGMDELSEDDKLTVARARKIQRFLSQPFHVAEVFTGAPGKYVELKENITSFQGVLDGKYDDLPEQSFYMVGGIEEVIAKAEKIAKESAAS

SEQ ID NO: 1127 - protein, 203 aa, Glycine max
MKSTIFFALFLVCAFTISYLPSATAQFVLDTDDDPLQNGGTYYMLPVMRGKGGGIEVDSTGKEICPLTVVQSPNELDKGIGLVFTSPLHALFIAERYPLSIKFGSFAVITLCAGMPTEWAIVEREGLQAVKLAARDTVDGWFNIERVSREYNDYKLVFCPQQAEDNKCEDIGIQIDDDGIRRLVLSKNKPLVVQFQKFRSSTA

SEQ ID NO: 1128 - protein, 328 aa, Glycine max
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMTKNVSIYKSQASALEKHAAANCKVLVVANPANTNALILKEFAPSIPEKNISCLTRLDHNRALGQISERLNIQVSDVKNVIIWGNHSSTQYPDVNHATVGEKPVRELIADDAWLNGEFITTVQQRGAAIIKARKLSSALSAASAACDHIRDWVLGTPQGTWVSMGVYSDGSYNVPAGLIYSFPVTCANGEWTIVQGLPIDEFSRKKLDLTAEELSEEKALAYSCLN

SEQ ID NO: 1129 - protein, 307 aa, Glycine max
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMTKNVSIYKSQASALEKHAAANCKVLVVANPANTNALILKEFAPSIPEKNISCLTRLDHNRALGQISERLTVQVSDVKNVIIWGNHSSTQYPDVNHATVATSAGEKPVRELIADDAWLNGEFITTVQQRGAAIIKARKLSSALSAASAACDHIRDWVLGTPQGTWVSMGVYSDGSYNVPAGLIYSFPVTCANGEWAIVQGKCFVT

SEQ ID NO: 1130 - protein, 485 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLYVNDAFGTAHRAHASTEGVTKYLKPSVAGFLLQKELDYLVGAVSNPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 1131 - protein, 843 aa, Glycine max
MVKFTAEELRRIMDYKHNIRNMSVIAHVDHGKSTLTDSLVAAAGIIAQEVAGDVRMTDTRADEAERGITIKSTGISLYYEMTDEALKSFKGERNGNEYLINLIDSPGHVDFSSEVTAALRITDGALVVVDCVEGVCVQTETVLRQALGERIRPVLTVNKMDRCFLELQVDGEEAYQTFQRVIENANVIMATYEDPLLGDVQVYPEKGTVAFSAGLHGWAFTLTNFAKMYASKFGVDEGKMMERLWGENFFDPATKKWTSKNSGSATCKRGFVQFCYEPIKQIINTCMNDQKDKLWPMLQKLGVTMKSEEKDLMGKALMKRVMQTWLPASSALLEMMIFHLPSPSTAQKYRVENLYEGPLDDQYASAIRNCDPEGPLMLYVSKMIPASDKGRFFAFGRVFSGRVSTGLKVRIMGPNYVPGEKKDLYVKSVQRTVIWMGKRQETVEDVPCGNTVAMVGLDQFITKNATLTNEKEVDAHPIRAMKFSVSPVVRVAVQCKVASDLPKLVEGLKRLAKSDPMVVCTIEESGEHIVAGAGELHLEICLKDLQDDFMGGAEIIKSDPVVSFRETVLERSCRTVMSKSPNKHNRLYMEARPLEEGLAEAIDDGKIGPRDDPKVRSKILSEEFGWDKDLAKKIWCFGPETLGPNMVVDMCKGVQYLNEIKDSVVAGFQWASKEGALAEENMRAICFEVCDVVLHADAIHRGGGQIIPTARRVFYASQITAKPRLLEPVYLVEIQAPEQALGGIYSVLNQKRGHVFEEMQRPGTPLYNIKAYLPVIESFGFSSTLRAATSGQAFPQCVFDHWDMMSSDPLEAGSQAAQLVTDIRKRKGLKEQMTPLSEFEDKL

SEQ ID NO: 1132 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 1133 - protein, 449 aa, Glycine max
MREIISIHIGQAGIQVGNSCWELYCLEHGIQPDGMMPSDSTFGVAHDAFNTFFSETGSGKHVPRAVFVDLEPTVIDEVRCGTYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDITEFQTNLVPYPRIHFMLSSYAPVISAAKAYHEQLSVPEITNAVFEPASMMAKCDPRHGKYMACCLMYRGDVVPKDVNAAVATIKTKRTVQFVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGAEDDEEGEDY

SEQ ID NO: 1134 - protein, 448 aa, Glycine max
MREILHIQGGQCGNQIGAKFWEVVCAEHGIDSTGRYQGDNELQLERVNVYYNEASCGRFVPRAVLMDLEPGTMDSVRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADDEGYEYEDEEEPQEDEV

SEQ ID NO: 1135 - protein, 456 aa, Glycine max
MRPPVILKTTTSLLDSSSSSPPCDRRLNTLARHFLPQMASHDSISASPTSASDSVFNHLVRAPEDPILGVTVAYNKDPSPVKLNLGVGAYRTEEGKPLVLNVVRRVEQQLINDVSRNKEYIPIVGLADFNKLSAKLIFGADSPAIQDNRVTTVQCLSGTGSLRVGGEFLAKHYHQRTIYLPTPTWGNHPKVFNLAGLSVKTYRYYAPATRGLDFQGLLEDLGSAPSGSIVLLHACAHNPTGVDPTLEQWEQIRQLIRSKALLPFFDSAYQGFASGSLDADAQPVRLFVADGGELLVAQSYAKNLGLYGERVGALSIVCKSADVASRVESQLKLVIRPMYSSPPIHGASIVAAILKDRNLFNDWTIELKAMADRIISMRQELFDALCSRGTPGDWSHIIKQIGMFTFTGLNAEQVSFMTKEFHIYMTSDGRISMAGLSSKTVPLLADAIHAAVTRVV

SEQ ID NO: 1136 - protein, 310 aa, Glycine max
MATATNAAAAPPRQLSQKEADIQMMLAADVHLGTKNCDFQMERYIFKRRNDGIYIINLGKTWEKLQLAARVIVAIENPQDIIVQSARPYGQRAVLKFAQYTGAHAIAGRHTPGTFTNQLQTSFSEPRLLILTDPRTDHQPIKEAALGNIPTIAFCDTDSPMRYVDIGIPANNKGKHSIGCLFWLLARMVLQMRGTIRPGLKWDVMVDLFFYREPEEAKQQEEEEAPAVDYAITDFNAGAIAADGQWPGTIDQSWSDAVPQPIPAVPGVNWGAPAEAPAAAGGDWGEAVPPPQQIPVPPSGIDTVQPSGWD

SEQ ID NO: 1137 - protein, 508 aa, Glycine max
MEFSVRAAELTTLLESRITNFYTNFQVDEIGRVVSVGDGIARVYGLNEIQAGEMVEFASGVKGIALNLENENVGIVVFGSDTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVAQLVQILSEANALEYSILVAATASDPAPLQFLAPYSGCAMGEYFRDNGMHALIIYDDLSKQAVAYRQMSLLLRRPPGREAFPGDVFYLHSRLLERAAKRSDQTGAGSLTALPVIETQAGDVSAYIPTNVISITDGQICLETELFYRGIRPAINVGLSVSRVGSAAQLKAMKQVCGSLKLELAQYREVAAFAQFGSDLDAATQALLNRGARLTEVLKQPQYAPLPIEKQILVIYAAVNGFCDRMPLDKIPQYERDILTTIKPELLQSLKGGLTSERKIELEKFLKEKGGTYYI

SEQ ID NO: 1138 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 1139 - protein, 702 aa, Glycine max
MAETETFAFQAEINQLLSLIINTFYSNKEIFLRELISNASDALDKIRFESLTDKSKLDAQPELFIHIIPDKTNNSLTIVDSGIGMTKADLVNNLGTIARSGTKEFMEALAAGADVSMIGQFGVGFYSAYLVAEKVIVTSKHNDDEQYVWESQAGGSFTVTRDTSGEVLGRGTKITLFLKEDQLEYLEERRLKDLIKKHSEFISYPISLWVEKTTEKEISDDEDEEEKKDEEGKVEDVDEEKEKEEKKKKKIKEVSHEWSLVNKQKPIWMRKPEEITKEEYSAFYKSLTNDWEEHLAVKHFSVEGQLEFKAILFVPKRAPFDLFDTRKKPNNIKLYVRRVFIMDNCEELIPEYLGFVKGIVDSEDLPLNISREMLQQNKILKVIRKNLVKKCLELFFEIAENKEDYNKFYEAFSKNLKLGIHEDSQNKGKIAELLRYHSTKSGDELTSLKDYVTRMKEGQSDIYYITGESKKAVENSPFLEKLKKKGYEVLFMVDAIDEYAVGQLKEFEGKKLVSATKEGLKLDESEDEKKKQEELKEKFDNLCKVIKDVLGDKVEKVVVSDRVVDSPCCLVTGEYGWTANMERIMKAQALRDNSMAGYMSSKKTMEINPENPIMEELRKRADADKNDKSVKDLVLLLFETALLTSGFSLDEPNTFGNRIHRMLKLGLSIDEDAAEADADADMPPLEEEAEADAEGSKMEEVD

SEQ ID NO: 1140 - protein, 839 aa, Glycine max
MKLSPREVEKLGLHNAGYLAQKRLARGLRLNYTEAVALIATQIMEFARDGEKTVAQLMCIGKHLLGRRQVLPEVQHLLNAVQVEATFPDGTKLVTVHDPISCEHGDLGQALFGSFLPVPSLDKFAENKEDNRIPGEIIYGDGSLVLNPGKNAVILKVVSNGDRPIQVGSHYHFIEVNPYLTFDRRKAYGMRLNIAAGTAVRFEPGDSKSVKLVRIGGNKVIRGGNGIADGQVNETNLREAMEAVCKRGFGHKEEEDASEGITGDPDSPFTTIIPREEYANKYGPTTGDKIRLGDTDLFAKIEKDFALYGDECVFGGGKVLRDGMGQSCGDPPAISLDTVITNAVIIDYSGIIKADIGIKDGLIVSIGKAGNPDIMDDVFFNMIIGANTEVIAGEGLIVTAGAIDCHVHYICPQLVDEAISSGITTLVGGGTGPTAGTRATTCTPAPSQMKLMLQSTDDLPLNFGFTGKGSSSKPDELHDIIKAGAMGLKLHEDWGSTPAAIDSCLTVADQYDIQINIHTDTLNEAGFVEHSIAAFKGRTIHTYHSEGAGGGHAPDIIKVCGMKNVLPSSTNPTRPLTLNTIDEHLDMLMVCHHLNREIPEDLAFACSRIREGTIAAEDILHDIGAISIISSDSQAMGRVGEVISRTWQTANKMKVQRGPLQPGESDNDNFRIKRYIAKYTINPAIANGFSQYVGSVEVGKLADLVMWKPSFFGAKPEMVIKGGVVAWADMGDPNASIPTPEPVKMRPMFGTLGKAGGALSIAFVSKAAVDQRVHALYGLNKRVEAVGNVRKLTKLDMKLNDSLPQITVDPDNYTVTADGEVLTSFATTFVPLSRNYFLF

SEQ ID NO: 1141 - protein, 253 aa, Glycine max
MLACIFHHPTSHTTTTSTSLQSKPTTTMASYQKHYDDQGRKVDEYGNVEKQTDEYGNPVHAASVTYVATRTAAGGYSDDINKQHDTTNAYGVDTGRQHSSGGYDGDTNKHHGTTGGYNDDTNRHHGTTGVYGIDTDRQQHGTTGGYAGDTGRQHGNIGGPYYGTNTADTGTGPRSGTTGGTGYGGTGGTDYGTTGGTGYGSGTGYGVNTGGAHTEAGYRKEHRQHDQSHGDQNEKKGIMDKIKEKLPGGHSDK

SEQ ID NO: 1142 - protein, 645 aa, Glycine max
MATKEGKAIGIDLGTTYSCVGVWQNDRVEIIPNDQGNRTTPSYVAFTDTERLIGDAAKNQVAMNPQNTVFDAKRLIGRRFSDSSVQNDMKLWPFKVGGSPCDKPMIVVNYKGEEKKFSAEEISSMVLVKMREVAEAFLGHAVKNAVVTVPAYFNDSQRQATKDAGAISGLNVLRIINEPTAAAIAYGLDKKASRKGEQNVLIFDLGGGTFDVSILTIEEGIFEVKATAGDTHLGGEDFDNRMVNHFVSEFKRKNKKDISGNARALRRLRTACERAKRTLSSTAQTTIEIDSLYEGIDFYATITRARFEEMNMDLFRKCMEPVEKCLRDAKIDKSQVHEVVLVGGSTRIPKVHQLLQDFFNGKELCKSINPDEAVAYGAAVQAAILSGQGDEKVQDLLLLDVTPLSLGLETAGGVMTVLIPRNTTIPTKKEQIFSTYSDNQPGVLIQVFEGERARTKDNNLLGKFELTGIPPAPRGVPQVNVCFDIDANGILNVSAEDKTAGVKNKITITNDKGRLSKEEIEKMVKDAERYKAEDEEVKKKVEAKNSLENYAYNMRNTIKDEKIGGKLSPDEKQKIEKAVEDAIQWLEGNQMAEVDEFEDKQKELEGICNPIIAKMYQGAAGPGGDVPMGADMPAAGAGPKIEEVD

SEQ ID NO: 1143 - protein, 236 aa, Glycine max
MATQMSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAVRRACYGVLRFVMESGAKGCEVIVSGKLRAQRAKSMKFKDGYMISSGQPVKDYIDSAVRHVLLRQGVLGIKVKIMLDWDPKGKQGPKTPLPDLVTIHTPKEEEEYNRPPAVLANDIEVVPVA

SEQ ID NO: 1144 - protein, 636 aa, Glycine max
MSSSTTVRKLQVVSPVPADIDIANSVEPVHISQIAKDLNLSPNHYDLYGKYKAKVLLSVLDELQGSEDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHESTQSDKALFNRLCPPNKEGKRSFSDVMFRRLTKLGISKTNPDDLTPEEVNKFARLDIDPNSITWRRVMDINDRFLRKIAIGQGPDEKGMVRETGFDISVASEIMAVLALTTSLADMRERLGKMVIGNSKSGDPVTADDLGVGGALTVLMKDAIHPTLMQTLEGTPVLVHAGPFANIAHGNSSIVADKIALKLVGPGGFVVTEAGFGADIGAEKFMNIKCRYSGLTPQCAIIVATIRALKMHGGGPAVVAGRPLDHAYLTENVALVEAGCVNMARHISNTKSYGVNVVVAINKFSTDTEAELNAVRSAALAAGAYDAVICTHHANGGKGAVDLGIAVQKACENVTQPLKFLYPVDLSIKEKIEAIAKSYGASGVEYSEQAEKQIEMYSKQGFSGLPICMAKTQYSFSDNAAAKGAPSGFVLPIRDVRASIGAGFIYPLVGTMSTMPGLPTRPCFYDIDLDTTTGKVIGLS

SEQ ID NO: 1145 - protein, 227 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSAEFVDIINAATVKKN

SEQ ID NO: 1146 - protein, 155 aa, Glycine max
MTKLTILLIALLFIAHTCCASKWQQHQQESCREQLKGINLNPCEHIMEKIQAGRRGEDGSDEDHILIRTMPGRINYIRKKEGKEEEEEGHMQKCCSEMSELKSPICQCKALQKIMDNQSEQLEGKEKKQMERELMNLAIRCRLGPMIGCDLSSDD

SEQ ID NO: 1147 - protein, 475 aa, Glycine max
MSPQTETKASVGFKAGVKDYKLTYYTPDYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 1148 - protein, 222 aa, Glycine max
MGRRPARCYRQIKNKPYPKSRFCRGVPDPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVAIGQVLLSVRCKDSNSHHAQEALRRAKFKFPGRQKIIVSRKWGFTKFSRSDYLKFKSENRIVPDGVNAKLLGCHGPLANREPGRAFLDTATSS

SEQ ID NO: 1149 - protein, 168 aa, Glycine max
MATISDQPRGSYSYGTSYGAPYGTTYETNTSINNPPSRQTVKFITAATIGITLLLLSGLTLTGTVIGLIIATPLLVIFSPILVPAAFVLFLVASGFLFSGGCGVAAIAALSWIYNYVSGNQPAGYDTLDYAKGYLADKARDVKERAKDYGSYAQGREGSRFVCKVAKH

SEQ ID NO: 1150 - protein, 503 aa, Glycine max
MALLVEKTTSGREYKVKDLSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGELPDPNSTDNAEFQIVLTIIRDGLKTDPTRYRKMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMKKMKNNAIVCNIGHFDNEIDMLGLENYPGVKRITIKPQTDRWVFPETNVGIIVLAEGRLMNLGCATGHPSFVMSCSFTNQVIAQLELWKEKSTGKYEKKVYVLPKHLDEKVAALHLGKLGAKLTKLSPAQADYISVPVEGPYKPAHYRSRQNMKCGVSGIWLALIIV

SEQ ID NO: 1151 - protein, 325 aa, Glycine max
MAEGLVLRGTMRAHTDVVTAIATPIDNSDMIVTASRDKSIILWHLTKEDKTYGVPRRRLTGHSHFVQDVVLSSDGQFALSGSWDGELRLWDLAAGTSARRFVGHTKDVLSVAFSIDNRQIVSASRDRTIKLWNTLGECKYTIQDGDAHSDWVSCVRFSPSTLQPTIVSASWDRTVKVWNLTNCKLRNTLAGHNGYVNTVAVSPDGSLCASGGKDGVILLWDLAEGKRLYSLDAGSIIHALCFSPNRYWLCAATEQSIKIWDLESKSIVEDLKVDLKTEADATSGGGNANKKKVIYCTSLNWSADGSTLFSGYTDGVVRVWAIGRY

SEQ ID NO: 1152 - protein, 203 aa, Glycine max
MKSTSLFAIFLLCAFTSYLPSATAQDVLDVDGDPIRNGFIYYVLPAIRGNGGGIERAALGKDTCPITVVQSPNPNSKGLEIKFESAYPAYYINETLILQIKFSYPQQCERKNPWWAISKDISEGPPAIKLSGFHGTELGWFKIQKASKSCDSNDYKLVFCQYDETWCLDVGIYVDRQGNRRLVLAVTGEPFLVHFHKISSSTA

SEQ ID NO: 1153 - protein, 476 aa, Glycine max
MGNKTTLLLLLFVLCHGVATTTMAFHDDEGGDKKSPKSLFLMSNSTRVFKTDAGEMRVLKSHGGRIFYRHMHIGFISMEPKSLFVPQYLDSNLIIFIRRGEAKLGFIYDDELAERRLKTGDLYMIPSGSAFYLVNIGEGQRLHVICSIDPSTSLGLETFQSFYIGGGANSHSVLSGFEPAILETAFNESRTVVEEIFSKELDGPIMFVDDSHAPSLWTKFLQLKKDDKEQQLKKMMQDQEEDEEEKQTSRSWRKLLETVFGKVNEKIENKDTAGSPASYNLYDDKKADFKNAYGWSKALHGGEYPPLSEPDIGVLLVKLSAGSMLAPHVNPISDEYTIVLSGYGELHIGYPNGSKAMKTKIKQGDVFVVPRYFPFCQVASRDGPLEFFGFSTSARKNKPQFLAGAASLLRTLMGPELSAAFGVSEDTLRRAVDAQHEAVILPSAWAAPPENAGKLKMEEEPNAIRSFANDVVMDVF

SEQ ID NO: 1154 - protein, 248 aa, Glycine max
MARSLFLCSLLILAVTTFSSPTGALILTLVNNCNYTVWPGIQPNAGHPVLAGGGLTLRSLTHQSIPVPDAHWSGRVWARTGCSYSGTAFSCASGDCGGRLQCNGAGGAAPATLAQLEVHHGSNDYASYGVSLVDGFNVPMTFTPHEGKGVCPVVGCRNDLLATCPRVLQHRVPAGHGPVVACKSGCEAFHTDELCCRNHFNNPNTCKGSIYSSFFKHACPATFTFAHDTPSLMHQCSSPRELKVIFCH

SEQ ID NO: 1155 - protein, 586 aa, Glycine max
MAAATTSYSSAIAASSDTLAKPASTRTFSATNLALQSSSSKLGFKSLKLHRCAAAAGSALGARMVSAPAVKAPALLDFDTKVFKKEKINLAGHDEYIVKGGRDLFHLLPDAFKGIKQIGVIGWGSQGPAQAQNLRDSLAEAKSDIVVKIGLRKGSRSFAEARAAGFSEENGTLGDIWETVSGSDLVMLLISDSAQADNYEKILSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGVVESLFRRYTDNGMNEDLAYKNTVESITGIISKTISTKGMLAVYNALSEDEKREFEKAYSASYYPCMEILYECYEDVASGSEIRSVVLAGRRFYEKEGLPAFPMGNIDQTRMWKVGERVRSTRAAGDQGPLYPFTAGVFVALMMAQIEILRKKGHSYSEIINESVIEAVDSLNPFMHARGVSFMVDNCSTTARLGSRKWAPRFDYILTQQAMVAVDNGTPVNRDLISNFLSDPVHGAIKVCAELRPTVDISVPPDADFVRPELRSSN

SEQ ID NO: 1156 - protein, 589 aa, Glycine max
MESATQVGAAAQPSSASASVIPSAFDGTLGRHLARRLAETGVRDVFSVPGDFNLTLLDHLIAEPSLNLVGCCNELNAGYAADGYARAKGVGACVVTFTVGGLSVLNAIAGAYSENLPVICIVGGPNSNDYGTNRILHHTIGLPDFTQELRCFQAITCFQAVVNNLDDAHELIDTAISTALKESKPVYISISCNLPGIPHPTFARDPVPFFLAPKVSNQEGLEAAVEATAALLNNAVKPVIVGGPKLRVAKAQKAFLEFAEASGYPIAVMPSGKGLVPEHHPHFIGTYWGAVSSSFCGEIVESADAYVFVGPIFNDYSSVGYSLLIKKEKAIIVQPNRVTIGNGPSLGWVFMADFLTALAKKVKTNTAAVENYRRIYVPPGIPLRREKDEPLRVNVLFKHIQELLSGDTAVIAETGDSWFNCQKLHLPENCGYEFQMQYGSIGWSVGATLGYAQAATDKRVIACIGDGSFQVTAQDISTMIRCGQKTIIFLINNGGYTIEVEIHDGPYNVIKNWDYTRFVDAIHNGQGKCWTAKVRTEDDLTEAIAKATGPQKDSLCFIEVFVHKDDTSKELLEWGSRVAAANSRPPNPQ

SEQ ID NO: 1157 - protein, 212 aa, Glycine max
MQSRHDMQSTLTSCRVTSHTSSYTTIYLSHSILSSTLGLAREKIPTMATISTDQPRGSYSYGTSYGAPYGTTYETNSSINNPPSRQTVKFITAATIGITLLLLSGLTLTGTVIGLIIATPLLVIFSPILVPAAFVLFLVASGFLFSGGCGVAAIAALSWIYNYVSGNQPAGSDTLDYAKGYLTDKARDVKERAKDYGSYAQGRINEATQGTY

SEQ ID NO: 1158 - protein, 264 aa, Glycine max
MARGLKKHLKRLNAPKHWMLDKLGGAFAPKPSSGPHKSRECLPLILILRNRLKYALTYREVIAILMQRHVLVDGKVRTDKTYPAGFMDVVSIPKTNENFRLLYDTKGRFRLHSVRDDEAKFKLCKVRSVQFGQKGIPYLNTYDGRTIRYPDPLIRANDTIKLDLEENKIVDFIKFDVGNVVMVTGGRNRGRVGVIKNREKHKGSFETIHVQDSTGHEFATRMGNVFTIGKGTKPWISLPKGKGIKLSIIEEARKRIAAQQATAA

SEQ ID NO: 1159 - protein, 153 aa, Glycine max
MDWIGAYRGGQRSRDWCDPSSPFTDLWDPRRVGDADDITSSLAHAHVDWRETDKAHIFRADLPGVKKEDLKVQVEENKILQISGERVKEKEDQNDKWHRVERQCGSFLRRFRLPEDANPNQISCTLENGVLNVTVPKVEKKPENKNVRQIDVV

SEQ ID NO: 1160 - protein, 248 aa, Glycine max
MASLGGLQNVSGINFLIKEGPKVNAKFELKPPPYPLNGLEPVMSQQTLEFHWGKHHKTYVENLKKQVVGTELDGKSLEEIIVTSYNKGDILPAFNNAAQVWNHDFFWECMKPGGGGKPSGELLELIERDFGSFVKFLDEFKAAAATQFGSGWAWLAYRARKFDGENVANPPSPDEDNKLVVLKSPNAVNPLVWGGYYPLLTIDVWEHAYYLDFQNRRPDYISVFMDKLVSWDAVSSRLEQAKALITSA

SEQ ID NO: 1161 - protein, 162 aa, Glycine max
MAEEQQRRILVAVDEGEESMYALSWCLKNLAFQNSKDTLLLLYVKPPRVTYSAFDGTGYLFSSDITATMERYSQQVADCVLEKAKKLCNNIENVETRVENGDPRDVICQMVQKLGADVLVMGSHGYGLIKRAFLGSVSNHCAQNVKCPVLIVKKPKPTTGET

SEQ ID NO: 1162 - protein, 285 aa, Glycine max; identical to SEQ ID NO: 606

SEQ ID NO: 1163 - protein, 262 aa, Glycine max
MAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 1164 - protein, 814 aa, Glycine max
MADPTSSNPDKDQSSTEPKSEKKDYSTAILERKKSPNRLVVDEAINDENSVVTLHPETMEKLQFFRGDTVLIKGKKRRDTICVVLADEQCDEPKIRMNKVVRANLRVRLGDVVSVHQCPDVKYGKRVHILPIDDTIEGVTGNLFDAYLKPYFMESYRPVRKGDLFLVRGGMRSIEFKLIETDPGEYCVVAPDTEIFCEGEPIKREDEERLNDVGYDDVGGVRKQMAQIRELVELPLRHPQLFKSIGVKPPKGILLYGPPGSGKTLIARAVANETGAFFFLINGPEIMSKLAGESESNLRKAFEEAEKNSPSIIFIDELDSIAPKREKTHGEVERRIVSQLLTLMDGLKTRSHVIVIGATNRPNSIDPALRRFGRFDREIDIGVPDEVGRLEVLRIHTKNMKLSDNVDLEKVARDTHGYVGADLAALCTEAALQCIREKMDVIDLEDETIDAEVLNSMAVTNEHFQTALSSSNPSALRETVVEVPNVSWDDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDESSRLQIFKACLRKSPISKDVDLSALARFTHGFSGADITEICQRACKYAIREDIEKGIEKERRKRENPEAMEEDDTDEVPEIKPAHFEESMKFARRSVSDADIRKYQLFAQTLQQSRGFGSEFRFPDQNENTAAGASDPFSSVTAEGDDDLYS

SEQ ID NO: 1165 - protein, 232 aa, Glycine max
MAPKVTRKVSRNPELIRGIGKYSRSQMYHKRGIWAIKAKNGGVLPRHDPKPKPETPAEKPPKFYPADDIKKPLVNKHKPKPAKLRASITPGTVLILLAGRFKGKRVVFLKQLPSGLLLVTGPFKVNGVPLRRVNQAYVIGTSTKVDISAVNVDSFGDKYFAKEAQKKKKKGEGEFFEAEKEEKSVLPQQKKDDQKTVDAAVLKAIESVPDLKSYLGARFSLKAGVKPHELVF

SEQ ID NO: 1166 - protein, 582 aa, Glycine max
MVLFNVSRVETTPFDGQKPGTSGLRKKVKVFVQPHYLHNFVQSTFNALTVEKVRGATLVVSGDGRYFSKEAIQIITKMSAANGVRRVWIGQNGLLSTPAVSAVIRERVGADGSRATGAFILTASHNPGGPHEDFGIKYNMENGGPAPEGITDKIYENTTTINEYLIASDLPDVDITTTGVTSFTGPEGPFDVEVFDSASDYIKLMKSIFDFESIRKLLSSPKFTFCYDALHGVGGAYAKSIFVDELGAQESSLLNCTPKEDFGGGHPDPNLTYAKELVARMGLGKSEPQDDPPEFGAASDGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNQIIKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 1167 - protein, 337 aa, Glycine max
MPPEKKEIFKSLEGWASEWVLPLLKPVEQCWQPQNFLPDPSLPHEEFSHQVKELRERTKELPDEYFVVLVGDMVTEDALPTYQTMINNLDGVKDDSGTSPSPWAVWTRAWTAEENRHGDLLRTYLYLSGRVDMAKVEKTVHYLISAGMDPGTDNNPYLGFVYTSFQERATFVAHGNTARLAKEGGDPVLARLCGTIAADEKRHENAYSRIVEKLLEVDPTGAMVAIGNMMEKKITMPAHLMYDGDDPRLFEHYSAVAQRIGVYTANDYADILEFLVERWRLEKLEGLMAEGKRAQDFVCGLAPRIRRLQERADERARKMKKHHGVKFSWIFNKELLL

SEQ ID NO: 1168 - protein, 614 aa, Glycine max
MEPRKASPLSWVLIFFLSISLSGVKVLSEEQHHAKSQEGPVVERDQRRTLLVTEFGEITAIDIKEGQKELPYHLRFITLEPNSLFLPVLLHADMVFYVHTGSGKLTWANDDGTSTIRLREGDVCSLKEGSVFYIQSNLEAERRKLRIYAMFTNTDDNTYDPSIGAYSRINELVKGFDTKIMQAALKVPEDLIEAIINKTETPAIVHAVPEKRNILQELEASFLKNFLGIGSNSKKLKTYNIFDHDPDFKNPNGWSTAVTKKQLKSLKRTNIGFLMVNLAMGSILGPHWNPKATELVVGVDGGGMVRVVCGSSNEDETECQNMRFKVKEGDAFLVPRFHPMAQMSFNDGPFVFLGFSTSAKKNHPQFLAGKGSVLHILDKRILATSFGVSNRTIDQLLRSPEDSIIFGCSSCAEEEEKIMKDEEENRKREEEEKEKKKEEEEEKRKREEEEERKREEEEDEKKRRREEEEEEKKKEEEEEKRKREEEEAKRQQEEREKKREEEEARREKEREREEEAEREQEQAKREAEAAAQREQEQAKREQERRERRRQEEEDEEEPTRWERRGRREKGKSPEGVEWEQEEARRQQAESDRQVEEQSHRNSFEGRRALKIRNV

SEQ ID NO: 1169 - protein, 155 aa, Glycine max
MVVTFAPTGLTTEVKFVEMHHEALQEALPGDNVGFNVKNVAVKDLKRGFVASNSKDDPAKEAANFTSQFAELVTKIDRRSGKEIEKEPKFLKNGDAGYVKMIPTKPMVVETFSEYPPLGRFSVRDMRQTVAVGVIKSVEKKDPTGAKVTKAAEKK

SEQ ID NO: 1170 - protein, 161 aa, Glycine max
MSLIPNFFGGRRNNVFDPFSLDVWDPFKDFPFPNTLSSASFPEFSRENSAFVSTRVDWKETPEAHVFKADIPGLKKEEVKVQIEDDKVLQISGERNVEKEDKNDTWHRVERSSGKFMRRFRLPENAKVEQVKASMENGVLTVTVPKEEVKKPDVKAIEISG

SEQ ID NO: 1171 - protein, 132 aa, Glycine max; identical to SEQ ID NO: 625

SEQ ID NO: 1172 - protein, 350 aa, Glycine max
MVSSSQHILVTGGAGFIGTHTVVQLLKAGFSVSIIDNFDNSVMEAVDRVRQVVGPLLSQNLQFTQGDLRNRDDLEKLFSKTTFDAVIHFAGLKAVAESVAKPRRYFDFNLVGTINLYEFMAKYNCKKMVFSSSATVYGQPEKIPCEEDFKLQAMNPYGRTKLFLEEIARDIQKAEPEWKIILLRYFNPVGAHESGKLGEDPKGIPNNLMPYIQQVAVGRLTELNVYGHDYPTRDGSAIRDYIHVMDLADGHIAALRKLFTTENIGCTAYNLGTGRGTSVLEMVAAFEKASGKKIPVKLCPRRPGDATEVYASTERAEKELGWKANYGVEEMCRDQWNWAKNNPWGYAGKP

SEQ ID NO: 1173 - protein, 191 aa, Glycine max
MEGTNSSGDNVSAGVVQSRMRMKVMVAIDESEGSFYALKWALDNLFTTMATVGEASSPENDGMVFLVHVEPKVHNYVYPIGPGGAAFYPATVVVDSVKKAQQERSAAILSRALKMCHDKLVKGESIILHGDAREMICEAAEQMQINLLVLGSRGLGTLKRTFLGSVSDYCAHHAKTPILIVKPPSEHSKMQ

SEQ ID NO: 1174 - protein, 243 aa, Glycine max
MGEEVKVVVPESVLKKRKREEEWALAKKQELDAAKKKRAESRKLIYNRAKQYAKEYDHQEKELIRLKREAKLKGGFYVDPEAKLLFIIRIRGINAMDPKSRKILQLLRLRQIFNGVFLKVNKATVNMLHRVEPYVTYGYPNLKSVRELIYKRGYGKLMKQRTALTDNSIIEQALGKYGIISTEDLIHEIITVGPHFKEANNFLWPFKLKAPLGGLKKKRNHYVEGGDAGNRENYINELIRRMN

SEQ ID NO: 1175 - protein, 149 aa, Glycine max
MAEQTFIMIKPDGVQRGLIGEIISRFERKGFYLKGLKLVTVDRPFAEKHYADLSAKPFFSGLVDYIVSGPVVAMIWEGKNVVTTGRKIIGATNPAQSEPGTIRGDFAIDIGRNVIHGSDSVESANKEIALWFPEGPANWQSSQHSWIYE

SEQ ID NO: 1176 - protein, 405 aa, Glycine max
MAAAARPLVTVQALDSDMATDASATVPIPDVMKSSIRPDIVNFVHSNISKNSRQPYAVSRRAGHQTSAESWGTGRAVSRIPRVPGGGTHRAGQGAFGNMCRGGRMFAPTKIWRRWHRKINVNQKRYAVVSAIAASAIPSLVLARGHRIESVPELPLVVSDSAESVEKTKEAIKVLKQIGAFPDAEKAKDSRSIRPGKGKMRNRRYISRRGPLIVYGTEGAKAVKAFRNVPGVEVANVERLNLLKLAPGGHLGRFVVWTKSAFEKLDSIYGSFDKPSEKKKGYLLPRPKMVNSDLARIINSDEVQSVVRPIKKDVKKATLKKNPLKNLNSMLKLNPYAKTAKRMALLAEAQRVKAKKEKLDKKRKTVSKEEASAIKSAGKAWYHTMVSDSDYTEFDNFSKWLGVSQ

SEQ ID NO: 1177 - protein, 261 aa, Glycine max
MGRVIRAQRKGAGSVFKSHTHHRKGPARFRSLDFGERNGYLKGVVTDIIHDPGRGAPLAKVAFRHPFRYKKQMELFVAAEGLYTGQFIYCGKKATLVVGNVLPLRSIPEGAVICNVEHHVGDRGVFARASGDYAIVISHNPDNDTSRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTT

SEQ ID NO: 1178 - protein, 978 aa, Glycine max
MASSATMRFSATSTGAEAALPRRNSVAGFIGVAARSSAKSRLRFIGRNANLSLRRRMSSFPVVKCVSGSEAKAQDPVAKQQEATTSLSSFSPDASSIASSIKYHAEFTPLFSPENFDLPQAFLATAQSVRDALIINWNATYDYYEKLNVKQAYYLSMEFLQGRALLNAIGNLELTGPHAEALSKLGHKLENVAYQEPDAALGNGGLGRLASCFLDSLATLNYPAWGYGLRYKYGLFKQRITKDGQEEVADDWLEMGNPWEIIRNDVSYPVKFYGKVVSGSDGKKHWIGGEDIKAVAHDVPIPGYKTKTTINLRLWSTKAASEEFDLSAFNAGRHTEASEALANAEKICYILYPGDESIEGKILRLKQQYTLCSASLQDIIARFERRSGTNVNWEEFPEKVAVQMNDTHPTLCIPELMRILIDVKGLSWKDAWNITQRTVAYTNHTVLPEALEKWSLDLMQKLLPRHIEIIEMIDEELIRTIIAEYGTENSDLLEKKLKEMRILENVELPAEFADIVVKSKEAIDIPSEELQSSEQAEVEERKDDEVEAVAKKNGTDESSIEDEKEELPEPVPEPPKLVRMANLCVVGGHAVNGVAEIHSEIVKDEVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLLNIFGIVYRYKKMKEMSAAERKANFVPRVCIFGGKAFATYVQAKRIVKFITDVGATVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKFVPDPRFEEVKEFVRSGVFGSYNYDELMGSLEGNEGFGRADYFLVGKDFPSYIECQEKVDEAYRNQTKWTRMSILNTAGSYKFSSDRTIHEYAREIWNIEPVQLP

SEQ ID NO: 1179 - protein, 331 aa, Glycine max
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 1180 - protein, 439 aa, Glycine max
MASVSKLSTPNPLASLSEALRPRDSRFLTFKPSSIAFNHKTNLSASLRSIHSLPLKTSLRIKCSQTDGNGSPAKRTVLHDLYEKEGQSPWYDNLCRPVTDLLPLIASGVRGVTSNPAIFQKAISSSNAYNDQFRELVQTGKDIESAYWELVVKDIQDACRLFEPIYDQTDGGDGYVSVEVSPRLADDTEGTIEAAKWLHKVVDRPNVYIKIPATEACVPSIKEVIANGISVNVTLIFSLARYEAVIDAYLDGLEASELNDLSRVTSVASFFVSRVDTLIDKALEKIGTPVALNLRGKAAVAQAALAYQLYQRKFSGPRWEALVKKGAKKQRLLWASTSVKNPAYSDTLYVAPLIGPDTVSTMPDQALQAFIDHGTVSRTIDSNASEAEGIYNALQKLGIDWSFVGSQLELEGVDSFKKSFDSLLDSLQEKANSLKLVSH

SEQ ID NO: 1181 - protein, 413 aa, Glycine max
MAWVLSSLKFEVVWCNSSFSSCLVQNRSSSLPSTDHSISLNTRSIYYKIHPLLPLSATTITIFIMHKSSSDSTLGPGGLDLSQAFFRPINNAAPPSPTKRHNKISVIGAGNVGMAIAQTILTQDLTDELVLVDTNSDKLRGEMLDLQHAAAFLPRTKIHASADSSVTAGSDLCIVTAGARQISGESRLNLLQRNLSLFRAIIPPLVRYSPDTTLLIVSNPVDVLTYVAWKLSGFPSNRVIGSGTNLDSSRFRFLIADHLDVNAQDVQAYIVGEHGDSSVALWSSISIGGVPVLSFLENQQIVYEKETLENIHKSVIDSAYEVIKLKGYTSWAIGYSVANLARSFIRNQRKIHPVSVLAKGFYGIDGEVFLSLPAMIGRGGILGVTNVHLNEEETQRLRDSAKTILEVQTQLGI

SEQ ID NO: 1182 - protein, 411 aa, Glycine max
MALRLNPIPTQTFSLPQMASLRSPRFRMASTLRSGSKEVENIKKPFTPPREVHVQVTHSMPPQKIEIFQSLEDWAEENILAHLKPVEKCWQPQDFLPDPSSDGFEEQVKELRERAKELPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFESDPDGTVMAFADMMRKKIAMPAHLMYDGRDDNLFDNYSSVAQRIGVYTAKDYADILEFLVGRWKVEQLTGLSGEGRKAQEYICGLPPRIRRLEERAQARVKESSTLKFSWIHDRESTTLNAPREEHGEIFRQYRSEKC

SEQ ID NO: 1183 - protein, 420 aa, Glycine max
MAFRVRSPDLRSLFLLSLLSIASANVFFEERFDDGWENRWVKSDWKKDENVAGEWNHTSGQWNGDANDKGIQTSEDYRFYAISAEYPEFSNKGKTLVFQFSVKHEQKLDCGGGYMKLLSGDVDQKKFGGDTPYSIMFGPDICGYSTKKVHAILTYNNTNHLIKKDVPCETDQLTHVYTFILRPDATYSILIDNVEKQTGSLYSDWDLLPPKTIKDPEAKKPEDWDDKEYIPDPEDKKPEGYDDIPKELPDPEAKKPEDWDDEEDGEWTPPTIANPEYKGPWKAEKIKNPNYKGKWKAPLIDNPDFKDDPDLYVFPNLKYVGIELWQVKSGTLFDNVLITDDPEYAKQLVEETWGKHKDAEKAAFEEAEKKREEEESKDDPVDSDADEEEEDADEAGNDSDAESKTEAGEDTKEEGVHDEL

SEQ ID NO: 1184 - protein, 147 aa, Glycine max
MAELHYQPQHQYPLRYPNDPHQQTRSSTHQVVKAATAVTAGGSLLILASLILAATVIALTIVTPLFVIFSPVLVPAVITVALLSLGFLASSGFGVAAITVLAWIYRYVTGKQPPGADQLDSARHKIMDKAREIKDYGQQQISGVQAS

SEQ ID NO: 1185 - protein, 157 aa, Glycine max
MSIIPNLFGGRRSNVFDPFSLDVWDPFEGFPFSTGHVPSSGGESSAIANTRVDWKETPAAHVFNVDLPGLKKEEVKVEVEDGRVLQISGERTKEQEQKDDRWHRVERSTGKFMRRFRLPENAKMDQVKAAMENGVLTVTVPKEEDKKPQVKSIQISA

SEQ ID NO: 1186 - protein, 275 aa, Glycine max
MAERGGGERGGDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKATFDCLMKTYGFLTPEFWKETRFSKSPFQEYTDLLAKPTGKTLILEEERVDA

SEQ ID NO: 1187 - protein, 421 aa, Glycine max
MEVLLFAVMAGLAPEGTQFDGRQYDAKMSELLSTDGQEFFTSYDEVYDSFDAMGLQENLLRGIYAYGFERPSAIQQRGIVPFCKGLDVIQQAQSGTGKTATFCSGILQQLDYGLVQCQALVLAPTRELAQQIEKVMRALGDYLGVKVHACVGGTSVREDQRILQAGVHTVVGTPGRVFDMLRRQSLRPDCIKMFVLDEADEMLSRGFKDQIYDIFQLLPSKIQVGVFSATMPPEALEITRKFMNKPVRILVKRDELTLEGIKQFYVNVDKEEWKLETLCDLYETLAITQSVIFVNTRRKVDWLTDKMRSNDHTVSATHGDMDQNTRDIIMREFRSGSSRVLITTDLLARGIDVQQVSLVINYDLPTQPENYLHRIGRSGRFGRKGVAINFVTTDDSRMLSDIQKFYNVTVEELPSNVADLL

SEQ ID NO: 1188 - protein, 389 aa, Glycine max
MSHRKFEHPRHGSLGFLPRKRASRHRGKVKAFPKDNPSQPCGLTAFVGYKAGMTHIVREVEKPGSKLHKKETCEAVTIIETPPLVVVGVVGYVKTPRGLRTLNTVWAQHLSEEVKRRFYKNWCKSKKKAFTKYSKKYETEEGKKDIESQLEKLKKYATVIRVLAHTQIRKLKGLKQKKAHLMEIQVNGGTVDQKVDYAYSFFEKQIPVDAVFHKDEMIDIVGVTKGKGYEGVVTRWGVTRLPRKTHRGLRKVACIGAWHPARVSFTVARAGQNGYHHRTELNKKIYKVAKADHESHSAITEFDRTEKDITPMGGFPHYGVVKDDYIMVKGCCVGPKKRVITLRRSLLKQTSRVALEEIKLKFIDTSSKFGHGRFQTTQEKQKFYGRLKA

SEQ ID NO: 1189 - protein, 241 aa, Glycine max
MVSVSLLLFLSFFAFFAPSESHDKVSLELYYESLCPYSANFIVNHLPKIFTPDLAPIVHLKLVPWGNAKLRANATFDCQHGPYECLLNTVEACAIHIWPQLSKHFPFIYCVEDLVFQSKREEWESCFEKLDLDSEPINQCYNSEHGKQLELQYAAETSALEPPHKYVPWVVVDGEPLYEDYENFLSYLCKAYKGTVTPQSCTQASYLREVNAKPKHSVCYKDSGIMLTWEKVRSTIASWMH

SEQ ID NO: 1190 - protein, 298 aa, Glycine max
MVYVKAQKSKAYFKRYQVKFKRRREGKTDYRARIRLINQDKNKYNTPKYRFVVRFSNKDIVAQIISASIAGDLVLATAYSHELPRYGLEVGLTNYAAAYCTGLLLARRVLKTLEMDEEYEGNVEATGEDYSVEPAESRRPFRALLDVGLVRTTTGNRVFGALKGALDGGLDIPHSDKRFAGFDKEKKELDAEVHRKYVFGGHVAAYMKILAEDEPEKYQSHFSEYIKRGIEADGIEALYKKVHAAIRADPTLRKSDKEPPKEHKRYNMKKLTYEERKAKLIARVAAINSAADSDEDDE

SEQ ID NO: 1191 - protein, 156 aa, Glycine max
MADAHRTTAPPPSLSAAFLRKLQDRGPNSTQLACILTLLLTASVLLLLTGLTVAGAVLGLIFFLPLIIVSSPVWVPAGTFLFIVTAAFLSVCGFGVALVAVLSWMYHYFRGLHPPGSDRVDYARSRIYDTASHVKDYAREYGGYLQSKVKDAAPGA

SEQ ID NO: 1192 - protein, 309 aa, Glycine max
MAQQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 1193 - protein, 159 aa, Glycine max
MAEQTEKAFLKQPKVFLSTKKTGKGKRPGKGGNRFWKSIGLGFKTPREAIEGTYIDKKCPFTGNVSIRGRILAGTCHSAKMNRTIIVRRNYLHFIKKYQRYEKRHSNIPAHISPAFRVKEGDHVIIGQCRPLSKTVRFNVLKVIPAGSSSGAKKAFTGM

SEQ ID NO: 1194 - protein, 229 aa, Glycine max; identical to SEQ ID NO: 755

SEQ ID NO: 1195 - protein, 130 aa, Glycine max
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 1196 - protein, 238 aa, Glycine max
MKRTPILFPLFFLLCAFTSYLPSATADDDHVYDTDGDKLQYGVNYFVLPVIRGNGGGIQVAKAGNETCPLTVVQSGNELSEGLPIKIASRSAGVAFITQGQLFKSIQFGVFPSTLRPGCPPSPIPSKWDPPSKWTIVEGLPERGLAVKLVGYQNRVSGWFSIVKVADDASSSSVGYKLVFCLWPEEEVMIHLCKNVGIRTDGKGIRRLVLSENTPLVVQFQKFRSALALNNHVLSASE

SEQ ID NO: 1197 - protein, 181 aa, Glycine max
MVKYSREPDNPTKSCKARGADLRVHFKNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETKLATSKKSQALRSGTSS

SEQ ID NO: 1198 - protein, 181 aa, Glycine max
MASEKKLSNPMREIKVQKLVLNISVGESGDRLTRAAKVLEQLSGQAPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIV

SEQ ID NO: 1199 - protein, 167 aa, Glycine max; identical to SEQ ID NO: 502

SEQ ID NO: 1200 - protein, 223 aa, Glycine max
MAVTFSDLHTEEGIKSLDQFLSGKTYISGDQLTKDDIKVYAAVVEKPGDTFPNAAKWYDAVSSQLAPSFPGHAQGVRFSGAAAPAEAAPAKAAATAEEDDDDLDLFGDETEEDKKAAEEREAAKKPAKKKESGKSSVLLDVKPWDDETDMKKLEETVRSIEMPGLLWGASKLVPVGYGIKKLQIMMTIVDDLVSVDTLVEERLTVEPCNEYIQSCDIVAFNKI

SEQ ID NO: 1201 - protein, 152 aa, Glycine max
MSLVANEDFQHILRVLNTNVDGKQKIMFAMTSIKGIGRRFANIACKKADVDMNKRAGELSAAELDSVMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 1202 - protein, 355 aa, Glycine max
MDFLNFMLNLLVPPGSMLTLAFSWPALCFLNVCEWLYNSIYGEDIDNKVVIITGASSGIGEQIAYEYALRRANLTLVARREHRLRGIAENAKRLGARHVMIMAADVVKEEDCRRFVNETINVFGRVDHLVNTVSLGHTFCFEEVTDTSVFPVLLDINFWGNVYPTFVALPYLHQSNGRIIINASVESWLPMPRMSLYAAAKAALVNFYETLRFELKDEVGITIATHGWIGSEMTRGKFMLEEGAEMQWKEEREVHVMGGPVEEFARLIVSGACRGDAYVKFPSWYDVFLLYRVFAPRVLNWAFRFLISPQGTRRASSYVGTGKHIEAVGMVRPMAMLEGTSPTHTGQLISQHKLD

SEQ ID NO: 1203 - protein, 202 aa, Glycine max
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLTANKVVSYETAKAFADEIGIPFMETSAKNATNVEQAFMAMAAEIKNRMASQPVNNARPPTVQIRGQPVNQKAGCCST

SEQ ID NO: 1204 - protein, 146 aa, Glycine max
MKFNPRVSSSRRKSRKAHFTAPSSVRRVLMSAPLSTDLRSKYNVRSIPVRKDDEVQVVRGTYKGREGKVVQVYRRKWVIHIERITREKVNGSTVNVGIHPSKVVVTKLRMDKDRKSLLDRKAKGRAAADKEKGTKFAPEDVMQTVD

SEQ ID NO: 1205 - protein, 317 aa, Glycine max
MATLTVPPVPPSPRDDAMQLYRAFKGFGCDTSAVINILAHRDATQRAYIQQEYRSMYSEELSKRLASELSGKLETAVLLWLHDPAGRDATIIRKSLTADNRSIEGATEVICSHTPSQLQYLKQIYHSMFGVYLEHDIQTNTSPGDHQKLLLAYISTPRHEGPEVNREIAQKDAKALYKAGEKKLGTDEKTFIHIFSERSAAHLAAVSSYYHDMYGHSLKKAVKNETSGAFEHALLTIIQCAVNPGKYFAKVLRKAMKGLGTDDSTLIRVIVTRTEVDMQYIKAAYLKKHKKTLNDEVHSETSGHYRTFLLSLLGPNH

SEQ ID NO: 1206 - protein, 192 aa, Glycine max
MKTILSSETMNIPDGVSIKVHAKVIEVEGPRGKLVRDFHHLNLDFQLITDDGGKRKLKIDSWFGSRKTSAAIRTALSHVENLITGVTKGYRYKMRFVYAHFPINASIGNNSKSIEIRNFLGEKKVRKVDMLEGVSVVRSEKVKDELVLDGNDIELVSRSCALINQKCHVKNKDIRKFLDGIYVSEKGTILEE

SEQ ID NO: 1207 - protein, 439 aa, Glycine max
MKTTLFSLSPLFLFLLFSLVEGLTPKCDTQDHGSTLEVFHVFSPCSPFRPPKPLSWAESVLQLQAKDQARLQFLASMVAGRSVVPIASGRQIIQSPTYIVRAKIGSPPQTLLLAMDTSNDAAWIPCTACDGCTSTLFAPEKSTTFKNVSCGSPQCNQVPNPSCGTSACTFNLTYGSSSIAANVVQDTVTLATDPIPDYTFGCVAKTTGASAPPQGLLGLGRGPLSLLSQTQNLYQSTFSYCLPSFKSLNFSGSLRLGPVAQPIRIKYTPLLKNPRRSSLYYVNLVAIRVGRKVVDIPPEALAFNAATGAGTVFDSGTVFTRLVAPAYTAVRDEFQRRVAIAAKANLTVTSLGGFDTCYTVPIVAPTITFMFSGMNVTLPEDNILIHSTAGSTTCLAMASAPDNVNSVLNVIANMQQQNHRVLYDVPNSRLGVARELCTK

SEQ ID NO: 1208 - protein, 990 aa, Glycine max
MASTASGATGWYRGRVKAVPSGDCLVIVAISSTKPGPLPEKTITLSSLIAPRLARRGGVDEPFAWESREFLRKLCIGKEVTFRVDYNVPSISRDFGTVFVGDKNVAMLVVSQGWVKVREQGQQKGEVSPYLAELLRLEEQAKQEGLGRWSKVPGAAEASIRNLPPSALGDPSNFDAMTFLNAKKGLPMEAVVEQVRDGSTLRIYLLPEFQFVQVFVAGIQSPQMGRRAAPESVVEPELTSDDTNGDVPGEPRAPLTSAQRLAVSTSAAETAADPFAHDAKFFTEMRVLNREVRLVLEGVDKFSNLIGSVYYPDGESAKDLALELVENGYAKYVDWSANMMEEEAKQKLKTAELQAKKDRLRMWTNYVPPPSNSKAIHNQNFSGKVVEVVSGDCIVVADDSIPYGSPLAERRVNLSSIRCPKMGNPRRDEKPAPYAREAKEFLRTRLIGRQVNVQMEYSRKVSPTDGSVVPSAADSRVMDFGSVFLLSGAKVDNDDAPSSAPPAGSQQNGVNVAELIVGRGFGTVIRHRDFEERSNYYDSLLAAESRAISGRKGTHSAKDPPVMHITDLTMASAKKARDFLPFLHRSRRVPAVVEYVLSGHRFKLLIPKETCSIAFSFSGVRCPGRDEPYSDEAIALMRRKIMQRDVEIEVETVDRTGTFLGSLWESRTNVAITLLEAGLAKLHTSFGSDRIPDFHLLDQAEQSAKRQKLKIWENFVEGEEVSNGAAVENKQQEVLKVIVTEVLGGGKFYVQTVGDQKIASIQQQLASLNLKDAPVLGAFNPKKGDIVLCYFHADKSWYRAMVVNTPRGPVESPNDLFEVFYIDYGNQEVVPYSQLRPVDPSVSAAPGLAQLCSLAYIKIPNLEEDFGQEAAEYLSELTLNSGKEFRAKVEEKDTSGGKVKGQGTGTVLAVTLVAVDAEISVNAAMLQEGLARTEKRNRWDRKDRQTALDNLENFQEEAKTSRRGMWQYGDIQSDDEDTAPPPRKAAGGRK

SEQ ID NO: 1209 - protein, 488 aa, Glycine max
MEREIEHCDKVMSQSSMDACPKSGPGYASPLAAISGPRETLLYVTAIYSGTGRDKPDFLATVDVDPSSPTYSKVIHRLPVPYLGDELHHFGWNSCSSCYGDPTAVRRYLILPSLVSGRIYVVDTKANPRSPSLHKVVEPEDIISKTGLAYAHTSHCLASGDVLISFLGDKDGNAEGSGFLLLDHEFNLKGRWEKPGHSPSFGYDFWYQPQHKTMISSSWGAPAAFTKGFNLQHVSDGLYGRHLHVYSWPGGELRQTLDLGESGLLPLEVRFLHDPSKDTGFVGCALSSNMVRFFKTEDESWSHEVAISVKPLKVQNWILPEMPGLITDFLISLDDRFLYFVNWLHGDIRQYNIEDPKNPVRTGQVWVGGLLQKGSPIVAITEDGNTWHSDVPDILGNKLRAGPQMIQLSLDGKRLYVTNSLFSAWDKQFYPELVEKGSHMLQIDVDTENGGLKINPNFFVDFGAEPGGSCLAHEMRYPGGDCTSDIWI

SEQ ID NO: 1210 - protein, 545 aa, Glycine max
MAVVAQTPDIAGERQSGQDVRTQNVVACQAVANIVKSSLGPVGLDKMLVDDIGDVTITNDGATILKMLEVEHPAAKVLVELAELQDREVGDGTTSVVIVAAELLKRANDLVRNKIHPTSIISGYRLAMREACKYVEEKLAVKVEKLGKDSLINCAKTSMSSKLIAGDSDFFAVLVVDAVQAVKMTNARGEVKYPIKGINILKAHGKSARDSFLMNGYALNTGRAAQGMPLRVAPARIACLDFNLQKTKMQLGVQVLVTDPRELEKIRQREADMTKERIEKLLKAGANVILTTKGIDDMALKYFVEAGAIAVRRVRKEDMRHVAKATGATLVSTFADMEGEETFEPSFLGYADEVVEERISDDAVVMIKGTKTTSAVTLILRGANDHMLDEMDRALHDALSIVKRTLESNTVVAGGGAVEAALSVYLEYLATTLGSREQLAIAEFAESLLIIPKVLSVNAAKDATELVAKLRAYHHSAQTKADKKHLSSMGLDLSQGKIRNNLEAGVIEPAMSKVKIIQFATEAAITILRIDDMIKLVKDESQNED

SEQ ID NO: 1211 - protein, 74 aa, Glycine max; identical to SEQ ID NO: 597

SEQ ID NO: 1212 - protein, 345 aa, Glycine max
MMKPSMLRSLHSAATRGASHLSRRGYASEPVPERKVAVLGAAGGIGQPLSLLMKLNPLVSSLSLYDIAGTPGVAADVSHINTGSEVVGYQGDEELGKALEGADVVIIPAGVPRKPGMTRDDLFNINAGIVKTLCTAIAKYCPHALVNMISNPVNSTVPIAAEVFKKAGTYDEKRLFGVTTLDVVRAKTFYAGKANVPVAGVNVPVVGGHAGITILPLFSQATPKANLDDDVIKALTKRTQDGGTEVVEAKAGKGSATLSMAYAGALFADACLKGLNGVPDVVECSFVQSTVTELPYFASKVRLGKNGVEEVLGLGPLSDFEQQGLESLKPELKSSIEKGIKFANQ

SEQ ID NO: 1213 - protein, 218 aa, Glycine max
MPGLTIGDTIPDLQVETNQGKIKLHQFCADGWTILFSHPGDFTPVCTTELGKMAQYAKEFYQRGVKLLGLSCDDVQSHNEWIKDIEAYTPGAKVNYPIIADPKREIIKQLNMVDPDEKDSTGNLPSRALHIVGPDLKIKLSFLYPATTGRNMDEVLRVIESLQKASKFKVATPANWKPGDPVVITPDVTNEQAKEMFPQGFESVKLPSKKEYLRLTKV

SEQ ID NO: 1214 - protein, 287 aa, Glycine max
MAEATQSNAELLEWPKKDKRRFLHVVYRVGDLDRTIKFYTECFGMKLLRKRDIPEEKYANAFLGFGPEQSHFVVELTYNYGVTSYDIGTGFGHFAIATPDVYKLVEDIRAKGGNITREPGPVKGGKSVIAFVKDPDGYAFELIQRSSTPEPLCQVMLRVGDLERSIKFYEKTLGLRVVKKTDRPEYKYTIAMLGYAEEHETTVLELTYNYGVTEYTKGNAYAQVAIGTDDVYKSAEVVNIVTQELGGKITRQPGPVPGLNTKITSFLDPDGWKTVLVDNQDFLKELE

SEQ ID NO: 1215 - protein, 526 aa, Glycine max
MHSSPLLLEEPIRMASILEPSKPTFFPAMTKIVGTLGLKSRSVDTISRCLDAGMSVARFDFSWGDPEYHQETLENLRVAIKSTKKLCAVMLDTVGPELQIENKTDHPITLEADTLVVLTPDQTKEAGSNLLPVNFNGLSKAVKKGDTIFIGKYLFTGSETASLWLEVSEVKGEDVTCLVKNTATLSGSLFTAHVSQIHIDLPTLADKDKEVISTWGVRNNIDFLSLYTRHVEDIRHAREFLSKLGDLKQTHIYAKIENIEGLKHFDEILREADGIILARGNLGIELPPEKVFLFQKAAIYKCNMVGKPVVVTRVVDSMTDNLRPTRAEATDVANAVLDGSDAILLGAETLRGQYPVETISIVGKICAEAEKVHNQDLYFKKAVKYVGEPMSHLESIASSAVRAAIKVKASVIICFTSSGRAARLIAKYRPIMPVISVVIPQLKTNQLRWTFTGAFEARQSLIVRGLFPMLADPRHPAESKSGTNESILKVALDHGKAFGIIKPHDRVVVCQKVADSSVVKILELED

SEQ ID NO: 1216 - protein, 437 aa, Glycine max
MALRHLRIFPHTLPLTLTPKPKLNNSNRFSFFTSSLSLSSTTLMATAHKVLVPIADGTEPMEAVIIIDVLRRSGADVTVASSSANLAVQALHGVKIIADASVSDVAATAFDLVALPGGLQGDENLRDCKVLEGFVKKHVEDGRLYAAVCAAPAVVLGPWGLLNGKKATCYPALMEKLAAYVAATSESRVQVDGTVVTSRAPGTTMEFAIALIEQLIGKEKAYEVAGPLVMRSNHDDEHTFKEFNSVQWTSDNPPKILVPIANGSEEMEAVIIIDILRRAKAKVVVASVEDKLEIVASRKVKLEADMLLDEATKLSYDLIVLPGGLGGAQTFANSETLVSLLKKQRESNKYYGAICASPALVLEPHGLLKGKKATAFPVMCDKLSDQSEVENRVVVDGNLITSRGPGTSIEFALAIVEKLFGRKLALELANAVVFARP

SEQ ID NO: 1217 - protein, 847 aa, Glycine max
MRKWTVASALLLLSLLFLFADQGRKFQANAEGDSDELVDPPKVEDKIGAVPHGLSTDSDVVKREAESISKRSLRSNAEKFEFQAEVSRLMDIIINSLYSNKDIFLRELISNASDALDKIRFLSLTDKEVLGEGDNTKLDIQIKLDKEKKILSIRDRGIGMTKEDLIKNLGTIAKSGTSAFVEKMQTSGDLNLIGQFGVGFYSVYLVADYVEVISKNNDDKQYVWESKADGAFAISEDTWNEPLGRGTEIRLHLKEEAGEYLEESKLKELVKRYSEFINFPIYIWASKEVDVEVPADEDDSSDEEDSSESSSKEESEDEDADKSEDEEKKPKTKTVKETTYEWELLNDVKAIWLRNPKEVTEEEYTKFYHSLAKDFSDEKPLAWSHFTAEGDVEFKAVLFVPPKAPQDLYESYYNANKSNLKLYVRRVFISDEFNELLPKYLNFLLGLVDSDTLPLNVSREMLQQHSSLKTIKKKLIRKALDMIRRIADEDPDESTDKEKKEDASSDNDEKKGQYSKFWNEFGKSIKLGIIEDATNRNRLAKLLRFESTKSEGKLTSLDQYISRMKTGQKDIFYITGTSKEQLENSPFLERLKKKNFEVIFFTDPVDEYLMQYLMDYEDKKFQNVSKEGLKLGKDSKDKELKESFKDLTKWWKTALSKDNVDDVKISNRLDNTPCVVVTSKFGWSANMERIMQSQTLSDASKQAYMRGKRVLEINPRHPIIKELRERVVKNPEVHSRLLEHFLRHLFPQLKWGLSVNTICFTFQDEGVKHTAQLMYQTALFESGFLLDDPKDFASRIYDSVKTSLDISPEATVEEEDDTEVEAESDAKEDSKPETDAVNDDNDVKDEL

SEQ ID NO: 1218 - protein, 241 aa, Glycine max
MTSISSTPNSTIVTLLHSHPATCSNRTVTSASRATINISLSSSATPSKTLIPLSSSSSVVRFSILFSATMPNPKVFFDMTIGGQPAGRIVMELYADVTPSTAENFRALCTGEKGAGRSGKPLHYKGSSFHRVIPNFMCQGGDFTAGNGTGGESIYGAKFADENFVKKHTGPGILSMANAGPGTNGSQFFICTTKTEWLDGKHVVFGQVVEGMDVVKEIEKVGSSSGRTAKPVVVADCGQLS

SEQ ID NO: 1219 - protein, 417 aa, Glycine max
MLALPFPISTHFCTKKHLLHLCNQRKIKSTQEVKLGGEINMQRSESMRLKEKKVKDLMVDKKRLVEVPYMASLAHTMTTLVANKVVAVPVAAPPGQWIGAGGSMIVESDKQTGTVRKHYIGMVTMLDIVVHIAGDNHLSGDDDDITKDLDQRMSGPVSSIIGHSFEGLSLWTLNPNTSLLDCMEVLSKGVHRAMVPVDGQAENVAAAGVELVESAWSYQMLTQMDVLRFLHDRAGEGDGELQSILSRSVQDLLAVTEQIYAITDRTKLVDAIKCLKAAMLNAVPIVRASDVDQDDHKQHINGRCRKLIGTFSSTDLRGCHIATLKSWLGISALAFTEDVASSPLYTESESDTQINRRELVTCFAESPLSEVIEKAVTRHVHRVWMVDHQGLLVGVVSLTDVIRVIRHSLLSSDSDDL

SEQ ID NO: 1220 - protein, 619 aa, Glycine max
MATLTASSNLVSRNSHVHHGPTTASYESKAVAMGLRSLKQTNTHNGLRILNPVDELLNRTPIKTNAVQAMRKGPQGKNARPKGMITCGMTFIIIGTEVAPWCKTGGLGDVLGGLPPALAGFGHRVMTIVPRYDQYKDAWDTSVVIEVKVGDRTEKVRFFHCYKRGVDRVFVDHPWFLEKVWGKTGQKLYGPTTGNDYEDNQLRFSLFCQAALEAPRVLSLNSSKYFSGPYGEDVIFVANDWHTALIPCYLKSMYQSRGIYTNARVVFCIHNIAYQGRFAFADFSLLNLPDQFKSSFDFIDGHVKPVVGRKINWLKAGLIESWFVITVSPNYAKELVSGPDKGVELDNIIRKIDDDGRLVGIVNGMDVQEWNPTTDKYIAVKYDVSTVLEAKALLKEALQAEVGLPVDRNIPLIGFIGRLEEQKGSDILAEAIPQFIKQNVQLVALGTGKKQMEKQLEELEISYPDKARGVAKFNVPLAHMIIAGADFILVPSRFEPCGLIQLQAMRYGSVPIVASTGGLVDTVKEGFTGFQMGAFNVECDAVDPADVDAISKTVKRALAVYGTPAFTEIIKNCMAQDLSWKGPAKEWEEVLLSLGVPGSEPGSDGEEIAPQAKENVATP

SEQ ID NO: 1221 - protein, 247 aa, Glycine max
MKFNIASPTTGCQKKLEIDDDQKLRAFWDKRISQEVSGDALGEEFKGYVFKITGGCDKQGFPMKQGVLTPGRVRLLLHRGTPCFRGYGRRNGERRRKSVRGCIVSPDLSVLNLVIVKKGENDLPGLTDAEKPRMRGPKRASKIRKLFNLSKEDDVRKYVNTYRRTFTTKAGKKVSKAPKIQRLVTPLTLQRKRARIADKKKRIAKAKSEAAEYQKLLASRLKEQRDRRSESLAKRRSKLSSAAKAAV

SEQ ID NO: 1222 - protein, 150 aa, Glycine max
MSRRKVREPKEENVTLGPAVRDGEHVFGVARIFASFNDTFIHVTDLSGRETLVRITGGMKVKADRDESSPYAAMLAAQDVAARCKELGITALHIKLRATGGNKTKTPGPGAQSALRALARSGMKIGRIEDVTPIPSDSTRRKSGRRGRRL

SEQ ID NO: 1223 - protein, 143 aa, Glycine max
MATARTVKDVSPHEFVKAYSSHLKRSGKMELPEWTDIVKTARFKELAPYDPDWYYVRAASMARKIYLRGGLGVGAFQRIYGGSKRNGSRPPHFCKSSGAVARHILQQLQNMSIIELDTKGGRKITSSGRRDLDQVAGRIVVAP

SEQ ID NO: 1224 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKCYRVF

SEQ ID NO: 1225 - protein, 149 aa, Glycine max; identical to SEQ ID NO: 618

SEQ ID NO: 1226 - protein, 162 aa, Glycine max
MAPIAVGDVIPDGILAYLDEENKPQTVSIHSLAAGKKVIIFGVPGAFTPTCSLKHVPGFIERAEELKGKGVDEIICISVNDPFVMNSWAKTFPENKHVKFLADGAAKYTNALGLELDLTDKGLGVRSKRFALLVEDLKVKVANVESGGEFTISSAEEIIKAL

SEQ ID NO: 1227 - protein, 155 aa, Glycine max
MADVEVDVAAAAAAGQPKKRTFKKFSFRGVDLDALLDMSTDELVKMFSARARRRFQRGLTRKPMALIKKLRKAKREAPPGEKPEPVRTHLRNMIIVPEMIGSIIGVYNGKTFNQVEIKPEMIGHYLAEFSISYKPVKHGRPGIGATHSSRFIPLK

SEQ ID NO: 1228 - protein, 129 aa, Glycine max
MEGGLKGSSLQDMKLLFVEMGVGYDLHGQDITAAAMRACRDAISANSIPAFRKGSIPGVTSDHMKLHVKLGVPHPLQQNLNKDKIKSVFPYGQIMNFEVVDGGLVCSTEEMAEKNDDCYIVNAAVYVGY

SEQ ID NO: 1229 - protein, 123 aa, Glycine max
MATYAAMKPNKPGLEESQEQIHKIRITLSSKHVKNLEKVCGDLVRGAKDKRLRVKGPVRMPTKVLHITTRKSPCGEGTNTWDRFELRVHKRVIDLYSSPDVVKQITSITIEPGVEVEVTIADA

SEQ ID NO: 1230 - protein, 191 aa, Glycine max
MYTSRKKIHKDKDAEPTEFEESVGQALFDLENTNQELKSDLKDLYINSAVQVDVSGNRKAVVIHVPYRLRKGFRKIHVRLVRELEKKFSGKDVILVATRRILRPPKKGSAAQRPRSRTLTAVHEAMLEDVVLPAEIVGKRVRFRIDGSKIMKVYLDPKERNNTEYKLETFAAVYRKLSGKDVVFEYPVSEA

SEQ ID NO: 1231 - protein, 157 aa, Glycine max
MAVIFSSAIPGGAAPAAIEQVQCFGRKKTAVAVTYCKRGRGLIKINGCPIELVEPEILRFKAFEPILLLGRHRFAGVDMRIRVKGGGHTSQIYAIRQSIAKALVAYYQKYVDEQSKKEIKDILVRYDRTLLVADPRRCEPKKFGGRGARARFQKSYR

SEQ ID NO: 1232 - protein, 348 aa, Glycine max
MATDSSNGNGHHQTTTKQPPLPSPLRFSKFFQSNMRILVTGGAGFIGSHLVDRLMENEKNEVIVADNYFTGSKDNLKKWIGHPRFELIRHDVTEPLLIEVDQIYHLACPASPIFYKYNPVKTIKTNVIGTLNMLGLAKRVGARILLTSTSEVYGDPLVHPQPESYWGNVNPIGVRSCYDEGKRVAETLMFDYHRQHGIEIRIARIFNTYGPRMNIDDGRVVSNFIAQALRGEPLTVQCPGTQTRSFCYVSDLVDGLIRLMEGSNTGPINLGNPGEFTMTELAETVKELINPGVEIKMVENTPDDPRQRKPDITKAKELLGWEPKVKLRDGLPRMEEDFRLRLGVGKKN

SEQ ID NO: 1233 - protein, 261 aa, Glycine max
MAVGKNKRISKGKKGGKKKAADPFAKKDWYDIKAPSLFQVKNVGKTLVSRTQGTKIASEGLKHRVFEVSLADLQGDEDHAFKKIRLRAEDVQGKNVLTNFWGMDFTTDKLRSLVRKWQTLIEAHVDVKTTDNYTLRMFCIGFTKRRANQVKRTCYAQSSQIRQIRRKMREIMTNQATSCDLKELVRKFIPEIIGKEIEKATSSIYPLQNVFVRKVKILKAPKFDLGKLMEVHGDYSEDVGAKVDRPADEIVAEEPTEIVGA

SEQ ID NO: 1234 - protein, 166 aa, Glycine max
MPPKFDPSQIVDVFVRVTGGEVGAASSLAPKIGPLGLSPKKIGEDIAKETAKDWKGLRVTVKLTVQNRQAKVTVVPSAAALVIKALKEPERDRKKTKNIKHNGNISLDDVIEIARVMRPRSMAKDLSGSIKEILGTCVSVGCTVDGKDPKDLQQEITDGDVEVPLD

SEQ ID NO: 1235 - protein, 181 aa, Glycine max
MIIPEKNRKEICKYLFQEGVCFAKKDFNLAKHPEIDVPNLQVIKLMQSFKSREYVRETFAWMHYYWFLTNDGIEFLRTYLNLPSEIVPATLKKQAKPAGRPFGGPPGDRPRGPPRFDGERRFGGDRDGYRGGPRGPGGDFGDKGGAPADYRPSFGGGPGGRPGFGRGSGGYGAPTSSNIPS

SEQ ID NO: 1236 - protein, 395 aa, Glycine max
MASASATLLKSSPVLDKCEWVKGQTLRQPLVRCNPSSASALTIKAASYADELVKTAKTVASPGRGILAMDESNATCGKRLASIGLENTEANRQAYRTLLVTVPGLGEYISGAILFEETLYQSTVDGRKIVDVLVDQNIVPGIKVDKGLVPLAGSNDESWCQGLDGLASRSAAYYQQGARFAKWRTVVSIPNGPSALAVKEAAWGLARYAAISQENGLVPIVEPEILLDGEHGIDRTFEVAQKVWSEVFFYLAENNVLLEGILLKPSMVTPGAESKDKATPLQVADYTLKLLHRRIPPAVPGIMFLSGGQSEVEATLNLNAMNQSPNPWHVSFSYARALQNTCLKTWGGLPENVKAAQDALLFRAKSNSLAQLGKYTAEGESEEATRGMFVKGYSY

SEQ ID NO: 1237 - protein, 579 aa, Glycine max
MGERKGIPIALGLLAMLLFFIASSSSSHLVRASDDADDAIFYESFDEDFDGRWIVSDKEDYNGVWKHAKSDGHDDYGLLVSEQARKYAIVKKLDEPVSLKDGTVVLQFETRLQNGLECGGAYIKYLRPQESGWKPKEFDNESPYSIMFGPDKCGATNKVHFIFKHKNPKSGEYVEHHLKYPPSVPSDKLTHVYTAILKPDNELQILIDGEEKKKANFLSSEDFEPPLIPSKTIPDPDDKKPEDWDERAKIPDPSAVKPDDWDEDAPMEILDEEAEKPEGWLDDEPEEIDDPEATKPEDWDDEEDGEWEAPKIENPKCEAAPGCGEWKRPMKRNPAYKGKWSAPYIDNPNYKGIWKPREIPNPEYFELEKPDFEPIAALGIEIWTMQDGILFDNILIANDDKVAESYRETTWKPKFTIEKEKQKAEDEAATGSDGIAGFQKKVFDLLYKIADIPFLSDHKSKIYDLIEKAEKQPNLTIGILVAVVVVFVSIFFRLIFGGKKPVSSDFFSLRSFIVFLSWNYYSVLFYLNLITKSLLVQAKVEKKPERTEASNNQGGAENEENKEKEEASNAPRRRPRRED

SEQ ID NO: 1238 - protein, 476 aa, Glycine max
MAQLKASPACSTRATAPSFHTTGHLYHHFWKAKPSSFKELGLRTSVGANKLQVIKAAARSDTEVVSETTKAGGLRGKLNKVVLAYSGGLDTSVIVPWLRENYGCEVVCFTADVGQGIKELEGLEQKAKASGACQLVVKDLKEEFVKDYIFPCLRAGAVYERKYLLGTSMARPVIAKAMVDVAKEVGADAVSHGCTGKGNDQVRFELTFFALNPKLNVVAPWREWDITGREDAIEYAKKHSIPVPVTKKSIYSRDRNLWHLSHEGDILEDPSNEPKKDMYMMSVDPEDAPDQAEYVEIGLESGLPVSVNGKSLSPASLLAELNEIGGRHGIGRIDMVENRLVGMKSRGVYETPGGTILFAAARELESLTLDRETIQVKDSLALKYAELVYAGRWFDPLRESMDAFMQKITETTTGSVTLKLYKGSVTVTSRTSPFSLYREDISSFESGQIYDQADAAGFIRLYGLPVRVRAMLEQGI

SEQ ID NO: 1239 - protein, 181 aa, Glycine max
MAEVRSQQQQPQHVQVHATTTHTPQHHGGEGGSGILNLIPEMSLTGSQLLALLAGVPLGAMLLLLSGISLIASLLGLAVATPLFIFFSPLLVPAAFAIGMAVTAVLAAGACGLAGLVLFSWVVNYLRQMPRGTTMMTVLPEQAKRHVADMAEYVGQKTKEVGQDIQTRAHHAQGTTRMTVH

SEQ ID NO: 1240 - protein, 233 aa, Glycine max
MDQKVDFSAPHSMGTTIIGVTYNGGVVLGADSRTSTGVYVANRASDKITQLTDNVYVCRSGSAADSQIVSDYVRYFLHQHTIQLGQPATVKVAANLVRLLAYNNKNFLQTGLIVGGWDKYEGGQIYGVPLGGTIVQQPFAIGGSGSSYLYGFFDQAWKEGMTKDEAEDLVKKAVSLAIARDGASGGVVRTVIINSEGVTRNFYPGDQLPLWHEEMEAHNSLLDILGVPEPMSM

SEQ ID NO: 1241 - protein, 545 aa, Glycine max
MASNDSDSQMKIVHGDAGYILEDVPHFADYIPNLPVFSLSLSLFRSSSITYANCIALTHSLADRLCTTFFFLQTYPNPLRSNPAYSVVKQYFVHMDDTVPQKVVVHKDSPRGVHFRRAGPRQKVYFKSDEVHACIVTCGGLCPGLNTVIREIVCGLSYMYGVNKVLGIDGGYRGFYSKNTITLTPKVVNDIHKRGGTILGTSRGGHDTGKIVDSIQDRGINQVYIIGGDGTQRGATVIYEEVRRRGLKVAIAGIPKTIDNDIPVIDKSFGFDTAVEEAQRAINAAHVEAESIENGIGVVKLMGRYSGFIAMYATLASRDVDCCLIPESPFYLEGKGGLFEFIEKRLKENGHMVIVIAEGAGQDLLTESMQAMDQKDASGNKLLQDVGLWISHKIKDHFARKDKMPINLKYIDPTYMIRAIPSNASDNVYCTLLAQSAVHGAMAGYTGFTVGLVNGRQTYIPFIRINERQNKVVITDRMWARLLSSTNQPSFLSPKDLEEAKKAESPTQLLEENNCNDVGDAEKEQPPKDEQESGNHTDNGIKTQN

SEQ ID NO: 1242 - protein, 454 aa, Glycine max
MHGHQPLYPPTESPTMDVKFGTTLIVIFSVMWLMRVNAIDPCASQPDNSDLNVIPIYSKCSPFKPPKADTWDNRIINMASKDPVRVKYLSTLVSQKTVSTAPIASGQAFNIGNYVVRVKLGTPGQLLFMVLDTSTDEAFVPCSGCTGCSDTTFSPKASTSYGPLDCSVPQCGQVRGLSCPATGTGACSFNQSYAGSSFSATLVQDALRLATDVIPYYSFGCVNAITGASVPAQGLLGLGRGPLSLLSQSGSNYSGIFSYCLPSFKSYYFSGSLKLGPVGQPKSIRTTPLLRSPHRPSLYYVNFTGISVGRVLVPFPSEYLGFNPNTGSGTIIDSGTVITRFVEPVYNAVREEFRKQVGGTTFTSIGAFDTCFVKTYETLAPPITLHFEGLDLKLPLENSLIHSSAGSLACLAMAAAPDNVNSVLNVIANFQQQNLRILFDIVNNKVGIAREVCN

SEQ ID NO: 1243 - protein, 623 aa, Glycine max
MPAVYGARLTTFEDSEKESEYGYVRKVSGPVVVADGMAGAAMYELVRVGHDNLIGEIIRLEGDSATIQVYEETAGLMVNDPVLRTHKPLSVELGPGILGNIFDGIQRPLKTIAKRSGDVYIPRGVSVPALDKDTLWEFQPKKIGEGDLLTGGDLYATVFENSLMQHHIALPPDNMGKITYIAPPGQYSLQDTVLELEFQGVKKKFTMLQTWPVRTPRPVASKLAADTPLLTGQRVLDALFPSVLGGTCAIPGAFGCGKTVISQALSKYSNSDAVVYVGCGERGNEMAEVLMDFPQLTMTLPDGREESVMKRTTLVANTSNMPVAAREASIYTGITLAEYFRDMGYNVSMMADSTSRWAEALREISGRLAEMPADSGYPAYLAARLASFYERAGKVKCLGGPERTGSVTIVGAVSPPGGDFSDPVTSATLSIVQVFWGLDKKLAQRKHFPSVNWLISYSKYSTALETFYEQFDPDFINIRTKAREVLQREDDLNEIVQLVGKDALAEGDKITLETAKLLREDYLAQNAFTPYDKFCPFYKSVWMMRNIIHFYNLANQAVERGAGSDGQKISYTLIKHRMGDLFYRLVSQKFEDPAEGEAALVAKFQKLHEDLTNGFRNLEDETR

SEQ ID NO: 1244 - protein, 421 aa, Glycine max
MAVLQSFVSVHPDSHFPIQNLPYGVFKPQSASPPRPGVAIGDFVLDLSEISSAGLFDGPLLKNSDAFLQPNLNKFVSLGRPAWKEARATLQKLLSATEPTLRDNAVLRQKALVPMSSVELLLPVAVGDYTDFFTSLHHTKNCGIIFRGPQTPVLDNWYRLPVAYHGRASSVVISGTDIVRPRGQAHPVGSSTPYFGPSLKLDFELEMATIVGPGNELGKPVDINNAKDHIFGLVLMNDWSARDIQAWEYIPLGPFLGKSFGTTISPWIVTLEALEPFASEAPKQDPSPLPYLTEKEPKIYDISLEAHIKPAGHEDSGVVSRTNLKHLYWTLTQQLAHHTINGCNLRPGDLLGTGTVSGPEPESRACLLELTWNGQNTVSVNELNRKFLEDGDEVILTGYCKGNGYSVGFGTCSGKIVPAAP

SEQ ID NO: 1245 - protein, 181 aa, Glycine max
MNLNTSSNLETRSLLDELCNFHKKGLFDLGHPLLNRILETFVKAAGIGAVQAVSREAYFTAIEGTGTDNSGGLPPEISSAKKNRLPSLKGETNNKSLEAMVKNTGKESLQWGVAAGLYAGLTYGLKEARGAHDWKNSAVAGAITGATLALTLEDSTHEQIVQCAITGAAISTAANLLTGIF

SEQ ID NO: 1246 - protein, 352 aa, Glycine max
MSRFRRFELIEQPPFFHSCYSFPSFVLQDSLSLDLDLLPLPSHFDAFADLVHAPSFAYRRVERHLENELRLQSLSDRVAELESRFDRVLGGDRKYTWTAEIKGAEKNGFDRKYKWVAEVAEEEDKKKKKNKKKQVKVLKDKSARWTLQLENEDAEEEEEKKKKLLKGVARNVKWTAEITGKGENSGSSRKYTFQVQSGDAEKKEKKNKGNGNGLRIVEIQEPIGHRDVVLRQAFAKRFGAVQNERGKKKDLSPQDAALLIQISFRAYLIRRSKALRALRELAIAKSKLKEIRAQFNNFSYRRHVARDAEERQRFSEKIIVLLLTVDAIEVVISIFGSFFVEQIELFPQFLNC

SEQ ID NO: 1247 - protein, 449 aa, Glycine max
MASRQQKEDRAEAAAKVAAKELEQLNREKDRDFSVGVADQHQQEEHQLDQQKRGVIGSMFKAVQDTYENAKEAVVGKKEPSTTTNSYSTREVIHDVDIQPDDAAAAREVRDKSASKSPGIYNSATADNKTGSKVGEYADYGSQKAKETKDATKEKAGEYTDYASQKAKETKDKTMEKAGEYTDYASQKAKETKDKTMEKAGEYTDYASQKAKEAKDKTMEKGGEYKDYAAEKAKEGKDATVNKMGEYKDYTAEKAKEGKDTTLGKLGELKDSAADAAKRAVGYLSGKTEETKEKVSETAEATANKAAEMKEATREKAAGTAEAAKNKAAEVKDRAAETAEAAKNKTAETAEAAKQKTAQAKDNAKENVSGADEGARRKMEDLRLRGKGYGSHESAGGRGDKVVVKVEESRPGAIAETLKAADQIAGQTFNDVGRFDEEEGVVNVERRKK

SEQ ID NO: 1248 - protein, 213 aa, Glycine max
MALEVAVKAAVGAPNVLGDCPFSQRVLLTLEEKKIPYKLHLIDLSSKPEWFLGVNPEGKVPVVLFDGKWVADSDVIVGILEEKYPEPSLVTPPEFASVGSKIFGSFVSFLKSKDTNDGTEQTLVAELSALDEHLKAHGPYIAGEKVTAVDLSLAPKLYHLVVALSHFKNWNIPESLTHVHNYTKLLFSRESFEKTKPPKVEYVISGWAPKVNA

SEQ ID NO: 1249 - protein, 392 aa, Glycine max
MTTTSFSGLQFAMSRSCIPSSQKIADAGAVVLGGKSKIGSWNKLASACHIASVQPFGRGFTSSSIKSVKSVTKAMTESSAQSAVSGLPINLKGKRAFIAGVADDNGYGWAIAKSLAAAGAEILVGTWVPALNIFESSLRRGKFDESRVLPDGSLMEITKVYPLDAVFDNLDDVPEDIKANKRYAGSSKWTVQEVAESVKEDFGSIDILVHSLANGPEVTKPLLETSRKGYLAAISASSYSYVSLLKHFLPILNPGGSSISLTYIASERIIPGYGGGMSSAKAALESDTRVLAFEAGRKRKIRVNTISAGPLRSRAAKAIGFIDMMIDYSSANAPLQKELSAEEVGNTAAFLASPLASAITGTVLYVDNGLNAMGVGVDSPIFKDLDIPKDQH

SEQ ID NO: 1250 - protein, 137 aa, Glycine max
MGVVVIDGSTVRDFVNDEAAFAKSVDEQFGVLDLNNDGVLSRSELRTAFESMRLIETHFGIDVATPPDQLAKLYDSIFDKFDGDRSGAVDRREFRDEMRKIMLAIADGLGSFPIRMVLEDDPNSLLQKAADLEASKT

SEQ ID NO: 1251 - protein, 536 aa, Glycine max
MASSLRISRLISRSFSSTSFFSRGGNGFLGSRHCKYSTSSAIEEEPVKPSVQVEHTQLLIDGKFVDAASGKTFPTLDPRTGEVIAHVAEGHSEDVDRAVAAARKAFDHGPWPKMTAYERQRILLRAADLLEKHNDELAALETWDNGKPYEQAAKIEVPMLVRLIRYYAGWADKIHGLTVPADGPYHVQTLHEPIGVAGQIIPWNFPLLMFAWKVGPALACGNTIVLKTAEQTPLSALYAAKLFHEAGLPAGVLNVVSGFGPTAGAALASHMEVDKLAFTGSTDTGKVVLELAAKSNLKPVTLELGGKSPFIVCEDADVDQAVELAHFALFFNQGQCCCAGSRTFVHESVYDEFVEKAKARALKRVVGDPFKGGIEQGPQIDSDQFEKILRYIRSGVESGATLETGGDKLGNKGFYIQPTVFSNVKDGMLIARDEIFGPVQSILKFKDLGEVVQRANNTRYGLAAGVFTTNMDTAYTLTRALRVGTVWINCFDTFDAAIPFGGYKMSGQGREKGEYSLKNYLQVKAVVNPLKNPAWL

SEQ ID NO: 1252 - protein, 486 aa, Glycine max
MAQPTTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSRN

SEQ ID NO: 1253 - protein, 333 aa, Glycine max
MASERQALMLILLTTFFFTIKPSQASTTGGITIYWGQNIDDGTLTSTCDTGNFEIVNLAFLNAFGCGITPSWNFAGHCGDWNPCSILEPQIQYCQQKGVKVFLSLGGAKGTYSLCSPEDAKEVANYLYQNFLSGKPGPLGSVTLEGIDFDIELGSNLYWGDLAKELDALRHQNDHYFYLSAAPQCFMPDYHLDNAIKTGLFDHVNVQFYNNPPCQYSPGNTQLLFNSWDDWTSNVLPNNSVFFGLPASPDAAPSGGYIPPQVLISEVLPYVKQASNYGGVMLWDRYHDVLNYHSDQIKDYVPKYAMRFVTAVSDAIYESVSAATHRILQKKPY

SEQ ID NO: 1254 - protein, 166 aa, Glycine max
MAEAQLRDQHGNPVPLTDQYGNPVILTDERGNPVQLTGVATTATGTAGSGFGSYGTGAYGGGASATTVADLLATQPRSGREARELRRSSSSSSSSSEDDGQGGRRKKGVKDKIKEKLPGVGGGNNNKEHAHTTTAPTTATNHPADQHEKKGIMERIKEKLPGHHTH

SEQ ID NO: 1255 - protein, 341 aa, Glycine max
MCEHLLVSLSCYIWVRTQRIVEFNEMEQIKHRTVEVNGIKMHVAEKGEGPVVLFLHGFPELWYSWRHQILSLSSLGYRAVAPDLRGYGDTEAPPSISSYNCFHIVGDLVALIDSLGVQQVFLVAHDWGAIIGWYLCMFRPDKVKAYVCLSVPLLRRDPNIRTVDGMRALYGDDYYVCRFQKPGEMEAQMAEVGTEYVLENILTTRNPGPPILPKGRFQFNPEMPNTLPSWLTEEDLAYYVSKFEKTGFTGPLNYYRNFNLNWELTAPWTGGQIKVPVKYITGELDMVYNSLNLKEYIHGGGFKQDVPNLEQVIVQKGVAHFNNQEAAEEIDNYIYDFINKF

SEQ ID NO: 1256 - protein, 416 aa, Saccharomyces cerevisiae
  source: /note="strain ATCC 204508 / S288c"
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 1257 - protein, 332 aa, Saccharomyces cerevisiae
  source: /note="strain ATCC 204508 / S288c"
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 1258 - protein, 500 aa, Saccharomyces cerevisiae
  source: /note="strain ATCC 204508 / S288c"
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 1259 - protein, 332 aa, Saccharomyces cerevisiae
  source: /note="strain ATCC 204508 / S288c"
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 1260 - protein, 642 aa, Saccharomyces cerevisiae [sequence omitted]

SEQ ID NO: 1261 - protein, 332 aa, Saccharomyces cerevisiae
  source: /note="strain ATCC 204508 / S288c"
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLEKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 1262 - protein, 639 aa, Saccharomyces cerevisiae
  source: /note="strain ATCC 204508 / S288c"
MSKAVGIDLGTTYSCVAHFSNDRVDIIANDQGNRTTPSFVGFTDTERLIGDAAKNQAAMNPANTVFDAKRLIGRNFNDPEVQGDMKHFPFKLIDVDGKPQIQVEFKGETKNFTPEQISSMVLGKMKETAESYLGAKVNDAVVTVPAYFNDSQRQATKDAGTIAGLNVLRIINEPTAAAIAYGLDKKGKEEHVLIFDLGGGTFDVSLLSIEDGIFEVKATAGDTHLGGEDFDNRLVNHFIQEFKRKNKKDLSTNQRALRRLRTACERAKRTLSSSAQTSVEIDSLFEGIDFYTSITRARFEELCADLFRSTLDPVEKVLRDAKLDKSQVDEIVLVGGSTRIPKVQKLVTDYFNGKEPNRSINPDEAVAYGAAVQAAILTGDESSKTQDLLLLDVAPLSLGIETAGGVMTKLIPRNSTIPTKKSEVFSTYADNQPGVLIQVFEGERAKTKDNNLLGKFELSGIPPAPRGVPQIEVTFDVDSNGILNVSAVEKGTGKSNKITITNDKGRLSKEDIEKMVAEAEKFKEEDEKESQRIASKNQLESIAYSLKNTISEAGDKLEQADKDAVTKKAEETIAWLDSNTTATKEEFDDQLKELQEVANPIMSKLYQAGGAPEGAAPGGFPGGAPPAPEAEGPTVEEVD

SEQ ID NO: 1263 - protein, 248 aa, Saccharomyces cerevisiae
  source: /note="strain ATCC 204508 / S288c"
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 1264 - protein, 458 aa, Saccharomyces cerevisiae
  source: /note="strain ATCC 204508 / S288c"
MGKEKSHINVVVIGHVDSGKSTTTGHLIYKCGGIDKRTIEKFEKEAAELGKGSFKYAWVLDKLKAERERGITIDIALWKFETPKYQVTVIDAPGHRDFIKNMITGTSQADCAILIIAGGVGEFEAGISKDGQTREHALLAFTLGVRQLIVAVNKMDSVKWDESRFQEIVKETSNFIKKVGYNPKTVPFVPISGWNGDNMIEATTNAPWYKGWEKETKAGVVKGKTLLEAIDAIEQPSRPTDKPLRLPLQDVYKIGGIGTVPVGRVETGVIKPGMVVTFAPAGVTTEVKSVEMHHEQLEQGVPGDNVGFNVKNVSVKEIRRGNVCGDAKNDPPKGCASFNATVIVLNHPGQISAGYSPVLDCHTAHIACRFDELLEKNDRRSGKKLEDHPKFLKSGDAALVKFVPSKPMCVEAFSEYPPLGRFAVRDMRQTVAVGVIKSVDKTEKAAKVTKAAQKAAKK

SEQ ID NO: 1265 - protein, 563 aa, Saccharomyces cerevisiae
  source: /note="strain ATCC 204508 / S288c"
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 1266 - protein, 109 aa, Saccharomyces cerevisiae; identical to SEQ ID NO: 633
  source: /note="strain ATCC 204508 / S288c"

SEQ ID NO: 1267 - protein, 359 aa, Saccharomyces cerevisiae
  source: /note="strain ATCC 204508 / S288c"
MGVEQILKRKTGVIVGEDVHNLFTYAKEHKFAIPAINVTSSSTAVAALEAARDSKSPIILQTSNGGAAYFAGKGISNEGQNASIKGAIAAAHYIRSIAPAYGIPVVLHSDHCAKKLLPWFDGMLEADEAYFKEHGEPLFSSHMLDLSEETDEENISTCVKYFKRMAAMDQWLEMEIGITGGEEDGVNNENADKEDLYTKPEQVYNVYKALHPISPNFSIAAAFGNCHGLYAGDIALRPEILAEHQKYTREQVGCKEEKPLFLVFHGGSGSTVQEFHTGIDNGVVKVNLDTDCQYAYLTGIRDYVLNKKDYIMSPVGNPEGPEKPNKKFFDPRVWVREGEKTMGAKITKSLETFRTTNTL

SEQ ID NO: 1268 - protein, 767 aa, Saccharomyces cerevisiae
  source: /note="strain ATCC 204508 / S288c"
MVQSAVLGFPRIGPNRELKKATEGYWNGKITVDELFKVGKDLRTQNWKLQKEAGVDIIPSNDFSFYDQVLDLSLLFNVIPDRYTKYDLSPIDTLFAMGRGLQRKATETEKAVDVTALEMVKWFDSNYHYVRPTFSKTTQFKLNGQKPVDEFLEAKELGIHTRPVLLGPVSYLFLGKADKDSLDLEPLSLLEQLLPLYTEILSKLASAGATEVQIDEPVLVLDLPANAQAAIKKAYTYFGEQSNLPKITLATYFGTVVPNLDAIKGLPVAALHVDFVRAPEQFDEVVAAIGNKQTLSVGIVDGRNIWKNDFKKSSAIVNKAIEKLGADRVVVATSSSLLHTPVDLNNETKLDAEIKGFFSFATQKLDEVVVITKNVSGQDVAAALEANAKSVESRGKSKFIHDAAVKARVASIDEKMSTRAAPFEQRLPEQQKVFNLPLFPTTTIGSFPQTKDIRINRNKFNKGTISAEEYEKFINSEIEKVIRFQEEIGLDVLVHGEPERNDMVQYFGEQINGYAFTVNGWVQSYGSRYVRPPIIVGDLSRPKAMSVKESVYAQSITSKPVKGMLTGPITCLRWSFPRDDVDQKTQAMQLALALRDEVNDLEAAGIKVIQVDEPALREGLPLREGTERSAYYTWAAEAFRVATSGVANKTQIHSHFCYSDLDPNHIKALDADVVSIEFSKKDDANYIAEFKNYPNHIGLGLFDIHSPRIPSKDEFIAKISTILKSYPAEKFWVNPDCGLKTRGWEETRLSLTHMVEAAKYFREQYKN

SEQ ID NO: 1269 - protein, 908 aa, Saccharomyces cerevisiae
  source: /note="strain ATCC 204508 / S288c"
MNDQTQFTERALTILTLAQKLASDHQHPQLQPIHILAAFIETPEDGSVPYLQNLIEKGRYDYDLFKKVVNRNLVRIPQQQPAPAEITPSYALGKVLQDAAKIQKQQKDSFIAQDHILFALFNDSSIQQIFKEAQVDIEAIKQQALELRGNTRIDSRGADTNTPLEYLSKYAIDMTEQARQGKLDPVIGREEEIRSTIRVLARRIKSNPCLIGEPGIGKTAIIEGVAQRIIDDDVPTILQGAKLFSLDLAALTAGAKYKGDFEERFKGVLKEIEESKTLIVLFIDEIHMLMGNGKDDAANILKPALSRGQLKVIGATTNNEYRSIVEKDGAFERRFQKIEVAEPSVRQTVAILRGLQPKYEIHHGVRILDSALVTAAQLAKRYLPYRRLPDSALDLVDISCAGVAVARDSKPEELDSKERQLQLIQVEIKALERDEDADSTTKDRLKLARQKEASLQEELEPLRQRYNEEKHGHEELTQAKKKLDELENKALDAERRYDTATAADLRYFAIPDIKKQIEKLEDQVAEEERRAGANSMIQNVVDSDTISETAARLTGIPVKKLSESENEKLIHMERDLSSEVVGQMDAIKAVSNAVRLSRSGLANPRQPASFLFLGLSGSGKTELAKKVAGFLFNDEDMMIRVDCSELSEKYAVSKLLGTTAGYVGYDEGGFLTNQLQYKPYSVLLFDEVEKAHPDVLTVMLQMLDDGRITSGQGKTIDCSNCIVIMTSNLGAEFINSQQGSKIQESTKNLVMGAVRQHFRPEFLNRISSIVIFNKLSRKAIHKIVDIRLKEIEERFEQNDKHYKLNLTQEAKDFLAKYGYSDDMGARPLNRLIQNEILNKLALRILKNEIKDKETVNVVLKKGKSRDENVPEEAEECLEVLPNHEATIGADTLGDDDNEDSMEIDDDLD

SEQ ID NO: 1270 - protein, 705 aa, Saccharomyces cerevisiae
  source: /note="strain ATCC 204508 / S288c"
MAGETFEFQAEITQLMSLIINTVYSNKEIFLRELISNASDALDKIRYQALSDPKQLETEPDLFIRITPKPEEKVLEIRDSGIGMTKAELINNLGTIAKSGTKAFMEALSAGADVSMIGQFGVGFYSLFLVADRVQVISKNNEDEQYIWESNAGGSFTVTLDEVNERIGRGTVLRLFLKDDQLEYLEEKRIKEVIKRHSEFVAYPIQLLVTKEVEKEVPIPEEEKKDEEKKDEDDKKPKLEEVDEEEEEKKPKTKKVKEEVQELEELNKTKPLWTRNPSDITQEEYNAFYKSISNDWEDPLYVKHFSVEGQLEFRAILFIPKRAPFDLFESKKKKNNIKLYVRRVFITDEAEDLIPEWLSFVKGVVDSEDLPLNLSREMLQQNKIMKVIRKNIVKKLIEAFNEIAEDSEQFDKFYSAFAKNIKLGVHEDTQNRAALAKLLRYNSTKSVDELTSLTDYVTRMPEHQKNIYYITGESLKAVEKSPFLDALKAKNFEVLFLTDPIDEYAFTQLKEFEGKTLVDITKDFELEETDEEKAEREKEIKEYEPLTKALKDILGDQVEKVVVSYKLLDAPAAIRTGQFGWSANMERIMKAQALRDSSMSSYMSSKKTFEISPKSPIIKELKKRVDEGGAQDKTVKDLTNLLFETALLTSGFSLEEPTSFASRINRLISLGLNIDEDEETETAPEASTEAPVEEVPADTEMEEVD

SEQ ID NO: 1271 - protein, 842 aa, Saccharomyces cerevisiae
  source: /note="strain ATCC 204508 / S288c"
MVAFTVDQMRSLMDKVTNVRNMSVIAHVDHGKSTLTDSLVQRAGIISAAKAGEARFTDTRKDEQERGITIKSTAISLYSEMSDEDVKEIKQKTDGNSFLINLIDSPGHVDFSSEVTAALRVTDGALVVVDTIEGVCVQTETVLRQALGERIKPVVVINKVDRALLELQVSKEDLYQTFARTVESVNVIVSTYADEVLGDVQVYPARGTVAFGSGLHGWAFTIRQFATRYAKKFGVDKAKMMDRLWGDSFFNPKTKKWTNKDTDAEGKPLERAFNMFILDPIFRLFTAIMNFKKDEIPVLLEKLEIVLKGDEKDLEGKALLKVVMRKFLPAADALLEMIVLHLPSPVTAQAYRAEQLYEGPADDANCIAIKNCDPKADLMLYVSKMVPTSDKGRFYAFGRVFAGTVKSGQKVRIQGPNYVPGKKDDLFIKAIQRVVLMMGRFVEPIDDCPAGNIIGLVGIDQFLLKTGTLTTSETAHNMKVMKFSVSPVVQVAVEVKNANDLPKLVEGLKRLSKSDPCVLTYMSESGEHIVAGTGELHLEICLQDLEHDHAGVPLKISPPVVAYRETVESESSQTALSKSPNKHNRIYLKAEPIDEEVSLAIENGIINPRDDFKARARIMADDYGWDVTDARKIWCFGPDGNGPNLVIDQTKAVQYLHEIKDSVVAAFQWATKEGPIFGEEMRSVRVNILDVTLHADAIHRGGGQIIPTMRRATYAGFLLADPKIQEPVFLVEIQCPEQAVGGIYSVLNKKRGQVVSEEQRPGTPLFTVKAYLPVNESFGFTGELRQATGGQAFPQMVFDHWSTLGSDPLDPTSKAGEIVLAARKRHGMKEEVPGWQEYYDKL

SEQ ID NO: 1272 - protein, 1046 aa, Saccharomyces cerevisiae
  source: /note="strain ATCC 204508 / S288c"
MNMNESISKDGQGEEEQNNFSFGGKPGSYDSNSDSAQRKKSFSTTKPTEYNLPKEQPESTSKNLETKAKNILLPWRKKHNKDSETPHEDTEADANRRANVTSDVNPVSADTKSSSGPNATITTHGYSYVKTTTPAATSEQSKVKTSPPTSHEHSNIKASPTAHRHSKGDAGHPSIATTHNHSTSKAATSPVTHTHGHSSATTSPVTHTHGHASVKTTSPTNTHEHSKANTGPSATATTHGHINVKTTHPVSHGHSGSSTGPKSTAAAQDHSSTKTNPSVTHGHTSVKDNSSATKGYSNTDSNSDRDVIPGSFRGMTGTDVNPVDPSVYTSTGPKSNVSSGMNAVDPSVYTDTSSKSADRRKYSGNTATGPPQDTIKEIAQNVKMDESEQTGLKNDQVSGSDAIQQQTMEPEPKAAVGTSGFVSQQPSYHDSNKNIQHPEKNKVDNKNISERAAEKFNIERDDILESADDYQQKNIKSKTDSNWGPIEYSSSAGKNKNLQDVVIPSSMKEKFDSGTSGSQNMPKAGTELGHMKYNDNGRDNLQYVAGSQAGSQNTNNNIDMSPRHEAEWSGLSNDATTRNNVVSPAMKDEDMNEDSTKPHQYGLDYLDDVEDYHENDIDDYSNAKKNDLYSKKAYQGKPSDYNYEQREKIPGTFEPDTLSKSVQKQDEDPLSPRQTTNRAGMETARDESLGNYEYSNTSGNKKLSDLSKNKSGPTPTRSNFIDQIEPRRAKTTQDIASDAKDFTNNPETGTTGNVDTTGRMGAKSKTFSSNPFDDSKNTDTHLENANVAAFDNSRSGDTTYSKSGDAETAAYDNIKNADPTYAKSQDITGMTHDQEPSSEQKASYGSGGNSQNQEYSSDDNIDVNKNAKVLEEDAPGYKREVDLKNKRRTDLGGADASNAYAAEVGNFPSLIDPHVPTYGFKDTNTSSSQKPSEGTYPETTSYSIHNETTSQGRKVSVGSMGSGKSKHHHNHHRHSRQNSSKGSDYDYNNSTHSAEHTPRHHQYGSDEGEQDYHDDEQGEEQAGKQSFMGRVRKSISGGTFGFRSEI

SEQ ID NO: 1273 - protein, 273 aa, Saccharomyces cerevisiae
  source: /note="strain ATCC 204508 / S288c"
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 1274 - protein, 709 aa, Saccharomyces cerevisiae [sequence omitted]

SEQ ID NO: 1275 - protein, 168 aa, Saccharomyces cerevisiae; identical to SEQ ID NO: 515
  source: /note="strain ATCC 204508 / S288c"

SEQ ID NO: 1276 - protein, 519 aa, Saccharomyces cerevisiae
  source: /note="strain ATCC 204508 / S288c"
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 1277 - protein, 247 aa, Saccharomyces cerevisiae
  source: /note="strain ATCC 204508 / S288c"
MPKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 1278 - protein, 387 aa, Saccharomyces cerevisiae
  source: /note="strain ATCC 204508 / S288c"
MSHRKYEAPRHGHLGFLPRKRAASIRARVKAFPKDDRSKPVALTSFLGYKAGMTTIVRDLDRPGSKFHKREVVEAVTVVDTPPVVVVGVVGYVETPRGLRSLTTVWAEHLSDEVKRRFYKNWYKSKKKAFTKYSAKYAQDGAGIERELARIKKYASVVRVLVHTQIRKTPLAQKKAHLAEIQLNGGSISEKVDWAREHFEKTVAVDSVFEQNEMIDAIAVTKGHGFEGVTHRWGTKKLPRKTHRGLRKVACIGAWHPAHVMWSVARAGQRGYHSRTSINHKIYRVGKGDDEANGATSFDRTKKTITPMGGFVHYGEIKNDFIMVKGCIPGNRKRIVTLRKSLYTNTSRKALEEVSLKWIDTASKFGKGRFQTPAEKHAFMGTLKKDL

SEQ ID NO: 1279 - protein, 444 aa, Saccharomyces cerevisiae
  source: /note="strain ATCC 204508 / S288c"
MPSHFDTVQLHAGQENPGDNAHRSRAVPIYATTSYVFENSKHGSQLFGLEVPGYVYSRFQNPTSNVLEERIAALEGGAAALAVSSGQAAQTLAIQGLAHTGDNIVSTSYLYGGTYNQFKISFKRFGIEARFVEGDNPEEFEKVFDERTKAVYLETIGNPKYNVPDFEKIVAIAHKHGIPVVVDNTFGAGGYFCQPIKYGADIVTHSATKWIGGHGTTIGGIIVDSGKFPWKDYPEKFPQFSQPAEGYHGTIYNEAYGNLAYIVHVRTELLRDLGPLMNPFASFLLLQGVETLSLRAERHGENALKLAKWLEQSPYVSWVSYPGLASHSHHENAKKYLSNGFGGVLSFGVKDLPNADKETDPFKLSGAQVVDNLKLASNLANVGDAKTLVIAPYFTTHKQLNDKEKLASGVTKDLIRVSVGIEFIDDIIADFQQSFETVFAGQKP

SEQ ID NO: 1280 - protein, 500 aa, Saccharomyces cerevisiae
  source: /note="strain ATCC 204508 / S288c"
MSFDDLHKATERAVIQAVDQICDDFEVTPEKLDELTAYFIEQMEKGLAPPKEGHTLASDKGLPMIPAFVTGSPNGTERGVLLAADLGGTNFRICSVNLHGDHTFSMEQMKSKIPDDLLDDENVTSDDLFGFLARRTLAFMKKYHPDELAKGKDAKPMKLGFTFSYPVDQTSLNSGTLIRWTKGFRIADTVGKDVVQLYQEQLSAQGMPMIKVVALTNDTVGTYLSHCYTSDNTDSMTSGEISEPVIGCIFGTGTNGCYMEEINKITKLPQELRDKLIKEGKTHMIINVEWGSFDNELKHLPTTKYDVVIDQKLSTNPGFHLFEKRVSGMFLGEVLRNILVDLHSQGLLLQQYRSKEQLPRHLTTPFQLSSEVLSHIEIDDSTGLRETELSLLQSLRLPTTPTERVQIQKLVRAISRRSAYLAAVPLAAILIKTNALNKRYHGEVEIGCDGSVVEYYPGFRSMLRHALALSPLGAEGERKVHLKIAKDGSGVGAALCALVA

SEQ ID NO: 1281 - protein, 584 aa, Saccharomyces cerevisiae
  source: /note="strain ATCC 204508 / S288c"
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVELGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 1282 - protein, 341 aa, Saccharomyces cerevisiae
  source: /note="strain ATCC 204508 / S288c"
MHRTYSLRNQRAPTAAELQAPPPPPSSTKSKFFGKASIASSFRKNAAGNFGPELARKLSQLVKTEKGVLRAMEVVASERREAAKQLSLWGADNDDDVSDVTDKLGVLIYELGELQDQFIDKYDQYRVTLKSIRNIEASVQPSRDRKEKITDEIAHLKYKDPQSTKIPVLEQELVRAEAESLVAEAQLSNITREKLKAAYSYMFDSLRELSEKFALIAGYGKALLELLDDSPVTPGEARPAYDGYEASRQIIMDAESALESWTLDMAAVKPTLSFHQTVDDVYEDEDGEEEEEPEIQNGDIPGQVVEEEEVEWTTEVPVDDEAHEADHHVSQNGHTSGSENI

SEQ ID NO: 1283 - protein, 545 aa, Saccharomyces cerevisiae
  source: /note="strain ATCC 204508 / S288c"
MLARTAAIRSLSRTLINSTKAARPAAAALASTRRLASTKAQPTEVSSILEERIKGVSDEANLNETGRVLAVGDGIARVFGLNNIQAEELVEFSSGVKGMALNLEPGQVGIVLFGSDRLVKEGELVKRTGNIVDVPVGPGLLGRVVDALGNPIDGKGPIDAAGRSRAQVKAPGILPRRSVHEPVQTGLKAVDALVPIGRGQRELIIGDRQTGKTAVALDTILNQKRWNNGSDESKKLYCVYVAVGQKRSTVAQLVQTLEQHDAMKYSIIVAATASEAAPLQYLAPFTAASIGEWFRDNGKHALIVYDDLSKQAVAYRQLSLLLRRPPGREAYPGDVFYLHSRLLERAAKLSEKEGSGSLTALPVIETQGGDVSAYIPTNVISITDGQIFLEAELFYKGIRPAINVGLSVSRVGSAAQVKALKQVAGSLKLFLAQYREVAAFAQFGSDLDASTKQTLVRGERLTQLLKQNQYSPLATEEQVPLIYAGVNGHLDGIELSRIGEFESSFLSYLKSNHNELLTEIREKGELSKELLASLKSATESFVATF

SEQ ID NO: 1284 - protein, 613 aa, Saccharomyces cerevisiae
  source: /note="strain ATCC 204508 / S288c"
MAEGVFQGAIGIDLGTTYSCVATYESSVEIIANEQGNRVTPSFVAFTPEERLIGDAAKNQAALNPRNTVFDAKRLIGRRFDDESVQKDMKTWPFKVIDVDGNPVIEVQYLEETKTFSPQEISAMVLTKMKEIAEAKIGKKVEKAVITVPAYFNDAQRQATKDAGAISGLNVLRIINEPTAAAIAYGLGAGKSEKERHVLIFDLGGGTFDVSLLHIAGGVYTVKSTSGNTHLGGQDFDTNLLEHFKAEFKKKTGLDISDDARALRRLRTAAERAKRTLSSVTQTTVEVDSLFDGEDFESSLTRARFEDLNAALFKSTLEPVEQVLKDAKISKSQIDEVVLVGGSTRIPKVQKLLSDFFDGKQLEKSINPDEAVAYGAAVQGAILTGQSTSDETKDLLLLDVAPLSLGVGMQGDMFGIVVPRNTTVPTIKRRTFTTCADNQTTVQFPVYQGERVNCKENTLLGEFDLKNIPMMPAGEPVLEAIFEVDANGILKVTAVEKSTGKSSNITISNAVGRLSSEEIEKMVNQAEEFKAADEAFAKKHEARQRLESYVASIEQTVTDPVLSSKLKRGSKSKIEAALSDALAALQIEDPSADELRKAEVGLKRVVTKAMSSR

SEQ ID NO: 1285 - protein, 199 aa, Saccharomyces cerevisiae
  source: /note="strain ATCC 204508 / S288c"
MDKIREKLSNLKLEAESWQEKYEELKEKNKDLEQENVEKENQIKSLTVKNQQLEDEIEKLEAGLSDSKQTEQDNVEKENQIKSLTVKNHQLEEEIEKLEAELAESKQLSEDSHHLQSNNDNFSKKNQQLEEDLEESDTKLKETTEKLRESDLKADQLERRVAALEEQREEWERKNEELTVKYEDAKKELDEIAASLENL

SEQ ID NO: 1286 - protein, 375 aa, Saccharomyces cerevisiae
  source: /note="strain ATCC 204508 / S288c"
MDSEVAALVIDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHAILRIDLAGRDLTDYLMKILSERGYSFSTTAEREIVRDIKEKLCYVALDFEQEMQTAAQSSSIEKSYELPDGQVITIGNERFRAPEALFHPSVLGLESAGIDQTTYNSIMKCDVDVRKELYGNIVMSGGTTMFPGIAERMQKEITALAPSSMKVKIIAPPERKYSVWIGGSILASLTTFQQMWISKQEYDESGPSIVHHKCF

SEQ ID NO: 1287 - protein, 554 aa, Saccharomyces cerevisiae; identical to SEQ ID NO: 724
  source: /note="strain ATCC 204508 / S288c"

SEQ ID NO: 1288 - protein, 649 aa, Saccharomyces cerevisiae
  source: /note="strain ATCC 204508 / S288c"
MSRAVGIDLGTTYSCVAHFSNDRVEIIANDQGNRTTPSYVAFTDTERLIGDAAKNQAAINPHNTVFDAKRLIGRKFDDPEVTTDAKHFPFKVISRDGKPVVQVEYKGETKTFTPEEISSMVLSKMKETAENYLGTTVNDAVVTVPAYFNDSQRQATKDAGTIAGMNVLRIINEPTAAAIAYGLDKKGRAEHNVLIFDLGGGTFDVSLLSIDEGVFEVKATAGDTHLGGEDFDNRLVNHLATEFKRKTKKDISNNQRSLRRLRTAAERAKRALSSSSQTSIEIDSLFEGMDFYTSLTRARFEELCADLFRSTLEPVEKVLKDSKLDKSQIDEIVLVGGSTRIPKIQKLVSDFFNGKEPNRSINPDEAVAYGAAVQAAILTGDQSTKTQDLLLLDVAPLSLGIETAGGIMTKLIPRNSTIPTKKSETFSTYADNQPGVLIQVFEGERTRTKDNNLLGKFELSGIPPAPRGVPQIDVTFDIDANGILNVSALEKGTGKSNKITITNDKGRLSKDDIDRMVSEAEKYRADDEREAERVQAKNQLESYAFTLKNTINEASFKEKVGEDDAKRLETASQETIDWLDASQAASTDEYKDRQKELEGIANPIMTKFYGAGAGAGPGAGESGGFPGSMPNSGATGGGEDTGPTVEEVD

SEQ ID NO: 1289 - protein, 778 aa, Saccharomyces cerevisiae
  source: /note="strain ATCC 204508 / S288c"
MLSARSAIKRPIVRGLATVSNLTRDSKVNQNLLEDHSFINYKQNVETLDIVRKRLNRPFTYAEKILYGHLDDPHGQDIQRGVSYLKLRPDRVACQDATAQMAILQFMSAGLPQVAKPVTVHCDHLIQAQVGGEKDLKRAIDLNKEVYDFLASATAKYNMGFWKPGSGIIHQIVLENYAFPGALIIGTDSHTPNAGGLGQLAIGVGGADAVDVMAGRPWELKAPKILGVKLTGKMNGWTSPKDIILKLAGITTVKGGTGKIVEYFGDGVDTFSATGMGTICNMGAEIGATTSVFPFNKSMIEYLEATGRGKIADFAKLYHKDLLSADKDAEYDEVVEIDLNTLEPYINGPFTPDLATPVSKMKEVAVANNWPLDVRVGLIGSCTNSSYEDMSRSASIVKDAAAHGLKSKTIFTVTPGSEQIRATIERDGQLETFKEFGGIVLANACGPCIGQWDRRDIKKGDKNTIVSSYNRNFTSRNDGNPQTHAFVASPELVTAFAIAGDLRFNPLTDKLKDKDGNEFMLKPPHGDGLPQRGYDAGENTYQAPPADRSTVEVKVSPTSDRLQLLKPFKPWDGKDAKDMPILIKAVGKTTTDHISMAGPWLKYRGHLENISNNYMIGAINAENKKANCVKNVYTGEYKGVPDTARDYRDQGIKWVVIGDENFGEGSSREHAALEPRFLGGFAIITKSFARIHETNLKKQGLLPLNFKNPADYDKINPDDRIDILGLAELAPGKPVTMRVHPKNGKPWDAVLTHTFNDEQIEWFKYGSALNKIKADEKK

SEQ ID NO: 1290 - protein, 1071 aa, Saccharomyces cerevisiae
  source: /note="strain ATCC 204508 / S288c"
MAGAIENARKEIKRISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLSTMQERFAESTD

SEQ ID NO: 1291 - protein, 572 aa, Saccharomyces cerevisiae
  source: /note="strain ATCC 204508 / S288c"
MLRSSVVRSRATLRPLLRRAYSSHKELKFGVEGRASLLKGVETLAEAVAATLGPKGRNVLIEQPFGPPKITKDGVTVAKSIVLKDKFENMGAKLLQEVASKTNEAAGDGTTSATVLGRAIFTESVKNVAAGCNPMDLRRGSQVAVEKVIEFLSANKKEITTSEEIAQVATISANGDSHVGKLLASAMEKVGKEGVITIREGRTLEDELEVTEGMRFDRGFISPYFITDPKSSKVEFEKPLLLLSEKKISSIQDILPALEISNQSRRPLLIIAEDVDGEALAACILNKLRGQVKVCAVKAPGFGDNRKNTIGDIAVLTGGTVFTEELDLKPEQCTIENLGSCDSITVTKEDTVILNGSGPKEAIQERIEQIKGSIDITTTNSYEKEKLQERLAKLSGGVAVIRVGGASEVEVGEKKDRYDDALNATRAAVEEGILPGGGTALVKASRVLDEVVVDNFDQKLGVDIIRKAITRPAKQIIENAGEEGSVIIGKLIDEYGDDFAKGYDASKSEYTDMLATGIIDPFKVVRSGLVDASGVASLLATTEVAIVDAPEPPAAAGAGGMPGGMPGMPGMM

SEQ ID NO: 1292 - protein, 563 aa, Saccharomyces cerevisiae
  source: /note="strain ATCC 204508 / S288c"
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 1293 - protein, 562 aa, Saccharomyces cerevisiae
  source: /note="strain ATCC 204508 / S288c"
MNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWSIASAN

SEQ ID NO: 1294 - protein, 391 aa, Saccharomyces cerevisiae
  source: /note="strain ATCC 204508 / S288c"
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 1295 - protein, 485 aa, Saccharomyces cerevisiae
  source: /note="strain ATCC 204508 / S288c"
MVHLGPKKPQARKGSMADVPKELMDEIHQLEDMFTVDSETLRKVVKHFIDELNKGLTKKGGNIPMIPGWVMEFPTGKESGNYLAIDLGGTNLRVVLVKLSGNHTFDTTQSKYKLPHDMRTTKHQEELWSFIADSLKDFMVEQELLNTKDTLPLGFTFSYPASQNKINEGILQRWTKGFDIPNVEGHDVVPLLQNEISKRELPIEIVALINDTVGTLIASYYTDPETKMGVIFGTGVNGAFYDVVSDIEKLEGKLADDIPSNSPMAINCEYGSFDNEHLVLPRTKYDVAVDEQSPRPGQQAFEKMTSGYYLGELLRLVLLELNEKGLMLKDQDLSKLKQPYIMDTSYPARIEDDPFENLEDTDDIFQKDFGVKTTLPERKLIRRLCELIGTRAARLAVCGIAAICQKRGYKTGHIAADGSVYNKYPGFKEAAAKGLRDIYGWTGDASKDPITIVPAEDGSGAGAAVIAALSEKRIAEGKSLGIIGA

SEQ ID NO: 1296 - protein, 959 aa, Saccharomyces cerevisiae
  source: /note="strain ATCC 204508 / S288c"
MTVTTPFVNGTSYCTVTAYSVQSYKAAIDFYTKFLSLENRSSPDENSTLLSNDSISLKILLRPDEKINKNVEAHLKELNSITKTQDWRSHATQSLVFNTSDILAVKDTLNAMNAPLQGYPTELFPMQLYTLDPLGNVVGVTSTKNAVSTKPTPPPAPEASAESGLSSKVHSYTDLAYRMKTTDTYPSLPKPLNRPQKAIAVMTSGGDAPGMNSNVRAIVRSAIFKGCRAFVVMEGYEGLVRGGPEYIKEFHWEDVRGWSAEGGTNIGTARCMEFKKREGRLLGAQHLIEAGVDALIVCGGDGSLTGADLFRSEWPSLIEELLKTNRISNEQYERMKHLNICGTVGSIDNDMSTTDATIGAYSALDRICKAIDYVEATANSHSRAFVVEVMGRNCGWLALLAGIATSADYIFIPEKPATSSEWQDQMCDIVSKHRSRGKRTTIVVVAEGAIAADLTPISPSDVHKVLVDRLGLDTRITTLGHVQRGGTAVAYDRILATLQGLEAVNAVLESTPDTPSPLIAVNENKIVRKPLMESVKLTKAVAEAIQAKDFKRAMSLRDTEFIEHLNNFMAINSADHNEPKLPKDKRLKIAIVNVGAPAGGINSAVYSMATYCMSQGHRPYAIYNGWSGLARHESVRSLNWKDMLGWQSRGGSEIGTNRVTPEEADLGMIAYYFQKYEFDGLIIVGGFEAFESLHQLERARESYPAFRIPMVLIPATLSNNVPGTEYSLGSDTALNALMEYCDVVKQSASSTRGRAFVVDCQGGNSGYLATYASLAVGAQVSYVPEEGISLEQLSEDIEYLAQSFEKAEGRGRFGKLILKSTNASKALSATKLAEVITAEADGRFDAKPAYPGHVQQGGLPSPIDRTRATRMAIKAVGFIKDNQAAIAEARAAEENFNADDKTISDTAAVVGVKGSHVVYNSIRQLYDYETEVSMRMPKVIHWQATRLIADHLVGRKRVD

SEQ ID NO: 1297 - protein, 261 aa, Saccharomyces cerevisiae
  source: /note="strain ATCC 204508 / S288c"
MARGPKKHLKRLAAPHHWLLDKLSGCYAPRPSAGPHKLRESLPLIVFLRNRLKYALNGREVKAILMQRHVKVDGKVRTDTTYPAGFMDVITLDATNENFRLVYDVKGRFAVHRITDEEASYKLGKVKKVQLGKKGVPYVVTHDGRTIRYPDPNIKVNDTVKIDLASGKITDFIKFDAGKLVYVTGGRNLGRIGTIVHKERHDGGFDLVHIKDSLDNTFVTRLNNVFVIGEQGKPYISLPKGKGIKLSIAEERDRRRAQQGL

SEQ ID NO: 1298 - protein, 339 aa, Saccharomyces cerevisiae
  source: /note="strain ATCC 204508 / S288c"
MHRTYSLRNSRAPTASQLQNPPPPPSTTKGRFFGKGGLAYSFRRSAAGAFGPELSRKLSQLVKIEKNVLRSMELTANERRDAAKQLSIWGLENDDDVSDITDKLGVLIYEVSELDDQFIDRYDQYRLTLKSIRDIEGSVQPSRDRKDKITDKIAYLKYKDPQSPKIEVLEQELVRAEAESLVAEAQLSNITRSKLRAAFNYQFDSIIEHSEKIALIAGYGKALLELLDDSPVTPGETRPAYDGYEASKQIIIDAESALNEWTLDSAQVKPTLSFKQDYEDFEPEEGEEEEEEDGQGRWSEDEQEDGQIEEPEQEEEGAVEEHEQVGHQQSESLPQQTTA

SEQ ID NO: 1299 - protein, 511 aa, Saccharomyces cerevisiae
  source: /note="strain ATCC 204508 / S288c"
MVLPRLYTATSRAAFKAAKQSAPLLSTSWKRCMASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFTGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAVLEGKYDNIPEHAFYMVGGIEDVVAKAEKLAAEAN

SEQ ID NO: 1300 - protein, 987 aa, Saccharomyces cerevisiae
  source: /note="strain ATCC 204508 / S288c"
MQSQDSCYGVAFRSIITNDEALFKKTIHFYHTLGFATVKDFNKFKHGENSLLSSGTSQDSLREVWLESFKLSEVDASGFRIPQQEATNKAQSQGALLKIRLVMSAPIDETFDTNETATITYFSTDLNKIVEKFPKQAEKLSDTLVFLKDPMGNNITFSGLANATDSAPTSKDAFLEATSEDEIISRASSDASDLLRQTLGSSQKKKKIAVMTSGGDSPGMNAAVRAVVRTGIHFGCDVFAVYEGYEGLLRGGKYLKKMAWEDVRGWLSEGGTLIGTARSMEFRKREGRRQAAGNLISQGIDALVVCGGDGSLTGADLFRHEWPSLVDELVAEGRFTKEEVAPYKNLSIVGLVGSIDNDMSGTDSTIGAYSALERICEMVDYIDATAKSHSRAFVVEVMGRHCGWLALMAGIATGADYIFIPERAVPHGKWQDELKEVCQRHRSKGRRNNTIIVAEGALDDQLNPVTANDVKDALIELGLDTKVTILGHVQRGGTAVAHDRWLATLQGVDAVKAVLEFTPETPSPLIGILENKIIRMPLVESVKLTKSVATAIENKDFDKAISLRDTEFIELYENFLSTTVKDDGSELLPVSDRLNIGIVHVGAPSAALNAATRAATLYCLSHGHKPYAIMNGFSGLIQTGEVKELSWIDVENWHNLGGSEIGTNRSVASEDLGTIAYYFQKNKLDGLIILGGFEGFRSLKQLRDGRTQHPIFNIPMCLIPATVSNNVPGTEYSLGVDTCLNALVNYTDDIKQSASATRRRVFVCEVQGGHSGYIASFTGLITGAVSVYTPEKKIDLASIREDITLLKENFRHDKGENRNGKLLVRNEQASSVYSTQLLADIISEASKGKFGVRTAIPGHVQQGGVPSSKDRVTASRFAVKCIKFIEQWNKKNEASPNTDAKVLRFKFDTHGEKVPTVEHEDDSAAVICVNGSHVSFKPIANLWENETNVELRKGFEVHWAEYNKIGDILSGRLKLRAEVAALAAENK

SEQ ID NO: 1301 - protein, 1044 aa, Saccharomyces cerevisiae
  source: /note="strain ATCC 204508 / S288c"
MSDSQQSIKVLEELFQKLSVATADNRHEIASEVASFLNGNIIEHDVPEHFFGELAKGIKDKKTAANAMQAVAHIANQSNLSPSVEPYIVQLVPAICTNAGNKDKEIQSVASETLISIVNAVNPVAIKALLPHLTNAIVETNKWQEKIAILAAISAMVDAAKDQVALRMPELIPVLSETMWDTKKEVKAAATAAMTKATETVDNKDIERFIPSLIQCIADPTEVPETVHLLGATTFVAEVTPATLSIMVPLLSRGLNERETGIKRKSAVIIDNMCKLVEDPQVIAPFLGKLLPGLKSNFATIADPEAREVTLRALKTLRRVGNVGEDDAIPEVSHAGDVSTTLQVVNELLKDETVAPRFKIVVEYIAAIGADLIDERIIDQQAWFTHITPYMTIFLHEKKAKDILDEFRKRAVDNIPVGPNFDDEEDEGEDLCNCEFSLAYGAKILLNKTQLRLKRARRYGICGPNGCGKSTLMRAIANGQVDGFPTQEECRTVYVEHDIDGTHSDTSVLDFVFESGVGTKEAIKDKLIEFGFTDEMIAMPISALSGGWKMKLALARAVLRNADILLLDEPTNHLDTVNVAWLVNYLNTCGITSITISHDSVFLDNVCEYIINYEGLKLRKYKGNFTEFVKKCPAAKAYEELSNTDLEFKFPEPGYLEGVKTKQKAIVKVTNMEFQYPGTSKPQITDINFQCSLSSRIAVIGPNGAGKSTLINVLTGELLPTSGEVYTHENCRIAYIKQHAFAHIESHLDKTPSEYIQWRFQTGEDRETMDRANRQINENDAEAMNKIFKIEGTPRRIAGIHSRRKFKNTYEYECSFLLGENIGMKSERWVPMMSVDNAWIPRGELVESHSKMVAEVDMKEALASGQFRPLTRKEIEEHCSMLGLDPEIVSHSRIRGLSGGQKVKLVLAAGTWQRPHLIVLDEPTNYLDRDSLGALSKALKEFEGGVIIITHSAEFTKNLTEEVWAVKDGRMTPSGHNWVSGQGAGPRIEKKEDEEDKFDAMGNKIAGGKKKKKLSSAELRKKKKERMKKKKELGDAYVSSDEEF

SEQ ID NO: 1302 - protein, 1178 aa, Saccharomyces cerevisiae
  source: /note="strain ATCC 204508 / S288c"
MSQRKFAGLRDNFNLLGEKNKILVANRGEIPIRIFRTAHELSMQTVAIYSHEDRLSTHKQKADEAYVIGEVGQYTPVGAYLAIDEIISIAQKHQVDFIHPGYGFLSENSEFADKVVKAGITWIGPPAEVIDSVGDKVSARNLAAKANVPTVPGTPGPIETVEEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKECGYRNAGTAEFLVDNQNRHYFIEINPRIQVEHTITEEITGIDIVAAQIQIAAGASLPQLGLFQDKITTRGFAIQCRITTEDPAKNFQPDTGRIEVYRSAGGNGVRLDGGNAYAGTIISPHYDSMLVKCSCSGSTYEIVRRKMIRALIEFRIRGVKTNIPFLLTLLTNPVFIEGTYWTTFIDDTPQLFQMVSSQNRAQKLLHYLADVAVNGSSIKGQIGLPKLKSNPSVPHLHDAQGNVINVTKSAPPSGWRQVLLEKGPAEFARQVRQFNGTLLMDTTWRDAHQSLLATRVRTHDLATIAPTTAHALAGRFALECWGGATFDVAMRFLHEDPWERLRKLRSLVPNIPFQMLLRGANGVAYSSLPDNAIDHFVKQAKDNGVDIFRVFDALNDLEQLKVGVDAVKKAGGVVEATVCFSGDMLQPGKKYNLDYYLEIAEKIVQMGTHILGIKDMAGTMKPAAAKLLIGSLRAKYPDLPIHVHTHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDVRRLANSLDFPDSVMDFFEGLIGQPYGGFPEPFRSDVLRNKRRKLTCRPGLELEPFDLEKIREDLQNRFGDVDECDVASYNMYPRVYEDFQKMRETYGDLSVLPTRSFLSPLETDEEIEVVIEQGKTLIIKLQAVGDLNKKTGEREVYFDLNGEMRKIRVADRSQKVETVTKSKADMHDPLHIGAPMAGVIVEVKVHKGSLIKKGQPVAVLSAMKMEMIISSPSDGQVKEVFVSDGENVDSSDLLVLLEDQVPVETKA

SEQ ID NO: 1303 - protein, 157 aa, Saccharomyces cerevisiae
  source: /note="strain ATCC 204508 / S288c"
MSDEEHTFETADAGSSATYPMQCSALRKNGFVVIKSRPCKIVDMSTSKTGKHGHAKVHLVAIDIFTGKKLEDLSPSTHNMEVPVVKRNEYQLLDIDDGFLSLMNMDGDTKDDVKAPEGELGDSLQTAFDEGKDLMVTIISAMGEEAAISFKEAARTD

SEQ ID NO: 1304 - protein, 221 aa, Saccharomyces cerevisiae
  source: /note="strain ATCC 204508 / S288c"
MARRPARCYRYQKNKPYPKSRYNRAVPDSKIRIYDLGKKKATVDEFPLCVHLVSNELEQLSSEALEAARICANKYMTTVSGRDAFHLRVRVHPFHVLRINKMLSCAGADRLQQGMRGAWGKPHGLAARVDIGQIIFSVRTKDSNKDVVVEGLRRARYKFPGQQKIILSKKWGFTNLDRPEYLKKREAGEVKDDGAFVKFLSKKGSLENNIREFPEYFAAQA

SEQ ID NO: 1305 - protein, 348 aa, Saccharomyces cerevisiae
  source: /note="strain ATCC 204508 / S288c"
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 1306 - protein, 395 aa, Saccharomyces cerevisiae
  source: /note="strain ATCC 204508 / S288c"
MSEGITDIEESQIQTNYDKVVYKFDDMELDENLLRGVFGYGFEEPSAIQQRAIMPIIEGHDVLAQAQSGTGKTGTFSIAALQRIDTSVKAPQALMLAPTRELALQIQKVVMALAFHMDIKVHACIGGTSFVEDAEGLRDAQIVVGTPGRVFDNIQRRRFRTDKIKMFILDEADEMLSSGFKEQIYQIFTLLPPTTQVVLLSATMPNDVLEVTTKFMRNPVRILVKKDELTLEGIKQFYVNVEEEEYKYECLTDLYDSISVTQAVIFCNTRRKVEELTTKLRNDKFTVSAIYSDLPQQERDTIMKEFRSGSSRILISTDLLARGIDVQQVSLVINYDLPANKENYIHRIGRGGRFGRKGVAINFVTNEDVGAMRELEKFYSTQIEELPSDIATLLN

SEQ ID NO: 1307 - protein, 430 aa, Saccharomyces cerevisiae
  source: /note="strain ATCC 204508 / S288c"
MGLFDKVKQFANSNNNNNDSGNNNQGDYVTKAENMIGEDRVNQFKSKIGEDRFDKMESKVRQQFSNTSINDNDSNNNDSYGSNNNDSYGSNNNDSYGSNNNDSYGSNNNDSYGSNNDDSYGSSNKKKSSYGSNNDDSYGSSNNNDSYGSNNNDSYGSNNNDSYGSNNDDSYGSSNKNKSSYGSNNDDSYGSNNDDSYGSSNKKKSSYGSSNNDSYGSNNDDSYGSNNNDSYGSNNDDSYGSSNKKKSSYGSNNDDSYGSSNNNDSYGSNNDDSYGSSNKNKSSYGSSSNDDSYGSSNNDDSYGSSNKKKSSYGSNNDDSYGSNNDDSYGSSNKKKSSYGSSNNDSYGSNNDDSYGSSNKKKSSYGSNNDDSYGSSNNNDSYGSNNDDSYGSSNRNKNSYGSSNYGSSNNDDSYGSSNRGGRNQYGGDDDY

SEQ ID NO: 1308 - protein, 437 aa, Saccharomyces cerevisiae
  source: /note="strain ATCC 204508 / S288c"
MPKKVWKSSTPSTYEHISSLRPKFVSRVDNVLHQRKSLTFSNVVVPDKKNNTLTSSVIYSQGSDIYEIDFAVPLQEAASEPVKDYGDAFEGIENTSLSPKFVYQGETVSKMAYLDKTGETTLLSMSKNGSLAWFKEGIKVPIHIVQELMGPATSYASIHSLTRPGDLPEKDFSLAISDFGISNDTETIVKSQSNGDEEDSILKIIDNAGKPGEILRTVHVPGTTVTHTVRFFDNHIFASCSDDNILRFWDTRTSDKPIWVLGEPKNGKLTSFDCSQVSNNLFVTGFSTGIIKLWDARAAEAATTDLTYRQNGEDPIQNEIANFYHAGGDSVVDVQFSATSSSEFFTVGGTGNIYHWNTDYSLSKYNPDDTIAPPQDATEESQTKSLRFLHKGGSRRSPKQIGRRNTAAWHPVIENLVGTVDDDSLVSIYKPYTEESE

SEQ ID NO: 1309 - protein, 440 aa, Saccharomyces cerevisiae
  source: /note="strain ATCC 204508 / S288c"
MSENNEFQSVTESTTAPTTSNPYGPNPADYLSNVKNFQLIDSTLREGEQFANAFFDTEKKIEIARALDDFGVDYIELTSPVASEQSRKDCEAICKLGLKAKILTHIRCHMDDARVAVETGVDGVDVVIGTSKFLRQYSHGKDMNYIAKSAVEVIEFVKSKGIEIRFSSEDSFRSDLVDLLNIYKTVDKIGVNRVGIADTVGCANPRQVYELIRTLKSVVSCDIECHFHNDTGCAIANAYTALEGGARLIDVSVLGIGERNGITPLGGLMARMIVAAPDYVRSKYKLHKIRDIENLVADAVEVNIPFNNPITGFCAFTHKAGIHAKAILANPSTYEILDPHDFGMKRYIHFANRLTGWNAIKSRVDQLNLNLTDDQIKEVTAKIKKLGDVRPLNIDDVDSIIKDFHAELSTPLLKPVNKGTDDDNIDISNGHVSKKAKVTK

SEQ ID NO: 1310 - protein, 454 aa, Saccharomyces cerevisiae
  source: /note="strain ATCC 204508 / S288c"
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 1311 - protein, 469 aa, Saccharomyces cerevisiae
  source: /note="strain ATCC 204508 / S288c"
MPYTLSDAHHKLITSHLVDTDPEVDSIIKDEIERQKHSIDLIASENFTSTSVFDALGTPLSNKYSEGYPGARYYGGNEHIDRMEILCQQRALKAFHVTPDKWGVNVQTLSGSPANLQVYQAIMKPHERLMGLYLPDGGHLSHGYATENRKISAVSTYFESFPYRVNPETGIIDYDTLEKNAILYRPKVLVAGTSAYCRLIDYKRMREIADKCGAYLMVDMAHISGLIAAGVIPSPFEYADIVTTTTHKSLRGPRGAMIFFRRGVRSINPKTGKEVLYDLENPINFSVFPGHQGGPHNHTIAALATALKQAATPEFKEYQTQVLKNAKALESEFKNLGYRLVSNGTDSHMVLVSLREKGVDGARVEYICEKINIALNKNSIPGDKSALVPGGVRIGAPAMTTRGMGEEDFHRIVQYINKAVEFAQQVQQSLPKDACRLKDFKAKVDEGSDVLNTWKKEIYDWAGEYPLAV

SEQ ID NO: 1312 - protein, 479 aa, Saccharomyces cerevisiae
  source: /note="strain ATCC 204508 / S288c"
MSAILSTTSKSFLSRGSTRQCQNMQKALFALLNARHYSSASEQTLKERFAEIIPAKAEEIKKFKKEHGKTVIGEVLLEQAYGGMRGIKGLVWEGSVLDPEEGIRFRGRTIPEIQRELPKAEGSTEPLPEALFWLLLTGEIPTDAQVKALSADLAARSEIPEHVIQLLDSLPKDLHPMAQFSIAVTALESESKFAKAYAQGVSKKEYWSYTFEDSLDLLGKLPVIASKIYRNVFKDGKITSTDPNADYGKNLAQLLGYENKDFIDLMRLYLTIHSDHEGGNVSAHTTHLVGSALSSPYLSLAAGLNGLAGPLHGRANQEVLEWLFKLREEVKGDYSKETIEKYLWDTLNAGRVVPGYGHAVLRKTDPRYTAQREFALKHFPDYELFKLVSTIYEVAPGVLTKHGKTKNPWPNVDSHSGVLLQYYGLTEASFYTVLFGVARAIGVLPQLIIDRAVGAPIERPKSFSTEKYKELVKKIESKN

SEQ ID NO: 1313 - protein, 489 aa, Saccharomyces cerevisiae
  source: /note="strain ATCC 204508 / S288c"
MSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 1314 - protein, 563 aa, Saccharomyces cerevisiae
  source: /note="strain ATCC 204508 / S288c"
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVIRLIELKLPVFDAPESLIKQAQLTAATNAKQ

SEQ ID NO: 1315 - protein, 681 aa, Saccharomyces cerevisiae
  source: /note="strain ATCC 204508 / S288c"
MAQFSDIDKLAVSTLRLLSVDQVESAQSGHPGAPLGLAPVAHVIFKQLRCNPNNEHWINRDRFVLSNGHSCALLYSMLHLLGYDYSIEDLRQFRQVNSRTPGHPEFHSAGVEITSGPLGQGISNAVGMAIAQANFAATYNEDGFPISDSYTFAIVGDGCLQEGVSSETSSLAGHLQLGNLITFYDSNSISIDGKTSYSFDEDVLKRYEAYGWEVMEVDKGDDDMESISSALEKAKLSKDKPTIIKVTTTIGFGSLQQGTAGVHGSALKADDVKQLKKRWGFDPNKSFVVPQEVYDYYKKTVVEPGQKLNEEWDRMFEEYKTKFPEKGKELQRRLNGELPEGWEKHLPKFTPDDDALATRKTSQQVLTNMVQVLPELIGGSADLTPSNLTRWEGAVDFQPPITQLGNYAGRYIRYGVREHGMGAIMNGISAFGANYKPYGGTFLNFVSYAAGAVRLAALSGNPVIWVATHDSIGLGEDGPTHQPIETLAHLRAIPNMHVWRPADGNETSAAYYSAIKSGRTPSVVALSRQNLPQLEHSSFEKALKGGYVIHDVENPDIILVSTGSEVSISIDAAKKLYDTKKIKARVVSLPDFYTFDRQSEEYRFSVLPDGVPIMSFEVLATSSWGKYAHQSFGLDEFGRSGKGPEIYKLFDFTADGVASRAEKTINYYKGKQLLSPMGRAF

SEQ ID NO: 1316 - protein, 2051 aa, Saccharomyces cerevisiae
  source: /note="strain ATCC 204508 / S288c"
MDAYSTRPLTLSHGSLEHVLLVPTASFFIASQLQEQFNKILPEPTEGFAADDEPTTPAELVGKFLGYVSSLVEPSKVGQFDQVLNLCLTEFENCYLEGNDIHALAAKLLQENDTTLVKTKELIKNYITARIMAKRPFDKKSNSALFRAVGEGNAQLVAIFGGQGNTDDYFEELRDLYQTYHVLVGDLIKFSAETLSELIRTTLDAEKVFTQGLNILEWLENPSNTPDKDYLLSIPISCPLIGVIQLAHYVVTAKLLGFTPGELRSYLKGATGHSQGLVTAVAIAETDSWESFFVSVRKAITVLFFIGVRCYEAYPNTSLPPSILEDSLENNEGVPSPMLSISNLTQEQVQDYVNKTNSHLPAGKQVEISLVNGAKNLVVSGPPQSLYGLNLTLRKAKAPSGLDQSRIPFSERKLKFSNRFLPVASPFHSHLLVPASDLINKDLVKNNVSFNAKDIQIPVYDTFDGSDLRVLSGSISERIVDCIIRLPVKWETTTQFKATHILDFGPGGASGLGVLTHRNKDGTGVRVIVAGTLDINPDDDYGFKQEIFDVTSNGLKKNPNWLEEYHPKLIKNKSGKIFVETKFSKLIGRPPLLVPGMTPCTVSPDFVAATTNAGYTIELAGGGYFSAAGMTAAIDSVVSQIEKGSTFGINLIYVNPFMLQWGIPLIKELRSKGYPIQFLTIGAGVPSLEVASEYIETLGLKYLGLKPGSIDAISQVINIAKAHPNFPIALQWTGGRGGGHHSFEDAHTPMLQMYSKIRRHPNIMLIFGSGFGSADDTYPYLTGEWSTKFDYPPMPFDGFLFGSRVMIAKEVKTSPDAKKCIAACTGVPDDKWEQTYKKPTGGIVTVRSEMGEPIHKIATRGVMLWKEFDETIFNLPKNKLVPTLEAKRDYIISRLNADFQKPWFATVNGQARDLATMTYEEVAKRLVELMFIRSTNSWFDVTWRTFTGDFLRRVEERFTKSKTLSLIQSYSLLDKPDEAIEKVFNAYPAAREQFLNAQDIDHFLSMCQNPMQKPVPFVPVLDRRFEIFFKKDSLWQSEHLEAVVDQDVQRTCILHGPVAAQFTKVIDEPIKSIMDGIHDGHIKKLLHQYYGDDESKIPAVEYFGGESPVDVQSQVDSSSVSEDSAVFKATSSTDEESWFKALAGSEINWRHASFLCSFITQDKMFVSNPIRKVFKPSQGMVVEISNGNTSSKTVVTLSEPVQGELKPTVILKLLKENIIQMEMIENRTMDGKPVSLPLLYNFNPDNGFAPISEVMEDRNQRIKEMYWKLWIDEPFNLDFDPRDVIKGKDFEITAKEVYDFTHAVGNNCEDFVSRPDRTMLAPMDFAIVVGWRAIIKAIFPNTVDGDLLKLVHLSNGYKMIPGAKPLQVGDVVSTTAVIESVVNQPTGKIVDVVGTLSRNGKPVMEVTSSFFYRGNYTDFENTFQKTVEPVYQMHIKTSKDIAVLRSKEWFQLDDEDFDLLNKTLTFETETEVTFKNANIFSSVKCFGPIKVELPTKETVEIGIVDYEAGASHGNPVVDFLKRNGSTLEQKVNLENPIPIAVLDSYTPSTNEPYARVSGDLNPIHVSRHFASYANLPGTITHGMFSSASVRALIENWAADSVSSRVRGYTCQFVDMVLPNTALKTSIQHVGMINGRKLIKFETRNEDDVVVLTGEAEIEQPVTTFVFTGQGSQEQGMGMDLYKTSKAAQDVWNRADNHFKDTYGFSILDIVINNPVNLTIHFGGEKGKRIRENYSAMIFETIVDGKLKTEKIFKEINEHSTSYTFRSEKGLLSATQFTQPALTLMEKAAFEDLKSKGLIPADATFAGHSLGEYAALASLADVMSIESLVEVVFYRGMTMQVAVPRDELGRSNYGMIAINPGRVAASFSQEALQYVVERVGKRTGWLVEIVNYNVENQQYVAAGDLRALDTVTNVLNFIKLQKIDIIELQKSLSLEEVEGHLFEIIDEASKKSAVKPRPLKLERGFACIPLVGISVPFHSTYLMNGVKPFKSFLKKNIIKENVKVARLAGKYIPNLTAKPFQVTKEYFQDVYDLTGSEPIKEIIDNWEKYEQS

SEQ ID NO: 1317 - protein, 156 aa, Saccharomyces cerevisiae
  source: /note="strain ATCC 204508 / S288c"
MSTELTVQSERAFQKQPHIFNNPKVKTSKRTKRWYKNAGLGFKTPKTAIEGSYIDKKCPFTGLVSIRGKILTGTVVSTKMHRTIVIRRAYLHYIPKYNRYEKRHKNVPVHVSPAFRVQVGDIVTVGQCRPISKTVRFNVVKVSAAAGKANKQFAKF

SEQ ID NO: 1318 - protein, 214 aa, Saccharomyces cerevisiae
  source: /note="strain ATCC 204508 / S288c"
MSFNSPFFDFFDNINNEVDAFNRLLGEGGLRGYAPRRQLANTPAKDSTGKEVARPNNYAGALYDPRDETLDDWFDNDLSLFPSGFGFPRSVAVPVDILDHDNNYELKVVVPGVKSKKDIDIEYHQNKNQILVSGEIPSTLNEESKDKVKVKESSSGKFKRVITLPDYPGVDADNIKADYANGVLTLTVPKLKPQKDGKNHVKKIEVSSQESWGN

SEQ ID NO: 1319 - protein, 225 aa, Saccharomyces cerevisiae
  source: /note="strain ATCC 204508 / S288c"
MSDTEAPVEVQEDFEVVEEFTPVVLATPIPEEVQQAQTEIKLFNKWSFEEVEVKDASLVDYVQVRQPIFVAHTAGRYANKRFRKAQCPIIERLTNSLMMNGRNNGKKLKAVRIIKHTLDIINVLTDQNPIQVVVDAITNTGPREDTTRVGGGGAARRQAVDVSPLRRVNQAIALLTIGAREAAFRNIKTIAETLAEELINAAKGSSTSYAIKKKDELERVAKSNR

SEQ ID NO: 1320 - protein, 219 aa, Saccharomyces cerevisiae
  source: /note="strain ATCC 204508 / S288c"
MSNEIELLQKQVSELQDLVKKQSLIISKTGERVLELQLDKQKHDVTDFDSKFSKSISKKSGSATQFDATDFATNEDLVELVKELQGELNFIEERSIRRLVNSLKKDDDDVIAPLPNADGDIPAISDGVFPKSLKEFKDIPDLKLVRLAKFYERLPPTLKEQEDFENFLEGKVEAFHINETTDEEISKELEKFSKDELDDAFNDVARYLGLSLRRGTEIW

SEQ ID NO: 1321 - protein, 255 aa, Saccharomyces cerevisiae
  source: /note="strain ATCC 204508 / S288c"
MAVGKNKRLSKGKKGQKKRVVDPFTRKEWFDIKAPSTFENRNVGKTLVNKSTGLKSASDALKGRVVEVCLADLQGSEDHSFRKIKLRVDEVQGKNLLTNFHGMDFTTDKLRSMVRKWQTLIEANVTVKTSDDYVLRIFAIAFTRKQANQVKRHSYAQSSHIRAIRKVISEILTKEVQGSTLAQLTSKLIPEVINKEIENATKDIFPLQNIHVRKVKLLKQPKFDVGALMALHGEGSGEEKGKKVTGFKDEVLETV

SEQ ID NO: 1322 - protein, 255 aa, Saccharomyces cerevisiae
  source: /note="strain ATCC 204508 / S288c"
MAVGKNKRLSRGKKGLKKKVVDPFTRKEWFDIKAPSTFENRNVGKTLVNKSTGLKNASDALKGRVVEVCLADLQGSEDHSFRKVKLRVDEVQGKNLLTNFHGMDFTTDKLRSMVRKWQTLIEANVTVKTSDDYVLRIFAIAFTRKQANQVKRHSYAQSSHIRAIRKVISEILTREVQNSTLAQLTSKLIPEVINKEIENATKDIFPLQNIHVRKVKLLKQPKFDVGALMALHGEGSGEEKGKKVSGFKDEVLETV

SEQ ID NO: 1323 - protein, 319 aa, Saccharomyces cerevisiae
  source: /note="strain ATCC 204508 / S288c"
MASNEVLVLRGTLEGHNGWVTSLATSAGQPNLLLSASRDKTLISWKLTGDDQKFGVPVRSFKGHSHIVQDCTLTADGAYALSASWDKTLRLWDVATGETYQRFVGHKSDVMSVDIDKKASMIISGSRDKTIKVWTIKGQCLATLLGHNDWVSQVRVVPNEKADDDSVTIISAGNDKMVKAWNLNQFQIEADFIGHNSNINTLTASPDGTLIASAGKDGEIMLWNLAAKKAMYTLSAQDEVFSLAFSPNRYWLAAATATGIKVFSLDPQYLVDDLRPEFAGYSKAAEPHAVSLAWSADGQTLFAGYTDNVIRVWQVMTAN

SEQ ID NO: 1324 - protein, 335 aa, Saccharomyces cerevisiae
  source: /note="strain ATCC 204508 / S288c"
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 1325 - protein, 654 aa, Saccharomyces cerevisiae
  source: /note="strain ATCC 204508 / S288c"
MLAAKNILNRSSLSSSFRIATRLQSTKVQGSVIGIDLGTTNSAVAIMEGKVPKIIENAEGSRTTPSVVAFTKEGERLVGIPAKRQAVVNPENTLFATKRLIGRRFEDAEVQRDIKQVPYKIVKHSNGDAWVEARGQTYSPAQIGGFVLNKMKETAEAYLGKPVKNAVVTVPAYFNDSQRQATKDAGQIVGLNVLRVVNEPTAAALAYGLEKSDSKVVAVFDLGGGTFDISILDIDNGVFEVKSTNGDTHLGGEDFDIYLLREIVSRFKTETGIDLENDRMAIQRIREAAEKAKIELSSTVSTEINLPFITADASGPKHINMKFSRAQFETLTAPLVKRTVDPVKKALKDAGLSTSDISEVLLVGGMSRMPKVVETVKSLFGKDPSKAVNPDEAVAIGAAVQGAVLSGEVTDVLLLDVTPLSLGIETLGGVFTRLIPRNTTIPTKKSQIFSTAAAGQTSVEIRVFQGERELVRDNKLIGNFTLAGIPPAPKGVPQIEVTFDIDADGIINVSARDKATNKDSSITVAGSSGLSENEIEQMVNDAEKFKSQDEARKQAIETANKADQLANDTENSLKEFEGKVDKAEAQKVRDQITSLKELVARVQGGEEVNAEELKTKTEELQTSSMKLFEQLYKNDSNNNNNNNGNNAESGETKQ

SEQ ID NO: 1326 - protein, 896 aa, Saccharomyces cerevisiae
  source: /note="strain ATCC 204508 / S288c"
MTTTAQDNSPKKRQRIINCVTQLPYKIQLGESNDDWKISATTGNSALFSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSNDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 1327 - protein, 176 aa, Saccharomyces cerevisiae
  source: /note="strain ATCC 204508 / S288c"
MSAQKAPKWYPSEDVAALKKTRKAARPQKLRASLVPGTVLILLAGRFRGKRVVYLKHLEDNTLLISGPFKVNGVPLRRVNARYVIATSTKVSVEGVNVEKFNVEYFAKEKLTKKEKKEANLFPEQQNKEIKAERVEDQKVVDKALIAEIKKTPLLKQYLSASFSLKNGDKPHMLKF

SEQ ID NO: 1328 - protein, 254 aa, Saccharomyces cerevisiae [sequence omitted]

SEQ ID NO: 1329 - protein, 240 aa, Saccharomyces cerevisiae
  source: /note="strain ATCC 204508 / S288c"
MVALISKKRKLVADGVFYAELNEFFTRELAEEGYSGVEVRVTPTKTEVIIRATRTQDVLGENGRRINELTLLVQKRFKYAPGTIVLYAERVQDRGLSAVAQAESMKFKLLNGLAIRRAAYGVVRYVMESGAKGCEVVVSGKLRAARAKAMKFADGFLIHSGQPVNDFIDTATRHVLMRQGVLGIKVKIMRDPAKSRTGPKALPDAVTIIEPKEEEPILAPSVKDYRPAEETEAQAEPVEA

SEQ ID NO: 1330 - protein, 312 aa, Saccharomyces cerevisiae
  source: /note="strain ATCC 204508 / S288c"
MGGIREKKAEYFAKLREYLEEYKSLFVVGVDNVSSQQMHEVRKELRGRAVVLMGKNTMVRRAIRGFLSDLPDFEKLLPFVKGNVGFVFTNEPLTEIKNVIVSNRVAAPARAGAVAPEDIWVRAVNTGMEPGKTSFFQALGVPTKIARGTIEIVSDVKVVDAGNKVGQSEASLLNLLNISPFTFGLTVVQVYDNGQVFPSSILDITDEELVSHFVSAVSTIASISLAIGYPTLPSVGHTLINNYKDLLAVAIAASYHYPEIEDLVDRIENPEKYAAAAPAATSAASGDAAPAEEAAAEEEEESDDDMGFGLFD

SEQ ID NO: 1331 - protein, 592 aa, Saccharomyces cerevisiae
  source: /note="strain ATCC 204508 / S288c"
MANYTKTAILSVYDKTGLLDLARGLIEKNVRILASGGTARMIRDAGFPIEDVSAITHAPEMLGGRVKTLHPAVHGGILARDIDSDEKDLKEQHIEKVDYVVCNLYPFKETVAKVGVTIPEAVEEIDIGGVTLLRAAAKNHARVTILSDPKDYSEFLSELSSNGEISQDLRNRLALKAFEHTADYDAAISDFFRKQYSEGQAQITLRYGANPHQKPAQAYVSQQDSLPFKVLCGSPGYINLLDALNSWPLVKELSASLNLPAAASFKHVSPAGAAVGIPLSDVEKQVYFVADIENLSPLACAYARARGADRMSSFGDWIALSNIVDVPTAKIISREVSDGVIAPGYEPEALAILSKKKGGKYCILQIDPNYVPEAVERRQVYGVTLEQKRNDAIINQSTFKEIVSQNKNLTEQAIIDLTVATIAIKYTQSNSVCYARNGMVVGLGAGQQSRIHCTRLAGDKADNWWFRQHPRVLEIKWAKGVKRPEKSNAIDLFVTGQIPTEEPELSEYQSKFEEIPKPFTPEERKEWLSKLTNVSLSSDAFFPFPDNVYRAVKSGVKYIAAPSGSVMDKVVFSAADSFDLVYVENPIRLFHH

SEQ ID NO: 1332 - protein, 87 aa, Saccharomyces cerevisiae
  source: /note="strain ATCC 204508 / S288c"
MENDKGQLVELYVPRKCSATNRIIKADDHASVQINVAKVDEEGRAIPGEYITYALSGYVRSRGESDDSLNRLAQNDGLLKNVWSYSR

SEQ ID NO: 1333 - protein, 136 aa, Saccharomyces cerevisiae
  source: /note="strain ATCC 204508 / S288c"
MAKFLKAGKVAVVVRGRYAGKKVVIVKPHDEGSKSHPFGHALVAGIERYPSKVTKKHGAKKVAKRTKIKPFIKVVNYNHLLPTRYTLDVEAFKSVVSTETFEQPSQREEAKKVVKKAFEERHQAGKNQWFFSKLRF

SEQ ID NO: 1334 - protein, 167 aa, Saccharomyces cerevisiae
  source: /note="strain ATCC 204508 / S288c"
MIIYKDIFSNDELLSDAYDAKLVDDVIYEADCAMVNVGGDNIDIGANPSAEGGDDDVEEGAEMVNNVVHSFRLQQTAFDKKSFLTYIKGYMKAVKAKLQETNPEEVPKFEKGAQTYVKKVIGSFKDWEFFTGESMDPDAMVVMLNYREDGTTPFVAIWKHGIVEEKI

SEQ ID NO: 1335 - protein, 199 aa, Saccharomyces cerevisiae
  source: /note="strain ATCC 204508 / S288c"
MAISKNLPILKNHFRKHWQERVKVHFDQAGKKVSRRNARATRAAKIAPRPLDLLRPVVRAPTVKYNRKVRAGRGFTLAEVKAAGLTAAYARTIGIAVDHRRQNRNQEIFDANVQRLKEYQSKIIVFPRNGKAPEAEQVLSAAATFPIAQPATDVEARAVQDNGESAFRTLRLARSEKKFRGIREKRAREKAEAEAEKKK

SEQ ID NO: 1336 - protein, 362 aa, Saccharomyces cerevisiae
  source: /note="strain ATCC 204508 / S288c"
MSRPQVTVHSLTGEATANALPLPAVFSAPIRPDIVHTVFTSVNKNKRQAYAVSEKAGHQTSAESWGTGRAVARIPRVGGGGTGRSGQGAFGNMCRGGRMFAPTKTWRKWNVKVNHNEKRYATASAIAATAVASLVLARGHRVEKIPEIPLVVSTDLESIQKTKEAVAALKAVGAHSDLLKVLKSKKLRAGKGKYRNRRWTQRRGPLVVYAEDNGIVKALRNVPGVETANVASLNLLQLAPGAHLGRFVIWTEAAFTKLDQVWGSETVASSKVGYTLPSHIISTSDVTRIINSSEIQSAIRPAGQATQKRTHVLKKNPLKNKQVLLRLNPYAKVFAAEKLGSKKAEKTGTKPAAVFTETLKHD

SEQ ID NO: 1337 - protein, 412 aa, Saccharomyces cerevisiae
  source: /note="strain ATCC 204508 / S288c"
MTKIKVANPIVEMDGDEQTRIIWHLIRDKLVLPYLDVDLKYYDLSVEYRDQTNDQVTVDSATATLKYGVAVKCATITPDEARVEEFHLKKMWKSPNGTIRNILGGTVFREPIIIPRIPRLVPQWEKPIIIGRHAFGDQYKATDVIVPEEGELRLVYKSKSGTHDVDLKVFDYPEHGGVAMMMYNTTDSIEGFAKASFELAIERKLPLYSTTKNTILKKYDGKFKDVFEAMYARSYKEKFESLGIWYEHRLIDDMVAQMLKSKGGYIIAMKNYDGDVESDIVAQGFGSLGLMTSVLITPDGKTFESEAAHGTVTRHFRQHQQGKETSTNSIASIFAWTRGIIQRGKLDNTPDVVKFGQILESATVNTVQEDGIMTKDLALILGKSERSAYVTTEEFIDAVESRLKKEFEAAAL

SEQ ID NO: 1338 - protein, 517 aa, Saccharomyces cerevisiae
  source: /note="strain ATCC 204508 / S288c"
MVLSDKELFAINKKAVEQGFNVKPRLNYNTVSGVNGPLVILEKVKFPRYNEIVNLTLPDGTVRQGQVLEIRGDRAIVQVFEGTSGIDVKKTTVEFTGESLRIPVSEDMLGRIFDGSGRPIDNGPKVFAEDYLDINGSPINPYARIYPEEMISTGVSAIDTMNSIARGQKIPIFSASGLPHNEIAAQICRQAGLVRPTKDVHDGHEENFSIVFAAMGVNLETARFFKQDFEENGSLERTSLFLNLANDPTIERIITPRLALTTAEYLAYQTERHVLTILTDMSSYADALREVSAAREEVPGRRGYPGYMYTDLSTIYERAGRVEGRNGSITQIPILTMPNDDITHPIPDLTGYITEGQIFVDRQLHNKGIYPPINVLPSLSRLMKSAIGEGMTRKDHGDVSNQLYAKYAIGKDAAAMKAVVGEEALSIEDKLSLEFLEKFEKTFITQGAYEDRTVFESLDQAWSLLRIYPKEMLNRISPKILDEFYDRARDDADEDEEDPDTRSSGKKKDASQEESLI

SEQ ID NO: 1339 - protein, 549 aa, Saccharomyces cerevisiae
  source: /note="strain ATCC 204508 / S288c"
MSPSKMNATVGSTSEVEQKIRQELALSDEVTTIRRNAPAAVLYEDGLKENKTVISSSGALIAYSGVKTGRSPKDKRIVEEPTSKDEIWWGPVNKPCSERTWSINRERAADYLRTRDHIYIVDAFAGWDPKYRIKVRVVCARAYHALFMTNMLIRPTEEELAHFGEPDFTVWNAGQFPANLHTQDMSSKSTIEINFKAMEMIILGTEYAGEMKKGIFTVMFYLMPVHHNVLTLHSSANQGIQNGDVTLFFGLSGTGKTTLSADPHRLLIGDDEHCWSDHGVFNIEGGCYAKCINLSAEKEPEIFDAIKFGSVLENVIYDEKSHVVDYDDSSITENTRCAYPIDYIPSAKIPCLADSHPKNIILLTCDASGVLPPVSKLTPEQVMYHFISGYTSKMAGTEQGVTEPEPTFSSCFGQPFLALHPIRYATMLATKMSQHKANAYLINTGWTGSSYVSGGKRCPLKYTRAILDSIHDGSLANETYETLPIFNLQVPTKVNGVPAELLNPAKNWSQGESKYRGAVTNLANLFVQNFKIYQDRATPDVLAAGPQFE

SEQ ID NO: 1340 - protein, 569 aa, Saccharomyces cerevisiae
  source: /note="strain ATCC 204508 / S288c"
MSFQIETVPTKPYEDQKPGTSGLRKKTKVFKDEPNYTENFIQSIMEAIPEGSKGATLVVGGDGRYYNDVILHKIAAIGAANGIKKLVIGQHGLLSTPAASHIMRTYEEKCTGGIILTASHNPGGPENDMGIKYNLSNGGPAPESVTNAIWEISKKLTSYKIIKDFPELDLGTIGKNKKYGPLLVDIIDITKDYVNFLKEIFDFDLIKKFIDNQRSTKNWKLLFDSMNGVTGPYGKAIFVDEFGLPADEVLQNWHPSPDFGGMHPDPNLTYASSLVKRVDREKIEFGAASDGDGDRNMIYGYGPSFVSPGDSVAIIAEYAAEIPYFAKQGIYGLARSFPTSGAIDRVAKAHGLNCYEVPTGWKFFCALFDAKKLSICGEESFGTGSNHVREKDGVWAIMAWLNILAIYNKHHPENEASIKTIQNEFWAKYGRTFFTRYDFEKVETEKANKIVDQLRAYVTKSGVVNSAFPADESLKVTDCGDFSYTDLDGSVSDHQGLYVKLSNGARFVLRLSGTGSSGATIRLYIEKYCDDKSQYQKTAEEYLKPIINSVIKFLNFKQVLGTEEPTVRT

SEQ ID NO: 1341 - protein, 680 aa, Saccharomyces cerevisiae
  source: /note="strain ATCC 204508 / S288c"
MTQFTDIDKLAVSTIRILAVDTVSKANSGHPGAPLGMAPAAHVLWSQMRMNPTNPDWINRDRFVLSNGHAVALLYSMLHLTGYDLSIEDLKQFRQLGSRTPGHPEFELPGVEVTTGPLGQGISNAVGMAMAQANLAATYNKPGFTLSDNYTYVFLGDGCLQEGISSEASSLAGHLKLGNLIAIYDDNKITIDGATSISFDEDVAKRYEAYGWEVLYVENGNEDLAGIAKAIAQAKLSKDKPTLIKMTTTIGYGSLHAGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLTPSNLTRWKEALDFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSRQNLPQLEGSSIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGASGKAPEVFKFFGFTPEGVAERAQKTIAFYKGDKLISPLKKAF

SEQ ID NO: 1342 - protein, 143 aa, Saccharomyces cerevisiae
  source: /note="strain ATCC 204508 / S288c"
MSAVPSVQTFGKKKSATAVAHVKAGKGLIKVNGSPITLVEPEILRFKVYEPLLLVGLDKFSNIDIRVRVTGGGHVSQVYAIRQAIAKGLVAYHQKYVDEQSKNELKKAFTSYDRTLLIADSRRPEPKKFGGKGARSRFQKSYR

SEQ ID NO: 1343 - protein, 152 aa, Saccharomyces cerevisiae
  source: /note="strain ATCC 204508 / S288c"
MQIFVKTLTGKTITLEVESSDTIDNVKSKIQDKEGIPPDQQRLIFAGKQLEDGRTLSDYNIQKESTLHLVLRLRGGGKKRKKKVYTTPKKIKHKHKKVKLAVLSYYKVDAEGKVTKLRRECSNPTCGAGVFLANHKDRLYCGKCHSVYKVNA

SEQ ID NO: 1344 - protein, 172 aa, Saccharomyces cerevisiae
  source: /note="strain ATCC 204508 / S288c"
MAHFKEYQVIGRRLPTESVPEPKLFRMRIFASNEVIAKSRYWYFLQKLHKVKKASGEIVSINQINEAHPTKVKNFGVWVRYDSRSGTHNMYKEIRDVSRVAAVETLYQDMAARHRARFRSIHILKVAEIEKTADVKRQYVKQFLTKDLKFPLPHRVQKSTKTFSYKRPSTFY

SEQ ID NO: 1345 - protein, 196 aa, Saccharomyces cerevisiae
  source: /note="strain ATCC 204508 / S288c"
MVAQVQKQAPTFKKTAVVDGVFDEVSLDKYKGKYVVLAFIPLAFTFVCPTEIIAFSEAAKKFEEQGAQVLFASTDSEYSLLAWTNIPRKEGGLGPINIPLLADTNHSLSRDYGVLIEEEGVALRGLFIIDPKGVIRHITINDLPVGRNVDEALRLVEAFQWTDKNGTVLPCNWTPGAATIKPTVEDSKEYFEAANK

SEQ ID NO: 1346 - protein, 254 aa, Saccharomyces cerevisiae
  source: /note="strain ATCC 204508 / S288c"
MGRVIRNQRKGAGSIFTSHTRLRQGAAKLRTLDYAERHGYIRGIVKQIVHDSGRGAPLAKVVFRDPYKYRLREEIFIANEGVHTGQFIYAGKKASLNVGNVLPLGSVPEGTIVSNVEEKPGDRGALARASGNYVIIIGHNPDENKTRVRLPSGAKKVISSDARGVIGVIAGGGRVDKPLLKAGRAFHKYRLKRNSWPKTRGVAMNPVDHPHGGGNHQHIGKASTISRGAVSGQKAGLIAARRTGLLRGSQKTQD

SEQ ID NO: 1347 - protein, 252 aa, Saccharomyces cerevisiae
  source: /note="strain ATCC 204508 / S288c"
MSLPATFDLTPEDAQLLLAANTHLGARNVQVHQEPYVFNARPDGVHVINVGKTWEKLVLAARIIAAIPNPEDVVAISSRTYGQRAVLKFAAHTGATPIAGRFTPGSFTNYITRSFKEPRLVIVTDPRLDAQAIKEASYVNIPVIALTDLDSPSEFVDVAIPCNNRGKHSIGLIWYLLAREVLRLRGALVDRTQPWSIMPDLYFYRNPEEVEQVAEEAAAAEEGEEEEVKEEVTEGQAEATEWAEENADNVEW

SEQ ID NO: 1348 - protein, 359 aa, Saccharomyces cerevisiae
  source: /note="strain ATCC 204508 / S288c"
MSTKVVNVAVIGAGVVGSAFLDQLLAMKSTITYNLVLLAEAERSLISKDFSPLNVGSDWKAALAASTTKTLPLDDLIAHLKTSPKPVILVDNTSSAYIAGFYTKFVENGISIATPNKKAFSSDLATWKALFSNKPTNGFVYHEATVGAGLPIISFLREIIQTGDEVEKIEGIFSGTLSYIFNEFSTSQANDVKFSDVVKVAKKLGYTEPDPRDDLNGLDVARKVTIVGRISGVEVESPTSFPVQSLIPKPLESVKSADEFLEKLSDYDKDLTQLKKEAATENKVLRFIGKVDVATKSVSVGIEKYDYSHPFASLKGSDNVISIKTKRYTNPVVIQGAGAGAAVTAAGVLGDVIKIAQRL

SEQ ID NO: 1349 - protein, 376 aa, Saccharomyces cerevisiae
  source: /note="strain ATCC 204508 / S288c"
MSASIPETMKAVVIENGKAVVKQDIPIPELEEGFVLIKTVAVAGNPTDWKHIDFKIGPQGALLGCDAAGQIVKLGPNVDAARFAIGDYIYGVIHGASVRFPSNGAFAEYSAISSETAYKPAREFRLCGKDKLPEGPVKSLEGAVSLPVSLTTAGMILTHSFGLDMTWKPSKAQRDQPILFWGGATAVGQMLIQLAKKLNGFSKIIVVASRKHEKLLKEYGADELFDYHDADVIEQIKKKYNNIPYLVDCVSNTETIQQVYKCAADDLDATVVQLTVLTEKDIKEEDRRQNVSIEGTLLYLIGGNDVPFGTFTLPADPEYKEAAIKFIKFINPKINDGEIHHIPVKVYKNGLDDIPQLLDDIKHGRNSGEKLVAVLK

SEQ ID NO: 1350 - protein, 384 aa, Saccharomyces cerevisiae
  source: /note="strain ATCC 204508 / S288c"
MSKSKTFLFTSESVGEGHPDKICDQVSDAILDACLEQDPFSKVACETAAKTGMIMVFGEITTKARLDYQQIVRDTIKKIGYDDSAKGFDYKTCNVLVAIEQQSPDIAQGLHYEKSLEDLGAGDQGIMFGYATDETPEGLPLTILLAHKLNMAMADARRDGSLPWLRPDTKTQVTVEYEDDNGRWVPKRIDTVVISAQHADEISTADLRTQLQKDIVEKVIPKDMLDENTKYFIQPSGRFVIGGPQGDAGLTGRKIIVDAYGGASSVGGGAFSGKDYSKVDRSAAYAARWVAKSLVAAGLCKRVQVQFSYAIGIAEPLSLHVDTYGTATKSDDEIIEIIKKNFDLRPGVLVKELDLARPIYLPTASYGHFTNQEYSWEKPKKLEF

SEQ ID NO: 1351 - protein, 395 aa, Saccharomyces cerevisiae
  source: /note="strain ATCC 204508 / S288c"
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 1352 - protein, 400 aa, Saccharomyces cerevisiae
  source: /note="strain ATCC 204508 / S288c"
MPFVKDFKPQALGDTNLFKPIKIGNNELLHRAVIPPLTRMRAQHPGNIPNRDWAVEYYAQRAQRPGTLIITEGTFPSPQSGGYDNAPGIWSEEQIKEWTKIFKAIHENKSFAWVQLWVLGWAAFPDTLARDGLRYDSASDNVYMNAEQEEKAKKANNPQHSITKDEIKQYVKEYVQAAKNSIAAGADGVEIHSANGYLLNQFLDPHSNNRTDEYGGSIENRARFTLEVVDAVVDAIGPEKVGLRLSPYGVFNSMSGGAETGIVAQYAYVLGELERRAKAGKRLAFVHLVEPRVTNPFLTEGEGEYNGGSNKFAYSIWKGPIIRAGNFALHPEVVREEVKDPRTLIGYGRFFISNPDLVDRLEKGLPLNKYDRDTFYKMSAEGYIDYPTYEEALKLGWDKN

SEQ ID NO: 1353 - protein, 449 aa, Saccharomyces cerevisiae
  source: /note="strain ATCC 204508 / S288c"
MSAPAQNYKIADISLAAFGRKEIELAEHEMPGLMAIRKAYGDVQPLKGARIAGCLHMTIQTAVLIETLVALGAEVTWSSCNIYSTQDHAAAAIAASGVPVFAWKGETEEEYLWCIEQQLFAFKDNKKLNLILDDGGDLTTLVHEKHPEMLEDCFGLSEETTTGVHHLYRMVKEGKLKVPAINVNDSVTKSKFDNLYGCRESLVDGIKRATDVMLAGKVAVVAGYGDVGKGCAAALRGMGARVLVTEIDPINALQAAMEGYQVVTMEDASHIGQVFVTTTGCRDIINGEHFINMPEDAIVCNIGHFDIEIDVAWLKANAKECINIKPQVDRYLLSSGRHVILLANGRLVNLGCATGHSSFVMSCSFSNQVLAQIALFKSNDKSFREKHIEFQKTGPFEVGVHVLPKILDEAVAKFHLGNLGVRLTKLSKVQSEYLGIPEEGPFKADHYRY

SEQ ID NO: 1354 - protein, 495 aa, Saccharomyces cerevisiae
  source: /note="strain ATCC 204508 / S288c"
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 1355 - protein, 522 aa, Saccharomyces cerevisiae
  source: /note="strain ATCC 204508 / S288c"
MKFSAGAVLSWSSLLLASSVFAQQEAVAPEDSAVVKLATDSFNEYIQSHDLVLAEFFAPWCGHCKNMAPEYVKAAETLVEKNITLAQIDCTENQDLCMEHNIPGFPSLKIFKNSDVNNSIDYEGPRTAEAIVQFMIKQSQPAVAVVADLPAYLANETFVTPVIVQSGKIDADFNATFYSMANKHFNDYDFVSAENADDDFKLSIYLPSAMDEPVVYNGKKADIADADVFEKWLQVEALPYFGEIDGSVFAQYVESGLPLGYLFYNDEEELEEYKPLFTELAKKNRGLMNFVSIDARKFGRHAGNLNMKEQFPLFAIHDMTEDLKYGLPQLSEEAFDELSDKIVLESKAIESLVKDFLKGDASPIVKSQEIFENQDSSVFQLVGKNHDEIVNDPKKDVLVLYYAPWCGHCKRLAPTYQELADTYANATSDVLIAKLDHTENDVRGVVIEGYPTIVLYPGGKKSESVVYQGSRSLDSLFDFIKENGHFDVDGKALYEEAQEKAAEEADADAELADEEDAIHDEL

SEQ ID NO: 1356 - protein, 557 aa, Saccharomyces cerevisiae
  source: /note="strain ATCC 204508 / S288c"
MSQDENIVKAVEESAEPAQVILGEDGKPLSKKALKKLQKEQEKQRKKEERALQLEAEREAREKKAAAEDTAKDNYGKLPLIQSRDSDRTGQKRVKFVDLDEAKDSDKEVLFRARVHNTRQQGATLAFLTLRQQASLIQGLVKANKEGTISKNMVKWAGSLNLESIVLVRGIVKKVDEPIKSATVQNLEIHITKIYTISETPEALPILLEDASRSEAEAEAAGLPVVNLDTRLDYRVIDLRTVTNQAIFRIQAGVCELFREYLATKKFTEVHTPKLLGAPSEGGSSVFEVTYFKGKAYLAQSPQFNKQQLIVADFERVYEIGPVFRAENSNTHRHMTEFTGLDMEMAFEEHYHEVLDTLSELFVFIFSELPKRFAHEIELVRKQYPVEEFKLPKDGKMVRLTYKEGIEMLRAAGKEIGDFEDLSTENEKFLGKLVRDKYDTDFYILDKFPLEIRPFYTMPDPANPKYSNSYDFFMRGEEILSGAQRIHDHALLQERMKAHGLSPEDPGLKDYCDGFSYGCPPHAGGGIGLERVVMFYLDLKNIRRASLFPRDPKRLRP

SEQ ID NO: 1357 - protein, 143 aa, Saccharomyces cerevisiae; identical to SEQ ID NO: 620
  source: /note="strain ATCC 204508 / S288c"

SEQ ID NO: 1358 - protein, 162 aa, Saccharomyces cerevisiae
  source: /note="strain ATCC 204508 / S288c"
MSQVYFDVEADGQPIGRVVFKLYNDIVPKTAENFRALCTGEKGFGYAGSPFHRVIPDFMLQGGDFTAGNGTGGKSIYGGKFPDENFKKHHDRPGLLSMANAGPNTNGSQFFITTVPCPWLDGKHVVFGEVVDGYDIVKKVESLGSPSGATKARIVVAKSGEL

SEQ ID NO: 1359 - protein, 189 aa, Saccharomyces cerevisiae
  source: /note="strain ATCC 204508 / S288c"
MANLRTQKRLAASVVGVGKRKVWLDPNETSEIAQANSRNAIRKLVKNGTIVKKAVTVHSKSRTRAHAQSKREGRHSGYGKRKGTREARLPSQVVWIRRLRVLRRLLAKYRDAGKIDKHLYHVLYKESKGNAFKHKRALVEHIIQAKADAQREKALNEEAEARRLKNRAARDRRAQRVAEKRDALLKEDA

SEQ ID NO: 1360 - protein, 200 aa, Saccharomyces cerevisiae
  source: /note="strain ATCC 204508 / S288c"
MGISRDSRHKRSATGAKRAQFRKKRKFELGRQPANTKIGAKRIHSVRTRGGNKKYRALRIETGNFSWASEGISKKTRIAGVVYHPSNNELVRTNTLTKAAIVQIDATPFRQWFEAHYGQTLGKKKNVKEEETVAKSKNAERKWAARAASAKIESSVESQFSAGRLYACISSRPGQSGRCDGYILEGEELAFYLRRLTAKK

SEQ ID NO: 1361 - protein, 190 aa, Saccharomyces cerevisiae
  source: /note="strain ATCC 204508 / S288c"
MSAPQAKILSQAPTELELQVAQAFVELENSSPELKAELRPLQFKSIREIDVAGGKKALAIFVPVPSLAGFHKVQTKLTRELEKKFQDRHVIFLAERRILPKPSRTSRQVQKRPRSRTLTAVHDKILEDLVFPTEIVGKRVRYLVGGNKIQKVLLDSKDVQQIDYKLESFQAVYNKLTGKQIVFEIPSETH

SEQ ID NO: 1362 - protein, 244 aa, Saccharomyces cerevisiae
  source: /note="strain ATCC 204508 / S288c"
MAAEKILTPESQLKKSKAQQKTAEQVAAERAARKAANKEKRAIILERNAAYQKEYETAERNIIQAKRDAKAAGSYYVEAQHKLVFVVRIKGINKIPPKPRKVLQLLRLTRINSGTFVKVTKATLELLKLIEPYVAYGYPSYSTIRQLVYKRGFGKINKQRVPLSDNAIIEANLGKYGILSIDDLIHEIITVGPHFKQANNFLWPFKLSNPSGGWGVPRKFKHFIQGGSFGNREEFINKLVKSMN

SEQ ID NO: 1363 - protein, 256 aa, Saccharomyces cerevisiae
  source: /note="strain ATCC 204508 / S288c"
MAPGKKVAPAPFGAKSTKSNKTRNPLTHSTPKNFGIGQAVQPKRNLSRYVKWPEYVRVQRQKKILSIRLKVPPTIAQFQYTLDRNTAAETFKLFNKYRPETAAEKKERLTKEAAAVAEGKSKQDASPKPYAVKYGLNHVVALIENKKAKLVLIANDVDPIELVVFLPALCKKMGVPYAIVKGKARLGTLVNQKTSAVAALTEVRAEDEAALAKLVSTIDANFADKYDEVKKHWGGGILGNKAQAKMDKRAKNSDSA

SEQ ID NO: 1364 - protein, 254 aa, Saccharomyces cerevisiae
  source: /note="strain ATCC 204508 / S288c"
MSIAEFAYKEKPETLVLFDVDGTLTPARLTVSEEVRKTLAKLRNKCCIGFVGGSDLSKQLEQLGPNVLDEFDYSFSENGLTAYRLGKELASQSFINWLGEEKYNKLAVFILRYLSEIDLPKRRGTFLEFRNGMINVSPIGRNASTEERNEFERYDKEHQIRAKFVEALKKEFPDYGLTFSIGGQISFDVFPAGWDKTYCLQHVEKDGFKEIHFFGDKTMVGGNDYEIFVDERTIGHSVQSPDDTVKILTELFNL

SEQ ID NO: 1365 - protein, 287 aa, Saccharomyces cerevisiae
  source: /note="strain ATCC 204508 / S288c"
MTYTTRQIGAKNTLEYKVYIEKDGKPVSAFHDIPLYADKENNIFNMVVEIPRWTNAKLEITKEETLNPIIQDTKKGKLRFVRNCFPHHGYIHNYGAFPQTWEDPNVSHPETKAVGDNDPIDVLEIGETIAYTGQVKQVKALGIMALLDEGETDWKVIAIDINDPLAPKLNDIEDVEKYFPGLLRATNEWFRIYKIPDGKPENQFAFSGEAKNKKYALDIIKETHDSWKQLIAGKSSDSKGIDLTNVTLPDTPTYSKAASDAIPPASPKADAPIDKSIDKWFFISGSV

SEQ ID NO: 1366 - protein, 318 aa, Saccharomyces cerevisiae
  source: /note="strain ATCC 204508 / S288c"
MSSNAQVKTPLPPAPAPKKESNFLIDFLMGGVSAAVAKTAASPIERVKLLIQNQDEMLKQGTLDRKYAGILDCFKRTATQEGVISFWRGNTANVIRYFPTQALNFAFKDKIKAMFGFKKEEGYAKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 1367 - protein, 297 aa, Saccharomyces cerevisiae
  source: /note="strain ATCC 204508 / S288c"
MAFQKDAKSSAYSSRFQTPFRRRREGKTDYYQRKRLVTQHKAKYNTPKYRLVVRFTNKDIICQIISSTITGDVVLAAAYSHELPRYGITHGLTNWAAAYATGLLIARRTLQKLGLDETYKGVEEVEGEYELTEAVEDGPRPFKVFLDIGLQRTTTGARVFGALKGASDGGLYVPHSENRFPGWDFETEEIDPELLRSYIFGGHVSQYMEELADDDEERFSELFKGYLADDIDADSLEDIYTSAHEAIRADPAFKPTEKKFTKEQYAAESKKYRQTKLSKEERAARVAAKIAALAGQQ

SEQ ID NO: 1368 - protein, 334 aa, Saccharomyces cerevisiae
  source: /note="strain ATCC 204508 / S288c"
MLSRVAKRAFSSTVANPYKVTVLGAGGGIGQPLSLLLKLNHKVTDLRLYDLKGAKGVATDLSHIPTNSVVKGFTPEEPDGLNNALKDTDMVLIPAGVPRKPGMTRDDLFAINASIVRDLAAATAESAPNAAILVISNPVNSTVPIVAQVLKNKGVYNPKKLFGVTTLDSIRAARFISEVENTDPTQERVNVIGGHSGITIIPLISQTNHKLMSDDKRHELIHRIQFGGDEVVKAKNGAGSATLSMAHAGAKFANAVLSGFKGERDVIEPSFVDSPLFKSEGIEFFASPVTLGPDGIEKIHPIGELSSEEEEMLQKCKETLKKNIEKGVNFVASK

SEQ ID NO: 1369 - protein, 368 aa, Saccharomyces cerevisiae
  source: /note="strain ATCC 204508 / S288c"
MLSAARLQFAQGSVRRLTVSARDAPTKISTLAVKVHGGSRYATKDGVAHLLNRFNFQNTNTRSALKLVRESELLGGTFKSTLDREYITLKATFLKDDLPYYVNALADVLYKTAFKPHELTESVLPAARYDYAVAEQCPVKSAEDQLYAITFRKGLGNPLLYDGVERVSLQDIKDFADKVYTKENLEVSGENVVEADLKRFVDESLLSTLPAGKSLVSKSEPKFFLGEENRVRFIGDSVAAIGIPVNKASLAQYEVLANYLTSALSELSGLISSAKLDKFTDGGLFTLFVRDQDSAVVSSNIKKIVADLKKGKDLSPAINYTKLKNAVQNESVSSPIELNFDAVKDFKLGKFNYVAVGDVSNLPYLDEL

SEQ ID NO: 1370 - protein, 394 aa, Saccharomyces cerevisiae
  source: /note="strain ATCC 204508 / S288c"
MTLQESDKFATKAIHAGEHVDVHGSVIEPISLSTTFKQSSPANPIGTYEYSRSQNPNRENLERAVAALENAQYGLAFSSGSATTATILQSLPQGSHAVSIGDVYGGTHRYFTKVANAHGVETSFTNDLLNDLPQLIKENTKLVWIETPTNPTLKVTDIQKVADLIKKHAAGQDVILVVDNTFLSPYISNPLNFGADIVVHSATKYINGHSDVVLGVLATNNKPLYERLQFLQNAIGAIPSPFDAWLTHRGLKTLHLRVRQAALSANKIAEFLAADKENVVAVNYPGLKTHPNYDVVLKQHRDALGGGMISFRIKGGAEAASKFASSTRLFTLAESLGGIESLLEVPAVMTHGGIPKEAREASGVFDDLVRISVGIEDTDDLLEDIKQALKQATN

SEQ ID NO: 1371 - protein, 446 aa, Saccharomyces cerevisiae
  source: /note="strain ATCC 204508 / S288c"
MGKNVLLLGSGFVAQPVIDTLAANDDINVTVACRTLANAQALAKPSGSKAISLDVTDDSALDKVLADNDVVISLIPYTFHPNVVKSAIRTKTDVVTSSYISPALRELEPEIVKAGITVMNEIGLDPGIDHLYAVKTIDEVHRAGGKLKSFLSYCGGLPAPEDSDNPLGYKFSWSSRGVLLALRNSAKYWKDGKIETVSSEDLMATAKPYFIYPGYAFVCYPNRDSTLFKDLYHIPEAETVIRGTLRYQGFPEFVKALVDMGMLKDDANEIFSKPIAWNEALKQYLGAKSTSKEDLIASIDSKATWKDDEDRERILSGFAWLGLFSDAKITPRGNALDTLCARLEELMQYEDNERDMVVLQHKFGIEWADGTTETRTSTLVDYGKVGGYSSMAATVGYPVAIATKFVLDGTIKGPGLLAPYSPEINDPIMKELKDKYGIYLKEKTVA

SEQ ID NO: 1372 - protein, 457 aa, Saccharomyces cerevisiae
  source: /note="strain ATCC 204508 / S288c"
MLRTVTSKTVSNQFKRSLATAVATPKAEVTQLSNGIVVATEHNPSAHTASVGVVFGSGAANENPYNNGVSNLWKNIFLSKENSAVAAKEGLALSSNISRDFQSYIVSSLPGSTDKSLDFLNQSFIQQKANLLSSSNFEATKKSVLKQVQDFEENDHPNRVLEHLHSTAFQNTPLSLPTRGTLESLENLVVADLESFANNHFLNSNAVVVGTGNIKHEDLVNSIESKNLSLQTGTKPVLKKKAAFLGSEVRLRDDTLPKAWISLAVEGEPVNSPNYFVAKLAAQIFGSYNAFEPASRLQGIKLLDNIQEYQLCDNFNHFSLSYKDSGLWGFSTATRNVTMIDDLIHFTLKQWNRLTISVTDTEVERAKSLLKLQLGQLYESGNPVNDANLLGAEVLIKGSKLSLGEAFKKIDAITVKDVKAWAGKRLWDQDIAIAGTGQIEGLLDYMRIRSDMSMMRW

SEQ ID NO: 1373 - protein, 492 aa, Saccharomyces cerevisiae
  source: /note="strain ATCC 204508 / S288c"
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 1374 - protein, 500 aa, Saccharomyces cerevisiae
  source: /note="strain ATCC 204508 / S288c"
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 1375 - protein, 499 aa, Saccharomyces cerevisiae
  source: /note="strain ATCC 204508 / S288c"
MSTKKHTKTHSTYAFESNTNSVAASQMRNALNKLADSSKLDDAARAKFENELDSFFTLFRRYLVEKSSRTTLEWDKIKSPNPDEVVKYEIISQQPENVSNLSKLAVLKLNGGLGTSMGCVGPKSVIEVREGNTFLDLSVRQIEYLNRQYDSDVPLLLMNSFNTDKDTEHLIKKYSANRIRIRSFNQSRFPRVYKDSLLPVPTEYDSPLDAWYPPGHGDLFESLHVSGELDALIAQGREILFVSNGDNLGATVDLKILNHMIETGAEYIMELTDKTRADVKGGTLISYDGQVRLLEVAQVPKEHIDEFKNIRKFTNFNTNNLWINLKAVKRLIESSNLEMEIIPNQKTITRDGHEINVLQLETACGAAIRHFDGAHGVVVPRSRFLPVKTCSDLLLVKSDLFRLEHGSLKLDPSRFGPNPLIKLGSHFKKVSGFNARIPHIPKIVELDHLTITGNVFLGKDVTLRGTVIIVCSDGHKIDIPNGSILENVVVTGNLQILEH

SEQ ID NO: 1376 - protein, 649 aa, Saccharomyces cerevisiae
  source: /note="strain ATCC 204508 / S288c"
MFSVTRRRAAGAAAAMATATGTLYWMTSQGDRPLVHNDPSYMVQFPTAAPPQVSRRDLLDRLAKTHQFDVLIIGGGATGTGCALDAATRGLNVALVEKGDFASGTSSKSTKMIHGGVRYLEKAFWEFSKAQLDLVIEALNERKHLINTAPHLCTVLPILIPIYSTWQVPYIYMGCKFYDFFAGSQNLKKSYLLSKSATVEKAPMLTTDNLKASLVYHDGSFNDSRLNATLAITAVENGATVLNYVEVQKLIKDPTSGKVIGAEARDVETNELVRINAKCVVNATGPYSDAILQMDRNPSGLPDSPLNDNSKIKSTFNQIAVMDPKMVIPSIGVHIVLPSFYCPKDMGLLDVRTSDGRVMFFLPWQGKVLAGTTDIPLKQVPENPMPTEADIQDILKELQHYIEFPVKREDVLSAWAGVRPLVRDPRTIPADGKKGSATQGVVRSHFLFTSDNGLITIAGGKWTTYRQMAEETVDKVVEVGGFHNLKPCHTRDIKLAGAEEWTQNYVALLAQNYHLSSKMSNYLVQNYGTRSSIICEFFKESMENKLPLSLADKENNVIYSSEENNLVNFDTFRYPFTIGELKYSMQYEYCRTPLDFLLRRTRFAFLDAKEALNAVHATVKVMGDEFNWSEKKRQWELEKTVNFIKTFGV

SEQ ID NO: 1377 - protein, 1887 aa, Saccharomyces cerevisiae
  source: /note="strain ATCC 204508 / S288c"
MKPEVEQELAHILLTELLAYQFASPVRWIETQDVFLKDFNTERVVEIGPSPTLAGMAQRTLKNKYESYDAALSLHREILCYSKDAKEIYYTPDPSELAAKEEPAKEEAPAPTPAASAPAPAAAAPAPVAAAAPAAAAAEIADEPVKASLLLHVLVAHKLKKSLDSIPMSKTIKDLVGGKSTVQNEILGDLGKEFGTTPEKPEETPLEELAETFQDTFSGALGKQSSSLLSRLISSKMPGGFTITVARKYLQTRWGLPSGRQDGVLLVALSNEPAARLGSEADAKAFLDSMAQKYASIVGVDLSSAASASGAAGAGAAAGAAMIDAGALEEITKDHKVLARQQLQVLARYLKMDLDNGERKFLKEKDTVAELQAQLDYLNAELGEFFVNGVATSFSRKKARTFDSSWNWAKQSLLSLYFEIIHGVLKNVDREVVSEAINIMNRSNDALIKFMEYHISNTDETKGENYQLVKTLGEQLIENCKQVLDVDPVYKDVAKPTGPKTAIDKNGNITYSEEPREKVRKLSQYVQEMALGGPITKESQPTIEEDLTRVYKAISAQADKQDISSSTRVEFEKLYSDLMKFLESSKEIDPSQTTQLAGMDVEDALDKDSTKEVASLPNKSTISKTVSSTIPRETIPFLHLRKKTPAGDWKYDRQLSSLFLDGLEKAAFNGVTFKDKYVLITGAGKGSIGAEVLQGLLQGGAKVVVTTSRFSKQVTDYYQSIYAKYGAKGSTLIVVPFNQGSKQDVEALIEFIYDTEKNGGLGWDLDAIIPFAAIPEQGIELEHIDSKSEFAHRIMLTNILRMMGCVKKQKSARGIETRPAQVILPMSPNHGTFGGDGMYSESKLSLETLFNRWHSESWANQLTVCGAIIGWTRGTGLMSANNIIAEGIEKMGVRTFSQKEMAFNLLGLLTPEVVELCQKSPVMADLNGGLQFVPELKEFTAKLRKELVETSEVRKAVSIETALEHKVVNGNSADAAYAQVEIQPRANIQLDFPELKPYKQVKQIAPAELEGLLDLERVIVVTGFAEVGPWGSARTRWEMEAFGEFSLEGCVEMAWIMGFISYHNGNLKGRPYTGWVDSKTKEPVDDKDVKAKYETSILEHSGIRLIEPELFNGYNPEKKEMIQEVIVEEDLEPFEASKETAEQFKHQHGDKVDIFEIPETGEYSVKLLKGATLYIPKALRFDRLVAGQIPTGWNAKTYGISDDIISQVDPITLFVLVSVVEAFIASGITDPYEMYKYVHVSEVGNCSGSGMGGVSALRGMFKDRFKDEPVQNDILQESFINTMSAWVNMLLISSSGPIKTPVGACATSVESVDIGVETILSGKARICIVGGYDDFQEEGSFEFGNMKATSNTLEEFEHGRTPAEMSRPATTTRNGFMEAQGAGIQIIMQADLALKMGVPIYGIVAMAATATDKIGRSVPAPGKGILTTAREHHSSVKYASPNLNMKYRKRQLVTREAQIKDWVENELEALKLEAEEIPSEDQNEFLLERTREIHNEAESQLRAAQQQWGNDFYKRDPRIAPLRGALATYGLTIDDLGVASFHGTSTKANDKNESATINEMMKHLGRSEGNPVIGVFQKFLTGHPKGAAGAWMMNGALQILNSGIIPGNRNADNVDKILEQFEYVLYPSKTLKTDGVRAVSITSFGFGQKGGQAIVVHPDYLYGAITEDRYNEYVAKVSAREKSAYKFFHNGMIYNKLFVSKEHAPYTDELEEDVYLDPLARVSKDKKSGSLTFNSKNIQSKDSYINANTIETAKMIENMTKEKVSNGGVGVDVELITSINVENDTFIERNFTPQEIEYCSAQPSVQSSFAGTWSAKEAVFKSLGVKSLGGGAALKDIEIVRVNKNAPAVELHGNAKKAAEEAGVTDVKVSISHDDLQAVAVAVSTKK

SEQ ID NO: 1378 - protein, 82 aa, Saccharomyces cerevisiae; identical to SEQ ID NO: 528
  source: /note="strain ATCC 204508 / S288c"

SEQ ID NO: 1379 - protein, 135 aa, Saccharomyces cerevisiae
  source: /note="strain ATCC 204508 / S288c"
MSDAVTIRTRKVISNPLLARKQFVVDVLHPNRANVSKDELREKLAEVYKAEKDAVSVFGFRTQFGGGKSVGFGLVYNSVAEAKKFEPTYRLVRYGLAEKVEKASRQQRKQKKNRDKKIFGTGKRLAKKVARRNAD

SEQ ID NO: 1380 - protein, 130 aa, Saccharomyces cerevisiae
  source: /note="strain ATCC 204508 / S288c"
MTRSSVLADALNAINNAEKTGKRQVLIRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 1381 - protein, 138 aa, Saccharomyces cerevisiae
  source: /note="strain ATCC 204508 / S288c"
MANDLVQARDNSQVFGVARIYASFNDTFVHVTDLSGKETIARVTGGMKVKADRDESSPYAAMLAAQDVAAKCKEVGITAVHVKIRATGGTRTKTPGPGGQAALRALARSGLRIGRIEDVTPVPSDSTRKKGGRRGRRL

SEQ ID NO: 1382 - protein, 153 aa, Saccharomyces cerevisiae
  source: /note="strain ATCC 204508 / S288c"
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 1383 - protein, 160 aa, Saccharomyces cerevisiae
  source: /note="strain ATCC 204508 / S288c"
MGKSHGYRSRTRYMFQRDFRKHGAVHLSTYLKVYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 1384 - protein, 199 aa, Saccharomyces cerevisiae
  source: /note="strain ATCC 204508 / S288c"
MSANEFYSSGQQGQYNQQNNQERTGAPNNGQYGADNGNPNGERGLFSTIVGGSAGAYAGSKVSNNHSKLSGVLGAIGGAFLANKISDERKEHKQQEQYGNSNFGGAPQGGHNNHHRQDNNNNNGGFGGPGGPGGQGFGRQGPQGFGGPGPQEFGGPGGQGFGGPNPQEFGGPGGQGFGGPNPQEFGGQGRQGFNGGSRW

SEQ ID NO: 1385 - protein, 195 aa, Saccharomyces cerevisiae
  source: /note="strain ATCC 204508 / S288c"
MPRAPRTYSKTYSTPKRPYESSRLDAELKLAGEFGLKNKREIYRISFQLSKIRRAARDLLTRDEKDPKRLFEGNALIRRLVRVGVLSEDKKKLDYVLALKVEDFLERRLQTQVYKLGLAKSVHHARVLITQRHIAVGKQIVNIPSFMVRLDSEKHIDFAPTSPFGGARPGRVARRNAARKAEASGEAAEEAEDEE

(The sequence listing continues in the following parts.)

The invention claimed is:

1. A method of treating a gastrointestinal protein malabsorption disease, disorder or condition in a human subject in need thereof, comprising administering to the human subject a nutritional formulation in an amount sufficient to treat such disease, disorder or condition, wherein the nutritional formulation comprises an isolated nutritive polypeptide comprising the sequence shown in SEQ ID NO: 240; wherein the formulation is present as a liquid, semi-liquid or gel in a volume not greater than about 500 ml or as a solid or semi-solid in a total mass not greater than about 200 g.

2. The method of claim 1, wherein the isolated nutritive polypeptide has an aqueous solubility at pH 7 of at least 12.5, 20, 30, 50, or 100 g/L.

3. The method of claim 1, wherein the isolated nutritive polypeptide has a simulated gastric digestion half-life of less than 2, 10, 30, or 60 minutes.

4. The method of claim 1, wherein the isolated nutritive polypeptide does not form insoluble aggregates at 95° C., pH 7.1, when present at 10 mg/ml.

5. The method of claim 1, wherein the formulation further comprises a pharmaceutically acceptable carrier.

6. The method of claim 1, wherein the formulation further comprises a component selected from the group consisting of a tastant, a protein mixture, a polypeptide, a peptide, a free amino acid, a carbohydrate, a lipid, a mineral or mineral source, a vitamin, a supplement, an organism, a pharmaceutical, and an excipient.

7. The method of claim 1, wherein the human subject has a dysphagia selected from the group consisting of an oropharyngeal dysphagia, an esophageal dysphagia, and a functional dysphagia.

8. The method of claim 1, wherein the nutritive formulation is administered in an amount effective to increase serum albumin and/or a serum clotting factor in the human subject following administration.

9. The method of claim 1, wherein the nutritive formulation is administered in an amount effective to reduce inflammatory infiltrate in the gastrointestinal tract of the human subject following administration.

10. The method of claim 1, wherein the human subject has a gastrointestinal disorder or a short bowel syndrome gastrointestinal disorder.

11. The method of claim 1, wherein the nutritional formulation is administered in conjunction with an exercise regimen, or wherein the nutritional formulation is administered as an adjunct to a surgical procedure.

12. The method of claim 1, wherein the subject is immobilized or mobility-impaired following a surgical procedure.

13. The method of claim 1, wherein the nutritional formulation is administered as an adjunct to administration of a pharmaceutical composition.

14. The method of claim 1, wherein the human subject has an eating disorder.

* * * * *